United States Patent 7,745,391 (HUMAN THROMBOSPONDIN POLYPEPTIDE) - sequence listing, part 224

SEQ ID NO: 581319 - DNA, 638 bp, Homo sapiens
tggataactgtgtgcctactcattgacttggaaacatgaaatagtcccagattctatatcttaaggagcaatttatagggactaactactcttggcaaaggacaagcccagtatgcggtctaaccaattgccaaggatgatcagcgaccatagaactgttatcagattgtcatgggattattgcgttgtacgagatctagttcattgtaaattaacctagactcagaatagtaactggtaccacagtgagagtagaatagggacgggatttacagaagtcagccggaatccaactgtattgttaaccctttaacttcctattaactaagcatctttatcttggtggtagggtctaccttctgcttccctggaaaggatgaatttacatcatgggacaagcctatcttccaagtctattggtggtgggtccgcttgtttggggttgttggcagctaggagataaaaatttcaaaatacaattaaaagttcttagaagataatgtcttaatttgtaccaattgcgaggtagaagtagaggcctaccttgaattaagggttatagctcagtttgtaacacattgtggaagaataggtaccagcttgggaaggaaaatgtatataaaataaagcaacgtgtt

SEQ ID NO: 581320 - DNA, 393 bp, Homo sapiens
  misc_feature (1)..(1): n is a, c, g, or t
naggcatggaatacactgtggtcatgtcatacgtaacatctcagctctgcattaaatatcccatcataactggtaagtacagggcactctagtgacactgacactgcgtctgtactctatagtacaatattccactgtgtgtaagaatcaacgtcagttaatgtcagtgctactataccataagatagtttgaactcaactattaaagttgcaataactctagagcatatggtcaggactaggcattgtaacctgcgcgtatcgctgttacttcgccagactgacaggctccatgatagttaggaactgtgagtctgacattagctatggcggtgaaaacctggaaggcacagtcatagatagtcgcggtgtgcacacaggagaacgcaacac

SEQ ID NO: 581321 - DNA, 161 bp, Homo sapiens
gtacttttcacaggtctcctgactcgtgatctgcgctcggcctcccaaagtgctgggattactggcatgagccactgcgcccggcgaacgcctgactaatttttaagaaatttcttgtagagactaggtctcactagtcttccaggctggtctcgaactcc

SEQ ID NO: 581322 - DNA, 86 bp, Homo sapiens
  misc_feature (45)..(45): n is a, c, g, or t
aaatagtgaccttagggaaagcacatatggatatgaatttcattnccatatgatctgaaaccactggatggctgaaggtgttaata

SEQ ID NO: 581323 - DNA, 229 bp, Homo sapiens
cgtactgcgacctctgttattgtaatgcagacggaggaccaacatagaacatactcgccagtactcggctgtgcaaaacaggggctagcgctgaagtacaaatgggaacacgtgcttcttcctgttttacatcaatacttagaacacgacttggatcctacaagcatctggactctaggtctcagtactggagtgtctcacccatgggccccacgcagaaggcgcctaa

SEQ ID NO: 581324 - DNA, 204 bp, Homo sapiens
cttgtctgcgttccgtgttcatggctggtgcagtgctccgcggggccggatcctccgcgcggccgagtcctatctcctgggaaatggggcggacagtgtttccctgactgactattgtgagcgccctctctctcctggctggaacggagaccatggtccccaatcagggcccccgggcccctgttgaaaatcggagggcccctg

SEQ ID NO: 581325 - DNA, 469 bp, Homo sapiens
gaataaagagaagtatataaagtaccatgacgaaacatataaatgaagtggcctatatcactaacaaataatatctgagttcaaagaaacagtatttggagaacagagaataattcacaaccatgcatgacattcaatgcacactgatcactcacaccaagctgtgcatgatactgtttcagaaattctaatctgttctagctctaacattgctaactctctagcagaaaatacacaggcagtaacacagtccctatagacattgtacttataggaggctcaatccagttataactgaaagcacatgacctggtaaggatgttacaaaataatagctgtcagcaaaggagggcttataatttcaaaggatacttttaattctgctttaatttaaggtgccaagaagctatttaagtgattacatttgaccaaatgtagcactaatagccattgtcatcttctccgcgat

SEQ ID NO: 581326 - DNA, 198 bp, Homo sapiens
  misc_feature (16)..(16): n is a, c, g, or t
  misc_feature (63)..(63): n is a, c, g, or t
  misc_feature (73)..(73): n is a, c, g, or t
  misc_feature (117)..(117): n is a, c, g, or t
  misc_feature (159)..(159): n is a, c, g, or t
  misc_feature (182)..(182): n is a, c, g, or t
  misc_feature (193)..(193): n is a, c, g, or t
atttctgaaacatttntgaaatgttactaattcacaacaagattacaaatatattcctaaganctggataaancgacttcataccacagtagggaaagagctgagctgagccacagnagttataattgaccaaaatcacttatcttttagttacaggtnagactcactttaaagagattaanattcttccacnaatat

SEQ ID NO: 581327 - DNA, 81 bp, Homo sapiens
gccgcggacacggccatgtattactgtgcgacagtaccgtacagtggtgacccgaaaggctttgactactggggccaggga

SEQ ID NO: 581328 - DNA, 818 bp, Homo sapiens
ggtaagggaaactgcgaggcgaacgtgaccgtggtaccgagcatttcagatctgctcggtagacctggtgcaccaccaccatgttggtgcaaggctggtgtgtctccgtgtattaccttctagggtttgccacccagctttcaccaatggcctcccctgttgtgaagaattccatcacgaagaatcaatggctgtggaacacctagcagggagtatgcgcacctaaagcaagaattggggatccggctggtgggaggaactgtgccgagaatcaacagaggcgagcattggaaccatcgatggaaagatatttagaattgatcagatgggaagatggtttgtagctggaggggctgctgtggtcttggagcattgtgctagtatgggctttgggactgtctaattgagattggagctattgaaaaaggctgtaattttggcctcagtatgtcgaaggatagaattcattccacctatatgtacttagcagggagtatgggtttaaacagtttgtctgccatagcaatcagcagaaccgccttgttctcattgaacttcattgactgagagggctcttgggtgacaaattggtgtgacctttggcagcatggttggcgctggaaatgctggttacgatccaaataccatatgacagatgccaggggccaaagcgtttgctggtgcgtaacttctggttggatcggtggcgggtgggtccctggccattttagggggcccttctctccaggtggttgtacacagccgcgctgggggggcgtccacttgccggttttcgccgaaattttctctttggtgcc

SEQ ID NO: 581329 - DNA, 321 bp, Homo sapiens
cccccccccccccccccggggccggggttggggcctggttttgggggccaagggggcccccccccttatttcccccccccctttttccccccctttggggatggtggggggggggggatttagttttttttgggttttcccccggccccttttttttttggggccgtttttttaagggggggggggggggtttttttttttttttttgtttttaggaaggcctttccccttttcccccccccccccaccccctgggggggcccggaggggggggtttttttccccgggtttttttgggggggtaaaaaggggcaaaaagga

SEQ ID NO: 581330 - DNA, 255 bp, Homo sapiens
gggcccccttttttaaaaaaaaaatttttttttaaagccccaaaggggggtttttaaggggccccttttttccccccccgggggtgtgggtttttttttaaaaaaaaggttaaaaaattttccccccccccctttgggcccccaacgccctttttaatttttcccatttttaaggggggggggggggggggggaggggttttttttttaaaaagggttttttcccccaaaaaaaaggggttttttttttttttta

SEQ ID NO: 581331 - DNA, 394 bp, Homo sapiens
  misc_feature (222)..(222): n is a, c, g, or t
  misc_feature (232)..(232): n is a, c, g, or t
  misc_feature (278)..(278): n is a, c, g, or t
taaatcccttgcgtaagcgcttcgcaactccttggcctcacggtttcactccctgggctgcaaaactgatgaagtgtttcttcaccccatccagcacgccccagagttcttaaaattcagtgaaacccaatgtgccagacatattctctatccagcattgagaccataagtggacaagtctccagttgaaaggtttgtagcttccggcaatgccggactgcngcagacaccnctgtagctcgtccgcatctatctgcccatcctgtccagctacggcnacaaagtacccgtaaagaggatcctgagtttgtgcaggaaacgagggtcctccgggagcccctccgtacccgcctgcgtagtacccgccgccagcgccagggtgcccggggtacga

SEQ ID NO: 581332 - DNA, 298 bp, Homo sapiens
  misc_feature (1)..(1): n is a, c, g, or t
  misc_feature (12)..(12): n is a, c, g, or t
  misc_feature (39)..(39): n is a, c, g, or t
  misc_feature (49)..(49): n is a, c, g, or t
  misc_feature (66)..(66): n is a, c, g, or t
  misc_feature (73)..(73): n is a, c, g, or t
  misc_feature (82)..(82): n is a, c, g, or t
  misc_feature (88)..(88): n is a, c, g, or t
  misc_feature (132)..(132): n is a, c, g, or t
  misc_feature (157)..(158): n is a, c, g, or t
  misc_feature (174)..(174): n is a, c, g, or t
  misc_feature (186)..(186): n is a, c, g, or t
  misc_feature (205)..(205): n is a, c, g, or t
  misc_feature (215)..(215): n is a, c, g, or t
  misc_feature (251)..(251): n is a, c, g, or t
  misc_feature (264)..(265): n is a, c, g, or t
nttccggcgganagctccaccgctgaggccgacgaggcnagtcctttantataagcccctactggnactatantatacgttngggggncgctactacaaaaattttcttttctttttgtgtttgcttattgngtacttagctatagataatttttgnntacaaagcctacgggncatataaatgcnatagttaactgatcctgtntgctgatgtnctttttatggggggggggggacatcttttaatccancatcttctcctgnntcttgccttcctttttcttcttcttagattctg

SEQ ID NO: 581333 - DNA, 327 bp, Homo sapiens
attcgcgggcgcgtcgacaatctatgcaacaaatcccctatgacacaagtttacctatgtaacaaacctgcacttgtacccctgaacttaaaagtttaaaaaaaaaaaaaaaggagttagtggctaataaactctaaataaagcatttcaaacttaaaagcaaaatctagccaggtgccgtggctcacgcctgtaatcccagcacttttggaggccaaggcaggaggatcgcttgaggtcaggagtttgaaaccagcctgagcagcaaagcaagaccccgtttctacaaaaaaagtcgacgcggccgcgaatttagtagtagtagta

SEQ ID NO: 581334 - DNA, 552 bp, Homo sapiens
gacctcgggttactgtctggcaaggccagacgtcccgggccgtcttctattccaaatgctcatcatgcaaagtccataagaaatccagagcacagttcgtggagagaaggaatgcccaaggtgaacatggtagggaggtcttcgattcggtggagcttcaccacgttggagtcgtctgctgggcctgtcaagatccgtatatgggctgcatcgtagcgatctccaattccagtagggaacactgtcactctgttggacctggtggtatcagctgctgtcattccactgaatccacagagacgtccgtgtaacaggatgaccatcgactttgtaggttcccggcctggtaccatgcagttctgaagtcgagtatcgcgcagcaaagcccaaggtcatcacctcgatttggctgggggctccctcccgactgcagtgacgttcacaaggctcagcaaatgggcttgctccgggaccacgttccagtggcacgtcgattgtggtgatgcttccatactgcagcagctgacacctgatagatgaggtatagccgag

SEQ ID NO: 581335 - DNA, 171 bp, Homo sapiens
agtcacctcctaaagtgctgggataacaggcatgagccactgcgcccggaaaggagcctctcattctatggactgaagtcacatattcaatccagacggggatattctagagccccgaccatgtgctcggtgccatgtacctagctatatctacctcttatggtgtgggca

SEQ ID NO: 581336 - DNA, 350 bp, Homo sapiens
ccaggcgtccacgtacttgcaaaagatgtccatgtacaacctgaaatgcccggcggaggaaaactgactggccagtacaccatacagggcaaatgtcatagattatgatcacaaggtgctgctaacatttccccaacgagtgaaaaaccaagggacatcacatttcttacccatcctaccaagatattcctgggaatggcacagtggtcatcaacattaccacactctggatgattatagccactatgacctgcttgatgccaacacccagatgagagtggctgaaggccacaaagcaagtttctgtgttgaagacacatcctgtgactatggctaccacaggcgattct

SEQ ID NO: 581337 - DNA, 748 bp, Homo sapiens
  misc_feature (664)..(664): n is a, c, g, or t
ctactagtagtatctagcggctactacggttgccctactacctatttacgtatataccggaaacataggcctaccgggtagtaggctagtactactagataggtagtacatacaaggtagtatacaacgacatagaaggtagcgtaaagtactatacaacgccagaggaggtagaagaagcgcaagggaaggcgggtagctactatactagccgtagagtagaggacaagaagaacatacatacctaggaggaggggcgaaggagatacctaggtagggcgatagtagggccagactagtacgacgataccctaacgccacctataagtacaagatagctagccagataaaggactagccgctaatagccctactaatagatagcaacctaatagaggaccaagggagagcaaggaaggaggatactaggtagttatatactatactaggggcccccggagtactagcgcccccttaaaagagcgaaaatagatattatagcgcagctaccaagggacgccatacaaggaagaagctagacaggggatcaaggcatgaatatgcaaggcaaactagcttacgagggagggttcaagggaccggctagcaccctaggcaagagaagctaggggggggcagtagccggtcaatacttcccctaggnaggggcaagcctttaggagaggcccctatactaggcgccccctaggcctaggagccatttagggagaccccaaaacctagccct

SEQ ID NO: 581338 - DNA, 284 bp, Homo sapiens
tccctgaacgcaccggtgagcctatgcaccgtttaagccacaagatccgctttagccagttggaatgcaggaaatgttacagtaaaacacgtcccacagtttcgcccaaatttcaagagtttattttcaaaagcgttattggggtatgttggcaccccagggttttcaaagttaatcgaaaagactcttttaaaaaaacttattttgataaattattacacacgcaaaaaaactgatcacacttactgaatctctccacgacatgaaaaataaactttattttc

SEQ ID NO: 581339 - DNA, 1068 bp, Homo sapiens
  misc_feature (499)..(499): n is a, c, g, or t
ttccatcaataaagccatggagaaagaccatgaagaggtggcgacatatggcgtcctagacagtctatggctttgaaatattccagagacaaatggcttcgaggcagatgtggtagtcaccctttcgttgaactgagagaacactgcatgcacgactttcttaatctcgtacagcatgtacaattcacatacggcaggaaccatgtgaatgacttactgttgccaagcagggcaataaatgactggacacctcattgcagtactctctcaatgagtaacaatcgtagtgtgtacctcactagagaaacaaagttgaacccctcctggacactcatgtagcattcctgaggactgaacgctgtgtgcgaccacgaactgtcattgtcgcgattggtgctgacgtggtggccagtactcaggaccagcttgagctctcgaggataaacctgtcagcactggcaggactacgagtgaagtgtcactgaagggcaactttcanatgcagattgggaagcccaaggcactgtcactgcatatccagtcaagttcagtgtctggggaacagcgtaatccctagttgaagcattgagactggggctatattgcatgtacaacgggaaaccccgggggtgatggctgcccgttgtactataaatggggaagttcgtccaaatgcggccagcgcgtcatacctggccacggtatgtgccctaggccgcaaggacggtggccctttttatcgcacttgaggagaaggttgcatttcacattgttttccccgtgggcaccacacttccttggccaaggggctctggcagccacaaggcacaaacaggggggctaggcgcgccagaaagccattaatctttagcccgcggcggaagaagggcaaatagaataggtcaacacatcggaaacaaccgaaaagggacccgagagttggaaccccattttgggtggaaggtgcaacgcccacttggcaaatcgacaggaggtgggtaaccggccctcagcaacgataacacaattatcaggcgtgggctaggttccaagtggcccagaaacgcg

SEQ ID NO: 581340 - DNA, 103 bp, Homo sapiens
gaatatatatatcactcaaacaatgttcaaccagtaactactactaatcaacgcccatcatcatacaaagccccctgcacaatagagatacagatagaggaga

SEQ ID NO: 581341 - DNA, 219 bp, Homo sapiens
tcgaatttaaatcagtagttttattacaatacgcactgacacacaattggaatcggaatgccctgacattttctgacgatttcacggaaagcaaatgtgaccatccacgcagtagagccacccacaccttttcctaacaaaaaggaaaagctttcacatgtcgtaactgaacaatgcaagcttttcttactcttgtcaaacaaacttcagtctcagaaa

SEQ ID NO: 581342 - DNA, 295 bp, Homo sapiens
cagactatccatcttgggtcgctttgctggtacgtgatatgagacagacagttgcggtgggtgtcatcaaagcagtggacacagaaggctgctcagccatcagacagcctgcccgacattcgtcttcaccattcaatgtgagtccagttacccctgtgccacccgagtgcctacattcctgcagacgcgaggggagctgcatcacgtggcttccagggctatgaacctaccccaccgcaatctggagcagctttggactcctgggtgatgtcttcatcgcgccaagtacggcgcc

SEQ ID NO: 581343 - DNA, 354 bp, Homo sapiens
gggcccttcgtctggcccatttcttcaggaaatctcttgaagagaagggcccgaaatacttaaccaagtaggactcccccttattttctccaatagtccccaaccagtacaggtcacttgaagccataaccattcttcttggttaagggatccacgcccttgtttcagaaatcacaccacagaagccgtgtaacgctcacagagcgcatcgctgtgtggatagtgtcgcgatatgacccgggtgtttaaagtgttttctctactctcgataaggccctgtgcgcactgtacggaatgtgggtgtagagcgtgctctccacataggccacacagccgcctgagtcacagagtcag

SEQ ID NO: 581344 - DNA, 533 bp, Homo sapiens
ctgttttttttaatagctcttttggacagcatgtttccaccaatccaacatcctcaatcatgttttgaaagctgtacttccacccttccaatactcctatgcgggggatgtgtcattcaacagcgttagcagtcccctcttgatctcttgtaagattgttgaaaccattctatctgaaacaattatcttcacccactagaaagaaacccatcctatagttagcgaagaacgtgccgcctgaataacatatgctagaatcgcgggcaacttatacactctctctccgatacacccttgaacccaagaggcaccacctgtgtccaggagttgacagtgacatagactctgaaatatagagtccttctcttaccgctcacattggtctatgcattcttgatgtcgaacaactgccgactgagcactatggctctctgagacacgctctgagctttgtacttatgttgatcgatgagcacatgactcgctgctgttaagcatacctcccagaaggcgggccactcattggctagccc

SEQ ID NO: 581345 - DNA, 116 bp, Homo sapiens
gtgcgggttcataaaacagggagttagaataggtcttggtgacaaaatatgttgtgtagagttcagggagagtgcgtcatatgttgttcctaggaagattgtagcggtgagggcgt

SEQ ID NO: 581346 - DNA, 159 bp, Homo sapiens
agttcacgaggcagaggtctggcctcaattagctaaatgtagatgctgctaacagttccctcctcaaaggcaccttggtgctgtgggggcccttgcctcttcccttcccactgggtgccttacaaaacagtgttcttttgaaaatgttcctcaggaata

SEQ ID NO: 581347 - DNA, 1391 bp, Homo sapiens
tataagcctctaagacccatttttaaaagtcagtattttatacagtgttccaagaattaccacaattatgtaatacatctcttacaccattcatactacaaaccatttacgctactcattatactactcccatgtgcatctctaccgttatatccaattctgctggtatactgatcctctagtgctttgtaactacgctgatcacgtcatgtatttataagatcctcaagctcccatagtatatgatgaaccaagaactaattagaaatctcagttgattgacactgagtgtccctcgagcattatacctatatatgggcactcgtgtttgtaagtcgcgtctccattcgcaaatgattctaatctcgatacctagcctgctttactaaagttgctaggtttcacttacttgtttaccttgtggatacctacgatcttaattcctaagcccattcgactcggtttgcaagctatgtctatataatcgcaggacgcaaaattgtttgtgatactagcactaattggtatttggattagtctcttatttttaccttgttatctttagtttattgcaacaactttaataaatgcgtgagaattaccttagttagtttctagggatatccattgaggtattacgatatagggtagtggaaagtgatttttaagttagtattactaatcgaacaaaggggtaatgccaaggttttttgacaaaatacgagttcctagagtcgttgtacaccctccaagtttttcctaattcaatgtttactccggcaatgatcaagtaacacgctgaggtttttaaagttatctacgccatacctttcccatagtaccaagaaccgtaagcaatagcaacctaacggctcatgcgaaccacttaaaaagttgtctcacaaaagccgtatttacacgaggggggaatagcacgggcaataacacatacgcttaggcatttcccggtagttttacagcaagcacacttcagtctgcagaaacttacgtggccaattgcgcatcatctgacatttgcctcctgccagctttgagagagacctagacccgcttgataaattatacaacgttggttgaggtttccccaagtggtatggtaattaagtatcttggccccctgcacattggccgcaccttggagccaatcgacataattacactaggacttgaatttgcccccgattccctccattacgcgtcctactaattgggaggtcaaacacctgtgccagtagtttcgaaacgcttgctaccatcatgtctgtacatctgaaaagactcgggtccgagggaaggttcctgttaggagcttgtcacataaccgccacgcaccacgcccggatatgtgccaaggctcacgacaggactcc

SEQ ID NO: 581348 - DNA, 1074 bp, Homo sapiens
ccatggttgggtacgagtgtgtatttgttgtaaggtagttatgaggaaattcttcttctaggacttgtggggaaggagtgggaaggcgccatgcggttgggtctagtatctgtttgttctgggctgtaagtggtggcaatgtctatgtgaatggaattgtgtttggttgtgtattgtaagccagtaggaggcgtgtggtggtagagcgcgaagtggcgagcgtgggaaggttgtactgggtggggcgggagtctatggctgaggtttgaatgaataatgtgaactaactataatgaccgaaccaatgtaggctatttgtttgcgtatgggagtatactatatatttgatgtggatatcggttgttttaggtgattgacgtgtcctgttctgtcagttattgggagcatgagcgccctagtgtgggaatgctttaggatctgatgttatatctaggctggtgtgtcaaggggtttgcgtagctgtgtatggggtattgtgctatgattgtggtctttgtttgttttgaatgagtgttagggtgtgtatgtgttttttaagtggggtctattgtgtctggtcctgtgtggtgtataaggcggtgttgcatctagtagaggatcacttagtgcataggatacatgggtctgcgatgctttgtgtgcctagtatgtagtatgattgcctagtatagatgactgtcttgacagtatattttagtgagtaggtagctgtcctgcatacctacgtataaaatagcctatatagcgtcttagatgtagttactactacaaggaagtaaatagtacgccgttcgcgctatagagttgtggtactcctacgctgtaagattgatcgggctatgaagagatatatagatattgcacgagaaatatacagtgcaagtgtattgaacactttcttctgatgagtgttcgtctatacctacaggatggagttattactaactgttactagttctagcacctgttttatgtgccgaatcactgtggggtataggtcaggaaggtgtagtccattcaataggtaaattgtaaattaaaaatagataatta

SEQ ID NO: 581349 - DNA, 109 bp, Homo sapiens
cgcaacgtaacatatctcacactaaacgctgttacaaaaatccttcaggccaaatgtataacatttagcaaactttttctgcaaagaatcagatagtaaatgttctaag

SEQ ID NO: 581350 - DNA, 373 bp, Homo sapiens
  misc_feature (7)..(7): n is a, c, g, or t
  misc_feature (14)..(14): n is a, c, g, or t
  misc_feature (19)..(19): n is a, c, g, or t
  misc_feature (61)..(61): n is a, c, g, or t
  misc_feature (316)..(316): n is a, c, g, or t
  misc_feature (358)..(358): n is a, c, g, or t
ctcaagntgatccntcaantgatagaagctagccaggtagctgggcacagcagcacacaantgtagtgccagctactagggaggctgaggcaagaggattctttgagcccaggacttcaggctgtagtgtgcaataatcacgactgtgaatagccagtgcactccagcctgggcaacatagtgagatcctgtctctaaaaaaaatttttttaaaaggagcaagccaggacaagatggagggaaaatattctaaggaaggccacagcatgtacaaaagcctacaactggttgcttttaaaaagctgagctctctttnggggctgggtacagtggtttacacctgtgatcccagcacttngggaggcagaggtgg

SEQ ID NO: 581351 - DNA, 385 bp, Homo sapiens
  misc_feature (78)..(78): n is a, c, g, or t
ttgtatggatataacacagtttacttatcccattcatgcaaatattgatggacatttgagttgtctcccaatttttgnctattaaaaataaagctgttctggctgggtatggtggctcacacctgtaatgtccgaactttgggaggccaaggctgggtggatcacttgaggtcaggatttcgagaccagcctggctaacgtagtgaaaccccatctctactaaaaataacagaaattagcgaggtgtggtggtgcacacctgtaatcccagctacttgggaggctgagaaactgaggcacaagaatcactttgaacccgtgtggtggaggttgcagttagcccagatcatgccagcctgggtgacagaacaagactgcttcttaa

SEQ ID NO: 581352 - DNA, 275 bp, Homo sapiens
tagggtgaagtaaaaagcaaatgagtgacagacataagtaaggagagaatttgaccttctaagctgggcgaagtggctcacacccataatcccagcactttgggaggtagaggccagcaggtcacttgaggtcaggagttcaagaccagcctggccagaatggtgaaaccccatcactactaaaaatgcaaaaattagccgggcatggtggcaggtgcctgtagtcccagctactcggcaggctgcagcaggaaaatggcataaacccgggaggt

SEQ ID NO: 581353 - DNA, 435 bp, Homo sapiens
  misc_feature (12)..(13): n is a, c, g, or t
  misc_feature (16)..(16): n is a, c, g, or t
  misc_feature (70)..(70): n is a, c, g, or t
  misc_feature (75)..(75): n is a, c, g, or t
  misc_feature (374)..(374): n is a, c, g, or t
  misc_feature (383)..(384): n is a, c, g, or t
  misc_feature (389)..(389): n is a, c, g, or t
cgcagtaacacnnccncgggtgatgagaagctcgcggttgatgcctgtaacagacattaactgttcacgnatgtngcaaacatcccccagtatagcctgcaggcgcgagggagaaagatggtttgccagttcggcgaccaggcccggcacatcaacattggtcacctgcgcagaccatgatggcgttttagcgcatccatcagcaacgttgccagccagtgtaaacgcgccggagcttgttcatgattaagggccgctagcagcgaataccagtcgcccgatggcacgctatatgccaacgcctgacacaatgtttcacgagcctgccagttatctccctgaaacaacgccagtgccgcgccaggggaaccggngcttaagcnnaatgnggcaagtaatgcatcctgtgacattgtcacttcgcggtgaaagcca

SEQ ID NO: 581354 - DNA, 143 bp, Homo sapiens
gaaactggaccactgagtgatcagcgcacgtcagtttaaggcctgcgacaacttatttttaactttttaccaacttcctgggccccgaagctttacacagtggaaatatacagaccacgagcacagggactcacggattctct

SEQ ID NO: 581355 - DNA, 190 bp, Homo sapiens
ctcatcttgtaccagtgacaactatgaagagtcctgcctggccttacaccttcagattacttttgatagtgcaaaaaaaaaaagggccatttccttctaatttaacctaataaccttttaaggccctaaaatggttatcaaaagttccttaaccaggttgagtggttaaccaatttgcggttttttcata

SEQ ID NO: 581356 - DNA, 261 bp, Homo sapiens
gaggatccactctctcacactggttagttatgggatctccccccttccacagtatatcttttttttaaaaaatattttttttccatcaaggtcatcttctgtttttcttttttttttttttaaattctttttttttcctttttttctttttttttttttttttctcttctaaataaaaatttttttaagtaggggaaataccagggggtcgttcaacccgggcccgtgaaaacgcaacccggggcccggcggtaaaaacca

SEQ ID NO: 581357 - DNA, 80 bp, Homo sapiens
cagaattttgatgggaatggaacatgtgaatgtcactctgatcacttttatgtaaaaattataatttaattaataaaaaa

SEQ ID NO: 581358 - DNA, 948 bp, Homo sapiens
  misc_feature (948)..(948): n is a, c, g, or t
aaattctgcaagaatataaactatctcatagttggacaaaaaaagaaaaggttgcagaaagcacaccaaatgcactcttttgaagagcataatttgggctatatgttttgctttacccatgaagaaacagcacgtaagaaatacattatcctggaccaaccaggctttcggggatcacagatgtttgtctccatcacaattaaattttcagtgaataaaatacctgctggaatgtgtatttttcctgcctaggcttatgctaaccgtttatgattaataagcttcagaaaccgacgattgtggaatgaatatgacatttaacataacataagcctgaacgggagtcagtgacccagataacatcaatatgctgacactacatgccaatattttgctataaaactctttctttgacacatctaggttggtatgagatatcatctgtcctctacaggtggcctctaggcaaactgagaagaaaaatgtgtgcatatatacaggacatagtttcaccttctcattaatcatctaggaattgggtgaaacatttttgtaatggcagcgtgataaatggactgatttagattttagttaaaataataagtacaacacatttcagatgtatagaatatttttaaaggatacttctagaactacaacaactgtcacagatattacgtgttgacataacttatgttttactgcaacatttacaccttcgtggcctttgatggctccattctccttcttctccctctagaggtatttgctttaacccgttggtcccctatccatttttcctcgggtttgggcccaaacctgtgtttgcctacagggttaccggtgggcccttggcctgccggatccagccatcccgtcggcgcacagggtcttgggtatacccccgacttctcttaacaccgtggtggtcttatttattcgttgggn

SEQ ID NO: 581359 - DNA, 634 bp, Homo sapiens
taaggttaatcatccctagcttcccagaacacttaatcaggacagagacatattctttaatgagctggagatctctaacaacagttctgaaggatcacagggaggacacagcaaactaatctacttctcatgcaataaccaccatttatctgatcgctggagcatagacaatggtctcaaattcacacaataaaaactgcatgcatcagcagcacacaatatacacagcccgccttacatttaggacttagcacccaacagcagaagcaccactcagcacagcaggctggcatcgcctgtgcgcattgtttcgcagatttccacgagttgagggatactggggcagcatcctctcatcagttaactcgagaggcccatccaggggcgcaatcacttaaccaagtggcacaggcacaaagagggcctcccaaatctggttgccaagattctagcgtttactgacgtaatttcctttcatgtttggcccaacggctttctttgccctttattcggtaaggcaccaaaacagcagacattacacaaaattacacgacacaacccacagacgccgaacgaaagtcaagcaagttgcgagtaccacaggaacagggactcggagaacaacgaaggagga

SEQ ID NO: 581360 - DNA, 298 bp, Homo sapiens
cgtcccatatgctggctgcacattatagctcggctgaccatccaaatttcataatagcaacttgaggacccaatcatgtcttaaccatctttgcatttttcagtatgtcttgaatagagaatttatgaaaataaatgtttgcataagctgataaaggagatgaagaaaaacacacagaaggagaaaaccaagggtgtgggatcagaaaatccaagagaagagagtgtttctggagaatgaagcaataactgaatgctgctgagaagtcagaatgatgaagcctgaaaagtttccccta

SEQ ID NO: 581361 - DNA, 133 bp, Homo sapiens
ggaaccggtttcaagcccaaggccaagcaggaaaacggcgaaaggactggaggggtgcctctgatcaaagcccccaaaaaagaaacacccgatgaaaatggttaaacccaaaaagccgatgattttgttttga

SEQ ID NO: 581362 - DNA, 268 bp, Homo sapiens
gaacgcgcagcaggccttggggaaggcccaggcccggcagccatggcgctagaagggaggaatgaaatgtgtgaaggtcttgctctacggccccctgctggccttttgcgccttgtcagtgggactgatttccgtggttgtggggcaaagcttgtcctgagtcagcccatatccaggggctcccgtgctctctgtgccagtggtcatcatcgcgtggtgtctcctctcctgtgctctgtgtctctcggccctcaagagactatgctat

SEQ ID NO: 581363 - DNA, 1048 bp, Homo sapiens
gtgctcgtggacgccgccgaggaagcatcgttaaggtctctcttcagcctgccgtcatgtctaagtcagagtctcctaaagagcccgaacaggctgaggaagctcttcatcggacgggttgagctttgaaacaactgagtgagagcctgaggagccatttagagcaagggggaacgctcacggtactgtgtggtacatgagagatccaaacaccaagcgctccaggggctaccggcgcttgtcacatatgccactgtggcaggaggtggatgcagctagtgaatgcacaggccaccacaaggtgcgatgggaagacgttgtggacacaaagagagctgtctccagagaagattctcaacgaccaggtgcccacttacctgtgaaaaagatactcgtagcgaggcactccaggaacgacactgcaacgacacatcaccgtaagcagcatcatccggacacagtcatggcaaccacctcgcacgtgatagcacctcatgactggaccgacggcagaggcaagcaaaagggggctcaggtcacccggccaacctataggacgagcctgccctccgacgcgtcacacactggcatccaagaaactaccatacaggggcactggccaccaactgggcaccgtacacaaaacagcccagggcaaacggccacgaagaatgggcacacgcgcgtcacatcaaggccccaaaagaacggccagaaggcgagatcagggaaaacactatgctggaagaccagacacaatgtgcgggacccaagagggacaaacaccacacacaacctaacagcagagaccaactaccatggcaccacgatcggctacgcaaacccccacgacgtagtaagcacgcacacagccgacccgcaagacaggacacaaaacggaaaccgacccacacacgagcacaagagccaagagagcaccaacaacagcacctcacggagccctcacaccacaacaaccaacgagcaacacataagcacaacccacccacacaagcccacaagaacagcagacaagcgaaacaaatcg

SEQ ID NO: 581364 - DNA, 444 bp, Homo sapiens
  misc_feature (3)..(3): n is a, c, g, or t
  misc_feature (231)..(231): n is a, c, g, or t
  misc_feature (360)..(360): n is a, c, g, or t
  misc_feature (363)..(363): n is a, c, g, or t
  misc_feature (369)..(369): n is a, c, g, or t
  misc_feature (377)..(377): n is a, c, g, or t
  misc_feature (401)..(401): n is a, c, g, or t
  misc_feature (405)..(405): n is a, c, g, or t
  misc_feature (415)..(415): n is a, c, g, or t
tantagtttgtccatgtgtttttaaagaatgaaaattgacaattttttttggtgggtaaatttatgatgtttacctttttcctgttttgcttttaataatgtctgattagtatttacctataaatcattcaaatgagatcactgggaatattaatggtacaatatcgacaattttgcttttggtgtgtctccagccatctattgatggccattttcggggtcctatttggngtaagtgccgctgatgggagaacaagatttgtcatgggacttgtacgtttctttttgctgatccaattttccattgcttccttttcatatgaatagccatctgatgcggtggcagggtctttcatgggnggnctggtngttgggcntgtgggttcctcaggggttcctgngggnaggggtttcnccttggtcctgagctcttcaattttcctc

SEQ ID NO: 581365 - DNA, 1368 bp, Homo sapiens
  misc_feature (54)..(54): n is a, c, g, or t
  misc_feature (168)..(168): n is a, c, g, or t
  misc_feature (206)..(206): n is a, c, g, or t
  misc_feature (210)..(210): n is a, c, g, or t
  misc_feature (270)..(270): n is a, c, g, or t
  misc_feature (766)..(766): n is a, c, g, or t
  misc_feature (1036)..(1036): n is a, c, g, or t
  misc_feature (1239)..(1239): n is a, c, g, or t
  misc_feature (1241)..(1241): n is a, c, g, or t
  misc_feature (1253)..(1253): n is a, c, g, or t
gagtctcatctgactccactcgggctcagtgcctcatcactgtacctgtgctcncagtcatcaattatagaccccacaacatgcgccctgaagacagaatgttccatatcagagctgtgatcttgagagccctctccttggctttcctgctgagtctccgaggagctnggggccatcaaggcggaccatgtgtcacacttatgccngcgnttgtacatgacccatagaccaacaggggagtttatgtttgaatttgatgaagatgagcangttctatgtggatctggacaagaaggagaccgtctggcatctggaggagttggccgagccttttcctttgaggctcagggcgggctggctaacattgctatattgaacaacaacttgaataccttgatccaaggcgttccaaccacactcaggccgccaatgataccccctgaggtgacgcggtgtttcccaaggagcctgtggagctgggccagcccaacaccctcatctgccacattgacaggttcttcccaccagtgctcaatgtcacatggctgtgcaatggggagccggtcactgagggtgtcgctgagagcctcttcctgcccagaacagattacagcttccacaagttccattacctgacctttgtgccctcagcagaggacgtctatgactgcagggtggagacactggggcttggaccagccgctcctcaagcactgggaggcccaagagccaatccagatgcctgagacaacggagactgtgctcntgtgccctgggcctggtgctgggcctagtgggcatcatcgtgggcaccgtcctcatcataaagtctctgcgttctggccatgacccccgggcccaggggcccctgtgaaatactgtaaaggtgacaaaatatctgaacagaagaggacttaggagagatctgaactccagctgccctacaaactccgtcacagcttttcttctcacttcatgtgaaaactaccccagtggctgactgaattgctgacccttcaagctctgtccttatccnttaccttaaagcagtcattccttagtaaagtttccaacaaatagaaattaatgaataaatgttgacactttgatagcactgatatggagattatcctttcattgagccttttatcctctggtcttctttgaagaacccctcactgtcaccttcctgagaatactctaagaccaataaatacttcagtatttcagaaaaaaaangncgtttacacgtntgactggaaaccctgcgttaccacttattccttgacacatccgcttgcagttgcgtaagccacgagcccaccgatgccttcacaatgccacctaatggtatgcaatgaacctaat

SEQ ID NO: 581366 - DNA, 918 bp, Homo sapiens
  misc_feature (78)..(78): n is a, c, g, or t
  misc_feature (100)..(100): n is a, c, g, or t
  misc_feature (316)..(316): n is a, c, g, or t
  misc_feature (586)..(586): n is a, c, g, or t
  misc_feature (789)..(789): n is a, c, g, or t
  misc_feature (791)..(791): n is a, c, g, or t
  misc_feature (803)..(803): n is a, c, g, or t
ctgccggctgagactcctctgtctcccccacctgaatcatcaccttctcctccactgcaggagacgcccttgtctccnccggaagagtcacccccatctnctgcacttgagacgcctctatccccaccacctagagcctcttcctgcccagaacagattacagcttccacaagttccattacctgacctttgtgccctcagcagaggacgtctatgactgcagggtggagacactggggcttggaccagccgctcctcaagcactgggaggcccaagagccaatccagatgcctgagacaacggagactgtgctcntgtgccctgggcctggtgctgggcctagtgggcatcatcgtgggcaccgtcctcatcataaagtctctgcgttctggccatgacccccgggcccaggggcccctgtgaaatactgtaaaggtgacaaaatatctgaacagaagaggacttaggagagatctgaactccagctgccctacaaactccgtcacagcttttcttctcacttcatgtgaaaactaccccagtggctgactgaattgctgacccttcaagctctgtccttatccnttaccttaaagcagtcattccttagtaaagtttccaacaaatagaaattaatgaataaatgttgacactttgatagcactgatatggagattatcctttcattgagccttttatcctctggtcttctttgaagaacccctcactgtcaccttcctgagaatactctaagaccaataaatacttcagtatttcagaaaaaaaangncgtttacacgtntgactggaaaccctgcgttaccacttattccttgacacatccgcttgcagttgcgtaagccacgagcccaccgatgccttcacaatgccacctaatggtatgcaatgaacctaat

SEQ ID NO: 581367 - DNA, 182 bp, Homo sapiens
cactaggcgtatcctgaaaactggagggccttcaaggctctcatcgctgctcagtacatcggggctcaagtccgcatgttcaccgcaccatacaagttggattttggccaaaccaaccgcacccctaaatttcaccgcaaatttcctgccggcaaggtcccatcatttgagggtgatgatgg

SEQ ID NO: 581368 - DNA, 1064 bp, Homo sapiens
tagggtcccaggacgctacccggggaatgcccccggtataggaagcacagtcgagaccttcgagaaaacaaagcccggagcaaagcgtactccatgggtgcgggatctccaggaataatcgaagggggcagatgaaaagccagataacagcaggaaagtgaacacggctttcaacgggatacaggggactagcttattgggggaccactttgtacggtgggctgaaagtgaattttagtgaagctatttatggcatggattcacgtgaaagcatttacgggttttcgttggagtctgttgttaaggtatggctggcccagtgaacttccaacgctatgctacttcagcccaataagacaactttggaagaaagctgagagtaagtaattacatgaattgtataaacatctagacagcagtgcagcagctagttattgatggctcctatggatattgccaggatttaaacctgagtcaacagagtaatactaacccctatgtgtaactacaagatgtgattgcaacttgctggaacttgcaagtgacaaatgggctcctcccctcgacaatcctgtcattgtgcattgtgtgtgctagacagaatactaagttgcagtatggtcgtactagtctaacgtcgtaggtatcctgttgcttgcttcattacgccctttcactaggtgaattctcccacagtggtctgtatctcgacatttatctttttaaagggaaagaagtatagtatatatagtttccttgttattgatcaggtcctgtacaatggtgtagctaaaagaatcagagtttattgtataaagcaaaatagtttatgttgaagagaaggtactcttccgttattgatatcatggtatgcattaattccatgttgttactattgtgcacaaaagccctgttcacaggggaatggtgtaaacagtttatactgttttgttcactgtatttagtagacataactgttggatagttactgaatcatgactgtaaagaatactgtgaccatcttcaggtatgggatttgctgataattcaagtcaatcatgagg

SEQ ID NO: 581369 - DNA, 171 bp, Homo sapiens
gcacgcccagcctcccacagtgctgggatacaggtgtgagccaccgcacctggcataagtttgttttaaattacagagttgtggtaatttgttacaatggccataggaaactcaaacactagatatttgaaatggtcgatgcatttgtataccatttttaaaaaattcatt

SEQ ID NO: 581370 - DNA, 90 bp, Homo sapiens
aaattgacagatgtgtcctttggaaatagaggagataaattattattggcttttaaaggccaagtagaattttccagctaaagagaagga

SEQ ID NO: 581371 - DNA, 265 bp, Homo sapiens
ggtaccgaggcacagacgctttcctgtggcttggcaactggcatgcggtctaggatcctctacgcacaacgcctgctcgcctcctccgtgtggttgatcggaaatcagggtggacgaagttgttgcgcaacaacttcgtccactctgacctgtgtcaccaagggtgtggacgctcggcgtgtgcagcaacaacttcgtccatcccgatctactgtggggggtgtcttaggggtttggttggttcggggtatggatgttcggcgtg

SEQ ID NO: 581372 - DNA, 790 bp, Homo sapiens
  misc_feature (790)..(790): n is a, c, g, or t
atgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggtgaaaaaatctgatgtttgaggaagtttttatttttatttatttgtttgtttttttttttttggaggcgaaactctttgtcgccgaggtttctccgtgggctaagcctcacgagtagcggggacttctcaggggtgtgcaccacaccacgccgcagaataatctcgtggtattttgcagcagaagacggggaggaagtctctaatttttataaacaaatatctggatgttcagaggccccgtttcttacaataaaatgtggagtcttagtaaagcaggatttttatgaacacccatttcctgacttttggcttaatttaagattttctccatccggtttctagcacaaaatttggcctgctgtgttccaacaatctaatttatgtggtcctgtgccataagtgactattttcacctattctaattccttgggttccgaccatggtaaagttcctaaagaccttttttttaacacaggtagacctttggttcttcacaaccactggggtccgcatttcctttggcagaaagcttgaaggttcggattccggttacatgcataatggcgataactcacttctccggcaataccctgtgcttcttgcan

SEQ ID NO: 581373 - DNA, 1001 bp, Homo sapiens
  misc_feature (36)..(36): n is a, c, g, or t
  misc_feature (90)..(90): n is a, c, g, or t
  misc_feature (108)..(108): n is a, c, g, or t
  misc_feature (180)..(180): n is a, c, g, or t
  misc_feature (226)..(226): n is a, c, g, or t
  misc_feature (228)..(228): n is a, c, g, or t
  misc_feature (231)..(231): n is a, c, g, or t
  misc_feature (244)..(244): n is a, c, g, or t
  misc_feature (255)..(255): n is a, c, g, or t
  misc_feature (259)..(259): n is a, c, g, or t
  misc_feature (262)..(262): n is a, c, g, or t
  misc_feature (266)..(266): n is a, c, g, or t
  misc_feature (281)..(281): n is a, c, g, or t
  misc_feature (297)..(297): n is a, c, g, or t
  misc_feature (301)..(301): n is a, c, g, or t
  misc_feature (304)..(305): n is a, c, g, or t
  misc_feature (307)..(307): n is a, c, g, or t
  misc_feature (310)..(310): n is a, c, g, or t
  misc_feature (316)..(316): n is a, c, g, or t
  misc_feature (321)..(321): n is a, c, g, or t
  misc_feature (326)..(326): n is a, c, g, or t
  misc_feature (333)..(333): n is a, c, g, or t
  misc_feature (337)..(337): n is a, c, g, or t
  misc_feature (341)..(342): n is a, c, g, or t
  misc_feature (348)..(348): n is a, c, g, or t
  misc_feature (361)..(361): n is a, c, g, or t
  misc_feature (366)..(368): n is a, c, g, or t
  misc_feature (371)..(371): n is a, c, g, or t
  misc_feature (374)..(377): n is a, c, g, or t
  misc_feature (382)..(382): n is a, c, g, or t
  misc_feature (388)..(388): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (401)..(402): n is a, c, g, or t
  misc_feature (407)..(407): n is a, c, g, or t
  misc_feature (409)..(411): n is a, c, g, or t
  misc_feature (418)..(418): n is a, c, g, or t
  misc_feature (425)..(425): n is a, c, g, or t
  misc_feature (427)..(427): n is a, c, g, or t
  misc_feature (435)..(436): n is a, c, g, or t
  misc_feature (441)..(441): n is a, c, g, or t
  misc_feature (453)..(453): n is a, c, g, or t
  misc_feature (463)..(463): n is a, c, g, or t
  misc_feature (470)..(470): n is a, c, g, or t
  misc_feature (474)..(474): n is a, c, g, or t
  misc_feature (481)..(481): n is a, c, g, or t
  misc_feature (488)..(488): n is a, c, g, or t
  misc_feature (493)..(493): n is a, c, g, or t
  misc_feature (495)..(495): n is a, c, g, or t
  misc_feature (500)..(501): n is a, c, g, or t
  misc_feature (503)..(503): n is a, c, g, or t
  misc_feature (506)..(507): n is a, c, g, or t
  misc_feature (535)..(535): n is a, c, g, or t
  misc_feature (539)..(539): n is a, c, g, or t
  misc_feature (549)..(549): n is a, c, g, or t
  misc_feature (553)..(553): n is a, c, g, or t
  misc_feature (560)..(560): n is a, c, g, or t
  misc_feature (571)..(571): n is a, c, g, or t
  misc_feature (575)..(575): n is a, c, g, or t
  misc_feature (585)..(585): n is a, c, g, or t
  misc_feature (594)..(594): n is a, c, g, or t
  misc_feature (600)..(600): n is a, c, g, or t
  misc_feature (602)..(602): n is a, c, g, or t
  misc_feature (605)..(606): n is a, c, g, or t
  misc_feature (612)..(612): n is a, c, g, or t
  misc_feature (618)..(618): n is a, c, g, or t
  misc_feature (621)..(621): n is a, c, g, or t
  misc_feature (627)..(627): n is a, c, g, or t
  misc_feature (629)..(629): n is a, c, g, or t
  misc_feature (667)..(667): n is a, c, g, or t
  misc_feature (733)..(733): n is a, c, g, or t
  misc_feature (971)..(971): n is a, c, g, or t
tagatagggtggggagaggggagagggaggaggggnggggaaacacgtcttaaaataaactctttagagactaagtgggtgtgtcttttncacagtagggtggagagnggggaggggagggggcgggggtccccttcccaatgtccccgcgggcttgagtaccaggcggcggggccagcnccgccgcgatcgccccctcttcccctccctgttaaatacacaaatntnttnttttccatatgantcgagtctgtntccngcngaanaaaaacatacaaaanaagtggaagggggggnttgnganngnggngggggnagggntgggngcagggnaggngggnnggagtncagtgtggtttgnggggnnnctnggnnnnagggngggtgngcacnggntgngnngtggncnnnagtgggnggggtgngngcaggggnngaagngagggggtgtgngtgaaggggnaggggangttnagaaggngtgtgcnttgancncaagnngnagnngagagcggtggctgaggtgggtgatgancttntgtttgagcngggncacctgntccgcggaggnggcngggggtactngagagggcngcgttntnggnnttgagngtgttnacnttgtgntncaggcgcgcgaggcgtccagcttgggcttccgggactnggtggcggcgagccggttccgcagccgcttgcgctccactttgatgcgctcttggtcttccatgtngatgggggacaccggcggcgtggcgtcccggctgcgcgcctccggcacgttctgcggttcctccttgaaggtggaggcgccgcggcccaagcccagctgcgccgggtggccaccggcgaagggcggcgcgtgtgggaggtagctgatggtggtcgtcgggtacgagctcccggtcccgacggcagccccggcgccttccgaggacgcagaggctggggagtagctgctgaggttggtntaacgggaggtgggtccgggccggcgtaga

SEQ ID NO: 581374 - DNA, 227 bp, Homo sapiens
gcacgctaagctactgtaagtacgcactcttctaccgcggtgtacacatagtttgccaggtgtgcgcgtctatcccaaggggtctaggggaccaaattccagctacccgccatcgggaggcacggtaagagaccgtaaggggacacaatacccgagcaccgcagatagcgaggtctccgatgcgctaccagtctgtcaacagaggcttcgggaccgcggggtccctt

SEQ ID NO: 581375 - DNA, 1032 bp, Homo sapiens
agttcaccaccccgaaatactttcttctaccgtcaagacccatgtatctaataattatgggactgatcgtcatctgtgctgtcattactcactagcaagaacagatagtcatgcattatggaacacaaccttacagatgtattgagtgcagatcaaagccttgaatcatggcctcacacatgactgtactgtcacggtaaagtcatcctggatgagaaacggactatacatgttgagctgctgctggcaaggtctttcaggtccataaaatcaagacccttgcgacagtcgatttgtggaatatttcgatacttggaagatgaaacgcatacaagaattgtacatggacatgtccatctagcaacgtttcagtactgctaaactcaatgtcccttgactagtcaaatctgtaatgatgtcacacagtagtaggcgaaaccttactaaatgtcattgacgatgtgacatggtcctacagctcgatatctactgccttgtggcttagattcatgaaatgcgtcatacttggagagaacacctatacacgctaattcatgtagatgtggcaagatccttttagtggtgaggatcaacacttaccaaccgtcaggtaattcatattggcaagtaaaactctacaaaatgcgattgtaatgtggcaaggtcgtacatttcagacttttcggggccttgctaattcattcagagaatggcgcactgggtgagatagctatacaagtgtttagtggatgtggtacaggccttcaatccgacttcagccgtgccaggcattggagaatcatactgggaggaaccgtcacactgcatgagggtggtagggtttcagtggaactccacctggagagggcgcggagagttcactggccacaaaccttcagtgtagactgtggtcaccttagggttaagattaccccgggtccccatggcgaagccttcaggttcacgtggaaggcctgtcgttaccacaccgggccatggaacaagtaggcccatggccccataatatagtaa

SEQ ID NO: 581376 - DNA, 799 bp, Homo sapiens
agcggtgcgggaagtctgaagccggtaaacatggccgtcaccgacagcctcagccgggctgcgactgtcttggcaactgtgttgctcttgtccttcggcagcgtggcccgcatagttcatatcgaggagtcaagcagtagacaattctttagaagtgggccatacgaaacaactggggctgttctggtagtgtacatcccgtattctgcgtttagattgatcggacatgtctgcaacataccctcttctgttatatagacagtgtcaaggaggctaggtagtccctgacagtcacattcgtcctagatgcttgcggcatgactatggacctgtacatcctagtaaatcccaaatgcagactacagttgttgatgtcactaagacatatggtaactaagatgtgtcatggcagatgcatgtggaacgtggattatagaagttcatgaggtaacgtgtggcagaatttctcctaggggtattaactggggggatcccagccatagtactccatcggttccagagaacgtcttctttgctgatgacagaagcaagtattctaactttactatgacatgggcttggtggacatggttacttaaaatttcacgattctgaagaagttaccatcatagaactcgcggatgcttttgaacaatgtgtggcagaatgagacgctacaattgagctactgggtattcatttgatactttgccaaggagcatcccatgtattgaagcgatttgattcctccttaacattaatgggctctagctaagtaagtccgagtggggcacgaacg

SEQ ID NO: 581377 - DNA, 247 bp, Homo sapiens
  misc_feature (21)..(21): n is a, c, g, or t
  misc_feature (94)..(94): n is a, c, g, or t
  misc_feature (229)..(229): n is a, c, g, or t
  misc_feature (232)..(232): n is a, c, g, or t
  misc_feature (244)..(245): n is a, c, g, or t
ttccctgatcctacttttaanattttcctgtccttgatagaaaacattattatagtttaataatgttttgttgttgttggtttttgttttttgnagctccgtctaaaaaaaaaaaaaaaatcaggggcagttgtgatggctaacacctgtaaccccagcacctttagaggcccaggtgggaggatcccttgaggccaagagtttgagatgagcctgggtaacatagggnaancctgcctctacnnaa

SEQ ID NO: 581378 - DNA, 204 bp, Homo sapiens
  misc_feature (135)..(135): n is a, c, g, or t
  misc_feature (159)..(159): n is a, c, g, or t
  misc_feature (198)..(198): n is a, c, g, or t
gccccctacaccggccccgactccgttgccaggtgctctggactacattgtccttctccacggcgcttgtacggcgagagttgacctctaatccaccccgcccggccgccctcgtcttgttgcgccgttgccctnccttgcacctccgccgtcgcccantctcctgcctgggttcggtttcagcatcccagcctccancccggg

SEQ ID NO: 581379 - DNA, 465 bp, Homo sapiens
agtctctacagatcccccggccgccacagctactcctttaagatacatcctgaatatgctttatctcacaggcacattttctatatttttatcacataatatactgtaatttccaaaagtataattctatatcacttaagttgaacaacagaacaatgcttcatatagtttatgaagttcaagtatgcaaagaatatacactagctttcttttatagcggtgctatcaatacagagaggcttgggggtcagcaaagggtaataggattggtaataccaattattatagtactcgctgcaacttcggcataggtgtgttggctctacaccatgttatcccaatcatctttgggaattcctatgcatgttgattgtctgatatcaggagttcaggatcatcctgtgctacatggttaaatcccttttctctactattaatactattttttaaactttttttaaaatt

SEQ ID NO: 581380 - DNA, 446 bp, Homo sapiens
  misc_feature (13)..(13): n is a, c, g, or t
  misc_feature (42)..(42): n is a, c, g, or t
  misc_feature (64)..(64): n is a, c, g, or t
cagagatgagcangtcaattagtcagctagagtccctgaccngggaattacgggaaaggaaacngaattttagggaattccaagtcacaagcagacaaggattacttaccagctgcaagctgtattggaagctgagcgaagagacagagggcatgattctgagatgattggagaccttcaagcacgaattacatctttacaagaagaagtgaaacatctcaaacataatcttgaaagagtggaaggagaaagaaaagaggctcaagacatgcttaatcattcagaaaaggaaaagaataatttggagatagatttgaattacaagctcaagtctatacaacagcggttagaacaagaagtaaatgaacataaagtcaccaaagcacgcctaactgacaagcaccaatctatcgaagaggcaaagtctgttgccatgtgtgaaatgg

SEQ ID NO: 581381 - DNA, 955 bp, Homo sapiens
tcgccatgagcccgtaagcaggcgcctctgcaggcctcctagtgacctccgggctagccatgtgatttcacttccactccataacgctcctcatactaggcctactacatcaacacgctaagcatataccaatgatggcgcgagtgtgacacgagaaagcacataccaaggccaccacagcaccgacgtgtccaaagataggcctatcgatagcggagataatcctattgtagttaccctcagaagtttctttgcttcgtcgaggattgtatgtctgaggcctgtttaccactccagcctagccccgtaccccccagatgtaggagggcagatggcccccaagcaggctactcacctcgctgaatcccccctgagaagtcccactcctagaaacacaatccgtattactcgcatcaggagtatcaaatcagctgaggctcagcatagtctaatagagagaaacaaccgaaagcaaataattcaagcactgtttattacaatggtactgggtctctattttagccctccgtacaagcctcagagtagttcgagtctcccttcaccattgccgaggcagctacggctcaacatttttggtagccacaaggcttccacggagttcacgtcattatggggtcaactttcctcattatctgcttcatccgcaactaatattgcactttacatccaaacatcacttgggctcgaagcgccgctgatactggcatagagacgtgcgagagcatgcggatgtctcgtctatgatgaggtcttgcaaaaagaagaaacaaggcacaacgccatgaaagcaggggggggcgccaaaaggacccagggggccgaccaaaccattgggaggggccaaagaggagaaaaagaggggggaaacccggaaaacgtggggagaaccttggggctggacccaagggcggcaagggtgcactggcgccgtaac

SEQ ID NO: 581382 - DNA, 124 bp, Homo sapiens
gaagcatggataatatctgaagagtctcataagactgcatgtggccaatggatttcccagaagaaatcgtgagcgaggctgaatattctgagaaacctcactaaatagaactctctccttcaga

SEQ ID NO: 581383 - DNA, 197 bp, Homo sapiens
ggcggtctcttcctgacttccggcaacagaccattattctgtcagttacgatgtagcaggtcaattatacttcttttaaaaagtttttaggaggctgaggcaggagaatcacttaaactgggagaggcggaggtggcagtgagccaagatcatgccacggcattccagccggggcagcaagagcaaaactcggtctc

SEQ ID NO: 581384 - DNA, 229 bp, Homo sapiens
tgccggaccgagttggacgtgggactgaagaagctaggaggggctcaacagctggaggtctagatccacttaatttttgtactgcaacgggctcatcgccgtgtttcattgagaagacacgtgcggcgtagggcttctgtcaccgaaaaggggtcgcagtttgcagaggggctacgatcttcaaagtaacccttcttctcctggccgacagtccggggaatgcgtatgc

SEQ ID NO: 581385 - DNA, 839 bp, Homo sapiens
gagacctgggggtgcaatcgatgagagatgcctgtatatgatgtgatacccgcgggactgtcctcgttggaaagcctgcatcgcgagccctaggtgctctccatttgaggaagttggctgggggagtgggtgcttgccttgcggatgcgtcactgctccccgctgccctgcccccaccgtcccagcctctgctgcctgctaaacgccctggagagcggagctgtgcactgttgacgattcctcggctgggctggcacaggcaccaagatgtccaagcgagtggtcttgcctgagaagccagtcacgcctgggagctggtacacaggccatcaggaacgcagctcgaatgcacagactagaaggtcctggctatccacaagtcacagtactacaaaaagacctgactagagccaaaatatggcccccccatgcagggaaaataccgaacgttgcagagagacataggttgcatgccaaatgagctaacacacaaccagaagtgagtcatcccgcacaagtcacccagcggagaaaacacttacaaaaccttgaggaccatactcaattcactgttagcacccgtaatctacgcagtgtgacaacttatccaagacggctggcacataactattacctacggggaagcaaacccatccgaggcaaacgcgacaccgtcccggcaaaatcgggcacgccagaaaggcagcatccaaccccgggagggagcacgggccaggaacaggacacaggggacactggctgcggcaaccgcgacacggcacaaccaggcaagccaccagcagcgacaagcagctagaaccaacacaagaaacccggga

SEQ ID NO: 581386 - DNA, 147 bp, Homo sapiens
gggcttagcagcagttgatctgtagaatatcttcaaaggagagatgtcaactattctgcactattcccagcctctgctcctccctgtactaccctctccccgtccctctctccctcacagttcacccctacaatttctcatccttgg

SEQ ID NO: 581387 - DNA, 348 bp, Homo sapiens
tccacataggtgcaagcagttacagtatgacctggataaacgacatgtacggttaacgagccggctgcagtgactcacacctgtgatctcaacacttggggaagctgagcacgggaggatagcttgagcccaggagtaggagaccagctagggcaacgtgatgaaacccggtctctacacctaccaacaacatcagccaggcagtggtggcacaagcctgtggtcccagctactcagaaggctgaggtgggcgtatggctcgagcccaggaggtcacggctgccgccacgctgtcgcaccactgcactctagccggggcaacagcaagaccctcgtctcaaacaaaga

SEQ ID NO: 581388 - DNA, 338 bp, Homo sapiens
  misc_feature (325)..(325): n is a, c, g, or t
tgctctagaggacccgatcagagcatacccctatatgcagctgaataacagagggatttctttcatcctggcagaaaatgtgtgtgcttactttttcattataacccttgggcaggaaacatccagccacaaagaaggctttctcccctctaacaaattttggtattggtgaatccgatattgaatatatgggaataacccggaggaattctttccaacactattaatttataccggaccctttcctgctgtggaaactttaatttccccgatatttttaaattcaacctacaatgtttttatcaagaaggctagaacgacagcnatgcatagaaagg

SEQ ID NO: 581389 - DNA, 371 bp, Homo sapiens
  misc_feature (137)..(137): n is a, c, g, or t
gttggcgaggcagtctcatcaggcgctgacgcgtgtgacaaggactgtcggtctgggacgcagctgggttgggggagatgaaatggaggcgcctaagcggcggtccggggtttgggtagggcgagacttcgtccggnctcggagtgagggggggggggaggtcgcagcaactgagacaggaaaagtctgcccggctggtgcggcacggacacgttttcggttcgaaccaaggcaagcagagccaaacggagcgaacaagaccaagccgtgggcccctttctttgcttgggacacccggagcggagccggatctctgctttcacgtgatgctagggcaagccctagtgtaggccccaggccttcagactggc

SEQ ID NO: 581390 - DNA, 1026 bp, Homo sapiens
  misc_feature (245)..(245): n is a, c, g, or t
ggccgaccggagcctcgctgctgcgcgtccctagacggatctttcctcatgagtccgagatggctgctacatcatagttcagtgttgggtgacacagcgtaggaccatagaatgcacctgtcgaacaggtctgctcgaagagatcgagagcatacgcagtgaatgcccgtcacgagtgcgcagcatagtagatggagcgcacgtatacgataggtcgctcgcgcctagtgagctgatgcctgtanagagtccttcctatcacgtagcgtctcgtactggttggtccttgcaggatcgctgtcaccgatgcgatcgtctcgtggcgtttccttcatgctccttctgtgacgggagacatctgccttgcgcactgtatcggcactccgactgtgaccatgcgacgcaacgtcggaagcgcgtacgaatactcagtcaggctcgtgacctctgactgactgtgcagggacacggggaagacttgacgggatcgtttcagcatgcgtagcgcccccgtaaatccatcactagggattgcgcattgtgccttccggtttccttgctttgtccacgcattaatcttgatgtctgacacactcgttatagtacctgctccataggaatccttatcgttgaccggcgtcaggagtcacgacagggtggaacgtgcgcaaagagtcatggagcgattccccatactaggccgtccctattcgttcgcgacacagtctggtactccgaccgctttcgtgttggcagacccggcctgggtggacgtagattgagtccttgggcgccctttctcgttccgtgggacggtccagtgcggggtcgctgggtcgggtgaattcccgtagccggtacgctttcagctacacctccacagtggtccccctttcactggcgagtcttcttcagggcagacattgccacgacaaagtccgttaaggcagcggtgtggttccctggcgccagccgccccaggggtccagagaaggggttttgcctggtgctgcatttcactttctc

SEQ ID NO: 581391 - DNA, 296 bp, Homo sapiens
agaggtggaggctgcaggaggtggaggctgcagtgagccgtgatggcaccaccgctctccagcctgggtgacagagtgagaccccatctccaaaggggtgggggaacagatcttcttggaaactgaattgttgtacatgggtgtgagggctgaagttaacgtgggtatgtgtgtatcatcgagtaggatcacgatggccatgaacagtggctattgatgcaggtagtgggtagcagtgaagggggaattggttcagtatcgtgagggttgtggtgggcccatgattgtctgacttg

SEQ ID NO: 581392 - DNA, 759 bp, Homo sapiens
  misc_feature (123)..(123): n is a, c, g, or t
  misc_feature (136)..(137): n is a, c, g, or t
  misc_feature (143)..(143): n is a, c, g, or t
  misc_feature (145)..(145): n is a, c, g, or t
  misc_feature (147)..(147): n is a, c, g, or t
  misc_feature (149)..(149): n is a, c, g, or t
  misc_feature (156)..(156): n is a, c, g, or t
  misc_feature (158)..(158): n is a, c, g, or t
  misc_feature (164)..(164): n is a, c, g, or t
  misc_feature (168)..(168): n is a, c, g, or t
  misc_feature (181)..(181): n is a, c, g, or t
  misc_feature (185)..(185): n is a, c, g, or t
  misc_feature (192)..(192): n is a, c, g, or t
  misc_feature (199)..(199): n is a, c, g, or t
  misc_feature (202)..(202): n is a, c, g, or t
  misc_feature (205)..(205): n is a, c, g, or t
  misc_feature (207)..(207): n is a, c, g, or t
  misc_feature (209)..(209): n is a, c, g, or t
  misc_feature (213)..(213): n is a, c, g, or t
  misc_feature (219)..(219): n is a, c, g, or t
  misc_feature (221)..(221): n is a, c, g, or t
  misc_feature (223)..(223): n is a, c, g, or t
  misc_feature (237)..(237): n is a, c, g, or t
  misc_feature (244)..(246): n is a, c, g, or t
  misc_feature (251)..(251): n is a, c, g, or t
  misc_feature (264)..(265): n is a, c, g, or t
  misc_feature (268)..(268): n is a, c, g, or t
  misc_feature (273)..(273): n is a, c, g, or t
  misc_feature (276)..(276): n is a, c, g, or t
  misc_feature (281)..(282): n is a, c, g, or t
  misc_feature (288)..(288): n is a, c, g, or t
  misc_feature (290)..(291): n is a, c, g, or t
  misc_feature (296)..(296): n is a, c, g, or t
  misc_feature (306)..(307): n is a, c, g, or t
  misc_feature (314)..(314): n is a, c, g, or t
  misc_feature (317)..(317): n is a, c, g, or t
  misc_feature (333)..(333): n is a, c, g, or t
  misc_feature (336)..(336): n is a, c, g, or t
  misc_feature (344)..(344): n is a, c, g, or t
  misc_feature (437)..(437): n is a, c, g, or t
  misc_feature (447)..(447): n is a, c, g, or t
  misc_feature (449)..(450): n is a, c, g, or t
  misc_feature (452)..(452): n is a, c, g, or t
  misc_feature (458)..(458): n is a, c, g, or t
  misc_feature (462)..(463): n is a, c, g, or t
  misc_feature (468)..(468): n is a, c, g, or t
  misc_feature (473)..(474): n is a, c, g, or t
  misc_feature (498)..(498): n is a, c, g, or t
  misc_feature (505)..(505): n is a, c, g, or t
  misc_feature (510)..(510): n is a, c, g, or t
  misc_feature (513)..(513): n is a, c, g, or t
  misc_feature (523)..(523): n is a, c, g, or t
  misc_feature (527)..(527): n is a, c, g, or t
  misc_feature (533)..(534): n is a, c, g, or t
  misc_feature (734)..(738): n is a, c, g, or t
cgtccgcctcgtgctatttacactaaaatcaaaagggccacctgcggttttctcccattgttcttatacttggccccaccccggtgtggtagcgggctggtggaaacttctccatacaacacngggtggtccagtnnaacccntnancnttcacanantcgttntggncctggtgccaagngtgnttgttancccgtcnacnggncnancctntttctntncngaatgtcccggagnaaggtgnnnggganccagagccccacnnctnccggncanaggtnntggacntnnacagntgctggactnntccgtgntgnacagcccttcctcacnttntgaggccnccacgctgaggggaggcctctactggggtccttgccctttggcgcagtttgaattaaagacccctgtgcccttctcagccggccttttgctgnacagataagngnnanttgttnctgnntattnctagnngtaccttgaggaaccctggaagcncagaagnaaggngcncccagaagcngggncagggnnctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaatnnnnntaaattatatgaaacaaaaaa

SEQ ID NO: 581393 - DNA, 178 bp, Homo sapiens
tggcaagaatgggcagccaccaaaaaatacggttgtgctgctaagacgggtgattttagctctggctttcaatcctaagtagattgggcctgaccaggcgttcttcttgtgttcctcttctcctcttctggagagggatgaaggagatcctttgcgagaggcatgttctcgtgtgcgt

SEQ ID NO: 581394 - DNA, 278 bp, Homo sapiens
  misc_feature (22)..(22): n is a, c, g, or t
  misc_feature (24)..(24): n is a, c, g, or t
  misc_feature (28)..(28): n is a, c, g, or t
  misc_feature (239)..(239): n is a, c, g, or t
  misc_feature (254)..(254): n is a, c, g, or t
gaattcggcacgagctcgtcgntntctnttaaatgcttaacgattaacagaagccccagcctcagccttcgggctgccactcagggtagtctgtttagtaaacagtcaaccaccaatatcttgagcaggttgaacagatggctccagggttcaggccaactgtgttttcctcaatttcacacagctttgggtaatgacaatcataaaaatcaagaaaagtataaacataaacactgccntctccccaccctccnccatgaatacacagggactccaat

SEQ ID NO: 581395 - DNA, 685 bp, Homo sapiens
  misc_feature (123)..(123): n is a, c, g, or t
  misc_feature (136)..(137): n is a, c, g, or t
  misc_feature (143)..(143): n is a, c, g, or t
  misc_feature (145)..(145): n is a, c, g, or t
  misc_feature (147)..(147): n is a, c, g, or t
  misc_feature (149)..(149): n is a, c, g, or t
  misc_feature (156)..(156): n is a, c, g, or t
  misc_feature (158)..(158): n is a, c, g, or t
  misc_feature (164)..(164): n is a, c, g, or t
  misc_feature (168)..(168): n is a, c, g, or t
  misc_feature (181)..(181): n is a, c, g, or t
  misc_feature (185)..(185): n is a, c, g, or t
  misc_feature (192)..(192): n is a, c, g, or t
  misc_feature (199)..(199): n is a, c, g, or t
  misc_feature (202)..(202): n is a, c, g, or t
  misc_feature (205)..(205): n is a, c, g, or t
  misc_feature (207)..(207): n is a, c, g, or t
  misc_feature (209)..(209): n is a, c, g, or t
  misc_feature (213)..(213): n is a, c, g, or t
  misc_feature (219)..(219): n is a, c, g, or t
  misc_feature (221)..(221): n is a, c, g, or t
  misc_feature (223)..(223): n is a, c, g, or t
  misc_feature (237)..(237): n is a, c, g, or t
  misc_feature (244)..(246): n is a, c, g, or t
  misc_feature (251)..(251): n is a, c, g, or t
  misc_feature (264)..(265): n is a, c, g, or t
  misc_feature (268)..(268): n is a, c, g, or t
  misc_feature (273)..(273): n is a, c, g, or t
  misc_feature (276)..(276): n is a, c, g, or t
  misc_feature (281)..(282): n is a, c, g, or t
  misc_feature (288)..(288): n is a, c, g, or t
  misc_feature (290)..(291): n is a, c, g, or t
  misc_feature (296)..(296): n is a, c, g, or t
  misc_feature (306)..(307): n is a, c, g, or t
  misc_feature (314)..(314): n is a, c, g, or t
  misc_feature (317)..(317): n is a, c, g, or t
  misc_feature (333)..(333): n is a, c, g, or t
  misc_feature (336)..(336): n is a, c, g, or t
  misc_feature (344)..(344): n is a, c, g, or t
  misc_feature (363)..(363): n is a, c, g, or t
  misc_feature (373)..(373): n is a, c, g, or t
  misc_feature (375)..(376): n is a, c, g, or t
  misc_feature (378)..(378): n is a, c, g, or t
  misc_feature (384)..(384): n is a, c, g, or t
  misc_feature (388)..(389): n is a, c, g, or t
  misc_feature (394)..(394): n is a, c, g, or t
  misc_feature (399)..(400): n is a, c, g, or t
  misc_feature (424)..(424): n is a, c, g, or t
  misc_feature (431)..(431): n is a, c, g, or t
  misc_feature (436)..(436): n is a, c, g, or t
  misc_feature (439)..(439): n is a, c, g, or t
  misc_feature (449)..(449): n is a, c, g, or t
  misc_feature (453)..(453): n is a, c, g, or t
  misc_feature (459)..(460): n is a, c, g, or t
  misc_feature (660)..(664): n is a, c, g, or t
cgtccgcctcgtgctatttacactaaaatcaaaagggccacctgcggttttctcccattgttcttatacttggccccaccccggtgtggtagcgggctggtggaaacttctccatacaacacngggtggtccagtnnaacccntnancnttcacanantcgttntggncctggtgccaagngtgnttgttancccgtcnacnggncnancctntttctntncngaatgtcccggagnaaggtgnnnggganccagagccccacnnctnccggncanaggtnntggacntnnacagntgctggactnntccgtgntgnacagcccttcctcacnttntgaggccnccacgctgaggtttgctgnacagataagngnnanttgttnctgnntattnctagnngtaccttgaggaaccctggaagcncagaagnaaggngcncccagaagcngggncagggnnctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaatnnnnntaaattatatgaaacaaaaaa

SEQ ID NO: 581396 - DNA, 111 bp, Homo sapiens
gcggcttcctccgtagtggactccgcgggccttcgcgagatgcaggcctggggtagtctccaactggactgagaagagaagaatggagacgcctcttccattagtgccttt

SEQ ID NO: 581397 - DNA, 243 bp, Homo sapiens
gattctggtctagctgttctgtttgataacagctcctcagccctggctgagctggggcaggacctcccgggttctgggagtgctgggctcccaggaggcagcaaagccacctctacttttcttcttctaggctggttcttcagagaggccagagcccagaaactcacaggaccaagctccttacagaatattaaagtcttcttatacaaaagccccagttgtgctctggaaggaacccacgcg

SEQ ID NO: 581398 - DNA, 203 bp, Homo sapiens
  misc_feature (1)..(1): n is a, c, g, or t
  misc_feature (197)..(197): n is a, c, g, or t
nttcggcacagggcaacaaagcaaaacaaaaaagtaaaaaaaaaaaaagtaaaaacagacaaaaaaaccaaaaataattagctaggtgtgatgatgcacacctgtagtcccagttcctcaggaggctaagaaagaaggatcgcttgagcccaggaggtctgcaccactgtcttccagcctgggacaacagagcaagntcctgt

SEQ ID NO: 581399 - DNA, 1074 bp, Homo sapiens
gccgtgccaggctcaggcagacccacagtgggacccaggctgctccctgctcctggggtcgtgatggggcccagtgcggagtagacggcgccctgtcttctgcggggccagccctcctcaaggcacacccggagggcttcccgtgcccagtctcgcataccgctgttcccttggtgttctgactcgtccctgtgggcctgaggagtctggacggattatacggtggtgcacacccctgcctgtaataccattaaggcagacgtcgtaccctgcatgccctgcaaggggagctatacttccgtgagtccacagcccacgtccacaggggcagcgagtcagggcctcatgcacgcccgtcgggacagggcggagggagccggaccttcaggcggggcaggggggattccatttggccttttgcagccagtcttgacggacacccggagaaagcgtcaaggccgggcagttaacccttggcgcctcagcgtggtaaagcccagcactttgggctgtgactgcgcgccgagacacgatcttgctgggtcgagacggcagaccggccgccccttccttcccaattagtgatgggaggcatcgaaagatggggacatttgatgccaattctggcaccttcccccggaagcaacagggtgtgcacctggttccctgggaggaacagggacccatttcgccaaggaaggttccatggaaggccccaaagctgttgcatgcctgaacggacattcaaaggtggacctttgcggcaattcgactcccccctgggtaccggaagagggctagagtgaggcccccccatggtccactggtgggcaacaagcaagaggctgggagctgggtttggacaccggggagctgggggtcaggcccaagccacgcatgcttgaaccccctggggcccaagagccatggggctaggcaaatggagacacgaaatcacggcatgagcacagaacaggaagagaaagcaaaaggccactccacacaacgggcaacgagctcacgaggagcacgatcattgcagaaagaagcgagggagggcacatggatataaag

SEQ ID NO: 581400 - DNA, 192 bp, Homo sapiens
acatggaccaatagtgattctgtgggcgcgaacagtggatagtatttgttgacttaagaaccttaaatatcttgaaaagtaatggcattcttgctcatgatatgcatttgttagtgaggtctcaccatagtattttaatgttgcttcttcttaaaattatattcataaatagtgtagccgtcacagaggtga

SEQ ID NO: 581401 - DNA, 300 bp, Homo sapiens
tcatttctctcctgggtttcaaaaaggtaattatttgagtgccccttaagtgtcaggccctgtgctagacactgaggttacagtggtaacagtatttgccttcagagagcttagtcttcacagtaaaggcagacactaaataagaagtcacagcagaacagaggtttgctaaactcttggcctctgagcttaggatggggtctctacattttaaaggggtatatggaaaggggagtgatatcgcgtgtccccacagcagcagcagtactctctgctgtggcgcctttcacaaaaaatatt

SEQ ID NO: 581402 - DNA, 410 bp, Homo sapiens
aattataaagtctatagtccagtggtatgatctatgaagttatcaggaactagtattcaagagtccatttcatagtctattgctagtacatctccgttgacagcaaaaagcagatagaggacagtagctgatattaaatactttgaggcaagaatcaaagcaactttctgccagtcttcctgaaatacgaaaatgacatcacggctgctacgttggattattgaaagcaaaagttcctaatcctggaggagcaatgactctgattgtcaaggatgtggagctttcctcgccagtggctgagttacgagcagagcaagcatagagcccattatgctttggagtaatttgagggataaagagcttttgtcctgatagctgaaacttcccattaattgtccaagaatactgtg

SEQ ID NO: 581403 - DNA, 613 bp, Homo sapiens
gggttcccaaaacactttcaggagtctgtgaggtcttctcttttccaacagcataactgtgtgaggccagattttctttatatgcttcatccaaaaaacatataacaatagaatgcagagaagatatgaggctccagctgtcttctgttaagccagatacttaaaatatttgcaaaatgtaaaacactgccattcttactttttttggttttagaaaatacaactttttcatttttataatgttactaatattaaataatgggtttattattgtttgctaaatgttaatattttattttctcagttctgacagtaaatatcaataaatacaacccatgtaaaggaaagctctttgttttttaattatttttaagagtataaaggggtcctggcaccaaaaaatttaagaaccactcctttagaccagttcataattgtatgggttagggtatgttttattgtcgcctgaccatttaattaataaaacctgttatcatctgtatctcccgtgtctttgttctgctctgtggaatgactagtaaagttagttgggcttggtatgtgcagccttccttccattcagctaagaatctattcagtagtttatttgtgc

SEQ ID NO: 581404 - DNA, 777 bp, Homo sapiens
  misc_feature (390)..(390): n is a, c, g, or t
  misc_feature (742)..(742): n is a, c, g, or t
caatatgccagcttcaatgcagtgtttgtgaattgtgccagtgtcagatctcaggagtcctgtgttgagagtgtgtgtctttcagctgtcgtgggatgctgcacttgtgtggcgcgaaagccaggcaggtctaccctcacatgccagcataagtgctggaaggtcacgcaacctcatatggaatggcgatgtgaggacctcctacctcccagatgcgggcgaccttgtgcctacccattcccttgggggaacctgaagtataatgcgtacattcacctctgcggggtgatatggctgggggtggtgtgccaagagagggaccatgtgcgcctccgtcaggctggctgtagggggcatcgcacgccactctggatgcatattgggtagtcntgctctatttagtcccgctcttccacgcgttcgtttcgtccctgctgatattcatttctccactcgatgacgcccaatgagcttgttcacatgcgttcgtttcgtccccctggggaatgtaattgccgtggacgtctgcgctgggtgactacgtagctgaagcctatgtaagcatgttgccacacccgtcgccctttatattcgcttggctacgcgctgtgcctcagcattttactgaggaccttccttagatcacaatactgacgggacgcgcttgcgatgttggctggctttggtgcctggtgggtcccgcgcgattttggggacgcgcccagggtggggagcgactccncttgaaggcccggaagtttgtggaccgccctgggc

SEQ ID NO: 581405 - DNA, 414 bp, Homo sapiens
ttactgaacaaatataaaaaataaagagaagtatgtgacgagaagtacttaaaatccaagcataatataatattaaatttgactgggggagggtctaaattgagagtgtgtgtcacatgcctatgtgtagaactaaagaataatttaaataaattatgacttatacaaatatgaatgaatgtatgcccaaaattccatttaactgattgattaatgagggaaccagtaagatgttacaactgattcaaatgagaagttaaagtatcacatacatttaaagtcaggaaagaagtgctaaatgaatttacaaaaaggtgcataaggctggacacggtggctcatggctgtaatcccagcaatttgggaggctgagataggcagatcacttgaggtcaagagtttgagaccagcctg

SEQ ID NO: 581406 - DNA, 416 bp, Homo sapiens
actggctgactgcgactgtttgatgccattagccgaaatcgccatcaactagctacagtttgcattgtatgcgatattcccaacattgccgtaaagcagtctagatggctgagtaacggtgattgaaccccggttgtgattatttgtctctaacaaaatgggacaaaagatgagaaaacctcgtagtatccgagtctggtacttataggatccccaacttttaagattataaattcaccatagtgaacaccctagtgacaacatttaaattaaatactggatagctgggcacaggtggtcacacccgttatcccagcacttagggacggcgaggcgtgtagatcacttgaggtcaagagttcaagaccgacctggtcaacatggtaaaagctcctctctaatataaatacaaaaat

SEQ ID NO: 581407 - DNA, 208 bp, Homo sapiens
gcaaaggtagcataatcacttgttccttaaatagggacctgtatgaatggctccacgagggttaagctgtctcttacctttaacagtgaaattgacctgcccgtgagaggccggactgacacagcaagacgagaggacttttggagctttatttattaatgcaaacgtccttacaaaccacagtcctaactaccaacctcgcattaaa

SEQ ID NO: 581408 - DNA, 220 bp, Homo sapiens
ctttgcaccttccattcagagtttgcagccagatctagggactcctcccctatcctctaccaaggaaaagattgctattgtcgtactcacctaccgaccctactccgggagtcttttgaggagttttctccacctaaccactttcaacatttcttttgtgattctcgactctttgcatgcctacccccgatcctttttccctatgtccagtatccctgga

SEQ ID NO: 581409 - DNA, 662 bp, Homo sapiens
  misc_feature (31)..(31): n is a, c, g, or t
  misc_feature (485)..(485): n is a, c, g, or t
cgaggatctatcttaacgccccaaactcacnaattctatagaaagctagcaaaaatagacaagatcttgcaaccatggtgaggtaaataccagtctatttatgggaaaatcacaccgatgaactcttaagtcatatcacagtttacttatttacttatggtgctgcctatgtggccgatgtgaaatggctagctagttagtggtggtgcacgctaatagtgtttcagtcggtgacgtcactcactctgagacggtgacgtcactcactctgagacctagaagtagttgttccccttgctctgcaagggccacggcttttgtggagtgatgggtaacgatgcttcgtgagtggctgtggttgatgtgtgcagagggtccctagttcaagcccaggttggagcgaggagagggacggaagctatactgttacacctactccagattacttgtttttatataagcaaaaaatatttcactttatattngtattttgttcagccaaggcagcagctactcttcatggtgtccacacaggaataaaacaattacatcataaaaagacaatatatcatacaagaacttattacattattactccattattgcacatttacagtatcacatttacaacactacaatatactgtgtgtgtgtgcgggggt

SEQ ID NO: 581410 - DNA, 329 bp, Homo sapiens
ttttctttgagacagaagtctctgttgcttgggctgcaatgcagtgatgcaatcttggctcactgcaacctccccctcctgggttcaagtgattctcgtgcttcagcctcccaagtacctgggactacaggtgtgcaccaccacaccaaggctaattttttgtgtatttttactagagacagggtttcaccatgttggccagcgtggtcttgaacgcctgacctcagatgatccacccaccttggcctcccaaagtgctgggattacaggcatgagccaccacggccagcccacaatgatattacaaacctattaaaaatgatacttag

SEQ ID NO: 581411 - DNA, 110 bp, Homo sapiens
ataaaatagtgacacatccttatactttattgcttttctgtcttattcaacctgggagaggccctgaatttgagtgtgctctctaatcaatagtggcatcgataaacacc

SEQ ID NO: 581412 - DNA, 596 bp, Homo sapiens
  misc_feature (18)..(18): n is a, c, g, or t
tacctactttccacaggnaaacgttccaagcttgtgatagccccttcaccctaaaaccaatatatactcttagtctataagagaaagcgctcctgaccgcaatcggccaagagcgcctctcaggttttaactaaagaaaacttgcctttaactgccagctgcattttgtgtttctttcctctttctttaactcttacaaggccgaggagagcagatcacctgaggtcaggagtttgagaccagactgggcaacatggcgaaaccccatctctactaaaaatataaaaattagccaggcgtagtggcgggcgcctgtgatcccagctactcaggaggctgaggcaggagaatcgcttgaaccccgtaggcagaggttgcagtgagccatgatgcactgcactccggcctgggtaagagagtgagactccgtctaaaacaaattaaaataaaataaaaaaggtgttttcagggttctgaagaggctcctgaggctcaaagtggcacagtggcttgctgaggtcattgggctggttaacagcaaggtcaggaagagagaggcctcaggtctcctgaccgtgtcctctttctaaagcatc

SEQ ID NO: 581413 - DNA, 138 bp, Homo sapiens
ggggggggggggtttttccaaaagcccccattcccacccccaggggggttgggcccccccaaagcacccccccggggggaggggttaaaggggggaaatttttttgatcttttttttaaaaaaaaggaaaaggggcca

SEQ ID NO: 581414 - DNA, 416 bp, Homo sapiens
  misc_feature (104)..(104): n is a, c, g, or t
  misc_feature (244)..(244): n is a, c, g, or t
tacctgaaacagctcagttaaaaacattttagaataaatgtctccccacagatccatgttgctgcctataaaaacactgctcaaatagtccccgatgagactgntgtctgaggtctctcagacatacaggtatccgaggtttctgctcatggtttttagtttcagccaaattttaagtacagactaatgattggtctccaaagttctccctttcaggaaacatatacataattcaatgataccnatgggtttaaatatttaagaatactgtggcagtgcttaacaaatacccacgtgttccccctacctcatctgtgtccttggggctgtgtgaccatctgtggccagtggtgatgaaggagtgaagggttccacttctagccagcgtcttcgcaaaccggaagggtcctctagag

SEQ ID NO: 581415 - DNA, 409 bp, Homo sapiens
ggagttcaagagcaacctgggcaacacacacacacacacacacacacacacacacacacacttctttccagctctgacacacacacacacacacacacacacacacacatttatttcttgcccgctgtgatattctagaatatagagagatggcacagggcacaatagagcgagtgattatatgtgtggaaatagggtcccagtgagggcgtgtagcgtagagtgtctagggagagagtgaagatgcttttcaattactatatccaagttagaggggtattcgtgtgattcgtgctagagaatctcgcgcgagaggggatatattccgtgctgtgctgagcagtgtgttatatatgtgtctatttactcatatattgtgatctattactctttagccagaatacgagat

SEQ ID NO: 581416 - DNA, 273 bp, Homo sapiens
ggctatcccgcatgaaggttaaagagcatcaggtggtgcgtaatgaagaacagaaggcggaacaagaagagggtaaggtggctcagcgagaggaacagttggaggagacaggtaatcagcacaatgatgtagaaatagaggaagccaggcagcaggcagcaggcaaaaggcaacatcgcgattgttcatcagtgatgcagcagaaagcacacaggcaggaggcacagcaacaacaaacaggcaaatcgcagcgttaagcatggcagcacagga

SEQ ID NO: 581417 - DNA, 792 bp, Homo sapiens
  misc_feature (792)..(792): n is a, c, g, or t
gaagtacaaaaaattggctgggcatggtggtatgcatctgtagtctcagctaattgggaggctgaggcaggagagtcacttgaacctcggaggtggaggttgcagtgagccaagatcatgccattgcactccaagccttggggaacaagaagtaaaaactccgtctccgaaaaaaaaaaaaaaacaaaacaaacaaaaaacacatttttggggcgcggccacggcgcctcagagaaaaaggtttttacaacccaattctgtttgtggggcgcgcgggggggccccagtgaggtgcatcggggaccacgggtgcaaaagcgggggtgggtccacaaagggagaaccttcggggacaagaacaaatggcggggggggttctccccaccaatattaaaaaaaaccggcccgggggcggaaccaccgcgggggggttcgtagaacaaaacctccaaaaaggggggcatccgggaaggaacactaaacgcggagtctcataacaaggggggggttcccaaggggagacccgcgaataaaaaaataagcccggcggcggtgagaagacagagcaacacacaaaacagagacagcagagactgacgacagacgacgaagacacgatcgaaacacgaccgcaagacaccgaagacatcagaacacacaacacgcaagcagccgaaaacgagagtgagcacgacaccgacaaccgagacaacagaagaccacgagacaacagatgagacccaagaccaaagcgacgaagagcacagccgacacgcacgacgcaactagagn

SEQ ID NO: 581418 - DNA, 295 bp, Homo sapiens
ccgcgctcggtactccgacggatacgcggatctgcccaagcgatcaccaatagcgctttggtcaaggacgagatcctcactgcggccctgtcttttgtggagccccagccactggcagtggtggcgagccatgctgccgatggcagtctgtggtcgtcggtactgtttggccggccggggtttgtgcgggctgtggatacgcatgaggtgcgcatcgatctgagtggtgcgcacctgataccgggagatccggtcctgcaaaatctccaggatgacccgagggtggggatgttga

SEQ ID NO: 581419 - DNA, 462 bp, Homo sapiens
atgtccattggcacattagtgatcttacgtagaagatgaggaaatcaggtctgcatagaaaatcctggagctaagcagtggcaatgcgcatttcctgtcctgtgctcaactcctaatttcccctgagagaagtgagtaaagctctctgtctagggtttcttcctctctaagtggaggatcatggtaccagaagcttgcattactgtgatcatgacagtgcttacaatcacaaagccttggggggtcttactaagataagctgccgcaagaaaatgagcatgaggaaatacttcatcttcaagttaaagccaaataggtgcattcattcctcttaatctataatttggcactgtagttggtagatctgtctcagaattttccagaaggatagtatcaaatgtgatttaaaccaagtaactataaagaatcataaaaacaggcaaggcccggtggcttaaagct

SEQ ID NO: 581420 - DNA, 340 bp, Homo sapiens
gtgagacagcgggtcccgacgtcacgtcactgtcctagttatcaatttgacatcggagttttgagggttcgagtttcactaggaggttggagtcggagggttccatcgaccctggtgttccacgttacggttggtacggaccccaaaaagacaaacaagacaagaaacaaaaagaaccaaaaggaaaaaaccctcctctaccccagagtggtgacactaacggatccgaccccaccttcccgtagtgaacacggccctccttcctccaacgtcactcgactctaacagcgggtgacgtgaggtcagtacccactgttctcactctttggtagagttttta

SEQ ID NO: 581421 - DNA, 134 bp, Homo sapiens
gaggatcccctgctgctccctcttcacattgcagacaagatccatcccagaggagcaggaattagaagcttatgtagatgatatagatattgatagtgatttccgaaaggatgatttttatttacttggtctcc

SEQ ID NO: 581422 - DNA, 236 bp, Homo sapiens
cggccgcctactactactaaattcgtggccgcgtcgaccataagccagggcttaacttgagggtgaagggtgggaggggggtgaggatcgaaaagttacctattaggtattatgcttattaccggggtgacaacataaattgtataccaagcccccatgacacagagtttacccgtataaaacctgcacatgtgcatatgtactccctgaacctaaaataaaagttgggaagaaag

SEQ ID NO: 581423 - DNA, 117 bp, Homo sapiens
  misc_feature (20)..(20): n is a, c, g, or t
ggtccgcttctgcttctgcnattctcctaattgatccagatattcgttgactttgtctatcctttttatactctcgtggacgcctctctgatctgcagtcactgcagcgacctttta

SEQ ID NO: 581424 - DNA, 358 bp, Homo sapiens
  misc_feature (261)..(261): n is a, c, g, or t
cgggcatccaaaaaggagtcctgggagaacgggcggaacgaacgagggcccccggactggaggctttagagctcccacgggaaaatggcttcccggaggtcaaaaaaaaaggaggccggcgagatttgaacccgtctcccgggggctgtaaatagtttgataaacgttcccccagtctaaaattaccctttatatttgctgaaaaccactcatcttttgtagtttaaaatttctattgttttggagccaactgtgagtttntaaaagtgtacaaagttgctcctgtgttcccgggtcatgttgagtaggaataaataaatttgatgctgccccctgaggctgcggggggtttttccca

SEQ ID NO: 581425 - DNA, 315 bp, Homo sapiens
tggtgcacaactagggtcagttttgcaggtggtaagccatttaccaagatagttgtaggtaaagaagggcagatttattagagaaattgtgaaaatatgttgcagtgggcagctcagcatagaaggggctacctgcaaagaggcaagggctggaggaaagttttatagggtcctgctgaagggtgctacgtgtggaatgtggacattgtgcccgcaggttgtttgtgattagctgtttctaacaattgttcatacaataattgttcattattgttctcaacttggggctctccccaacctggggacccttcctta

SEQ ID NO: 581426 - DNA, 924 bp, Homo sapiens
cccacgctgttacgaccatcgcgtcccgtaaatattatactagccattcaccatctcacttctaggactactagtatatcgctcacacctcatatcctcccatactatgcctataacgcgaataatactatcgctgttcattatacgcatactcatcagtgaagccctgcaagcacccactccctgcttagcctcgaatacttgtcgtccttatctgccgatgacgtagatctttgtcgcgcccgtgctgaaagctatgcggtgtcgcctgagtcccgtactagtcttcaagtctccaacacactatggttcctataagcgtagctgtacataaacgctataacccatagctcctatatatgctacaaacctaagtcgtcccaaaatattactacttaacctatccagctgatcatttgaccttatcctatataaaacacataagtctgacatcaagctatcaagtcagaccatcatggccttactctaaattaggcgattcattgcccgtctaactgattttgctatacccaagattcaacgtaactaacgcatatttgagcttggtttccccctaagccttttattaccttcctgtaaaccacccttttatcaaaaaatcgcccagcctccactcaattagttaacttttaacctattacttcatttgagctccccttcaattaactctattggagcatcgcctcgaaaacgacccaacttttaatccccacggtgaataccaaccttattgcacttaatataacccacttttccctaactcttcctccctaaatactacgatacctctcgcttagcaaaaatcatccatataaattttattaactcttattatcaacggggacaaccagaagaattaattccattattatgaactaattcttgacttctcgaaaacccaag

SEQ ID NO: 581427 - DNA, 106 bp, Homo sapiens
ccctatgtcttgccaccgaagaactggaagcgctcgcccgacgaagttcggtggcttatgggcttcaatcgtgacgtcatccaccgtcgatcgcgatcaagctcga

SEQ ID NO: 581428 - DNA, 600 bp, Homo sapiens
ccatgctgctctgaaaagcatctttgcatgtccctcatccgctcttgcttcgcgagccgctcgccggcgctctcgccgcggactcggaagttatcgcagatccctgaatttcgttcttaaatcccgtgcttgggatcacggtccccaacaatgtcaagacgcaggcgggtaaaacagttcgaaaatcaccacaaggcttacggacgaccacgcaatttgtgaaagacgcaaaactggaaaaaagacgcctggaaaaagggaaatcgctgacaatggggaaatggggacacacagacgggtcgccaattggtggtcgccacgacaacacggcacacacgttctgtcgagccgacaaagagcgggggcaggaaacacaccacggtgttcatggctagacaaccacgaacgtcgtgaacagtgtaaccagattcgaggaacactctgagtcacacgacacggggcaaagcgcggccgtgttagaacaatatgcttggctgtaaatcacagttgtgattaaccaaggaaaccaagaaacacggcagaagattgacatcagcagcgctttaaaacacacgaacgaccacaacgaaacacaaacaa

SEQ ID NO: 581429 - DNA, 955 bp, Homo sapiens
  misc_feature (22)..(22): n is a, c, g, or t
  misc_feature (624)..(624): n is a, c, g, or t
  misc_feature (662)..(662): n is a, c, g, or t
  misc_feature (667)..(667): n is a, c, g, or t
  misc_feature (677)..(678): n is a, c, g, or t
  misc_feature (682)..(682): n is a, c, g, or t
  misc_feature (693)..(693): n is a, c, g, or t
  misc_feature (700)..(700): n is a, c, g, or t
  misc_feature (711)..(711): n is a, c, g, or t
  misc_feature (718)..(718): n is a, c, g, or t
  misc_feature (727)..(727): n is a, c, g, or t
  misc_feature (729)..(729): n is a, c, g, or t
  misc_feature (734)..(734): n is a, c, g, or t
  misc_feature (739)..(740): n is a, c, g, or t
  misc_feature (744)..(744): n is a, c, g, or t
  misc_feature (746)..(747): n is a, c, g, or t
  misc_feature (759)..(759): n is a, c, g, or t
  misc_feature (762)..(762): n is a, c, g, or t
  misc_feature (769)..(769): n is a, c, g, or t
  misc_feature (778)..(778): n is a, c, g, or t
  misc_feature (783)..(783): n is a, c, g, or t
  misc_feature (955)..(955): n is a, c, g, or t
tgtggggttatctgataggatngcaccaggtccctcagagcgtgggctggctgctcactgtcgaaaagcacaggtaccctctcgtgacttctctggccagctcaactgggtggtgacaaattacaagccttccaacctctgacgtacatcccaagggacagacagcatggcagcctgcgggaagaccaataaatcccacgtcatcttcaagaaggtctctcgggacaagtcggtgaccatctacctggggaagagagactatgtagaccacgtcagccaagtagagcctgtagatggtgttgtgctggtggaccctgagcttgtgaaggggaagaaggtgtatgtcaccctgacctgcgccttccgctatggccaggaggacattgatgtgatgggcctgaccttccgcagggacctgtatttttctcgggtccaggtataccctcctgttggggccatgagtgtcctcacccaactccaagagagcctgctcaagaaactgggagacaacacgtacccctttctgctcacgtttcctgactacctaccctgttcagtgatgttgcagcagctccccaggatgtaggcaagagctgtggggttgactttgaggttaagcattgnctcagacatcacagatctgaggaggacagatccccaanaaagntctggcggtnntgtncggaagtgagnatgccanctgagatggtncccaccngtgtgagcncnggagnctcannttgnanncctgaactcttngtncccaggnaagaaattncgggngccacccggatggaccggcacaaccgcaaggggggacacatctcgggacaacacgggggccacaggtaataaccggccgaaacaaaagaaacatcgacagggtggaaaagaggggagagaagacacacagacgcgggttagatatcacgaccgcacaaaaaaagaaagccgn

SEQ ID NO: 581430 - DNA, 480 bp, Homo sapiens
ggggcacggatctccacgcgtcgatcagtcatctcaagcgggaaaaggcataatgggctaacgttcctctctggcgactgcccactcatcctaaccctactcctaatcagataacctattccccgcgagcaagctcaattacgatatatacaccaacaaagagggtgcaaccagataggtactactaatcaacgcggaggtatcatacaaaggcgcgggaccaataggagtcgcgtcccgaatcaaccctgagccctctccttcataaagttattcagcttcctacactattaaagtttaccacaagcaccaccccatcatactctttcagccacagcaccaatcctacctccatcgctaaccccactaaaacactcaccaagacctcaagccctgacccccatgcctcaggatactcctcaatagccgtcgctgtagtatatccaaagacaaccatcattccccctaaataaattaaaa

SEQ ID NO: 581431 - DNA, 493 bp, Homo sapiens
caatatactatatcatgctgttcctcgttgatatggatccatcaataaatatacaataaaccagaggaggggtgtgctctgaaaggtcaatgtaacaataacagtggtcttggtacagcagaaaattgaacaagtggctatccttggaaaattcaaaacaaatgatttacacaaagacatttctataacataagggtgaagggaccaggtaatccttatccctaagtacatttggcgtttcccagataagtcaactgtttcctctctcccactcctctgatacaactagttttgattgagtgtgggctacaaaatcaattctgggtgtggtaatgaatctcattatcaaacttccggaagggttcggctagaaaagccaattctacctggcttgaaatatggatgcgaagatgtctggggtctctttggatttttcactcagagctaatttcaggggaagtctacaggagcggggaaacttttgactttccgt

SEQ ID NO: 581432 - DNA, 161 bp, Homo sapiens
cttcgtttattgctaaaggtacactgctgttcccgtgtgggtgtggctaggctaagcgttttgagcgtgcattgctgtcgtgctcttatgcttgtcccttttgtatcgtggtagatttagacgggtgagctcactgagtacggggtatgcttgccatgtgt

SEQ ID NO: 581433 - DNA, 237 bp, Homo sapiens
agggtcccccccaaagccaaactttggggtgggttttttccctttaaaaaaattgtataaaaccggaaaggggggggggtgagcctggggtccccttttataaaaaaaaagccttttgtttttaaaaaaggaaagtttaattttcccctatggttgggggggaaaatttaaagctgggattttttttaaaaaagttaaacccttaattttttataaaaaacttttttgggtttttga

SEQ ID NO: 581434 - DNA, 115 bp, Homo sapiens
atcatcggcattgcactgcagggcccaagactgggccgcgactagaaggtgaatgggatggagatctcgttggactgcgatggtagcttgggtatggagggcctccagggtcagt

SEQ ID NO: 581435 - DNA, 739 bp, Homo sapiens
ctaaaagtgctgtcatccctcaaacctgcagtgccccatacgcgagccatcagcgatcacaacagcgagcggcagcctccacggcagctatcgctcggaccgctgtcgtctgcttccagagacagcatcaccgctggagcacatcctgcagactctctttggaaagaagaaatcattcgacccgtacgccatgagagcctcccggtgtccacgcgcagggtctcccccaggagtcccaaaatgcacagcagaggacggggtgccggtcaccttccgttgtatagatccgatcgtccagcagttcggtcagttctcaaagagataaggctctagaggacgaggaggacgacagggcccagtaacgacccgtggaggacggagtactgagccggaagagggccttcgaccacttcagcctagttgggaagcccgagggccggcgccgaccgcgaggggtggaacagggcgctccttgaaagcatgctgcagcctgagcgggcgaccagagtgtcggccgtagtgacctccgacggattggaagacccactcctatacggacaagaccggcgcaaggggtgaccgttggtcgaatgaacccgtggccccaaagcagggcattggtggtagcccgagcggttggcaggaaggggggacaactcccggctggccaagaacgggcccttccctggatgcacggttttcccctgggtggccttggggaacacgcccatccccttga

SEQ ID NO: 581436 - DNA, 187 bp, Homo sapiens
  misc_feature (19)..(19): n is a, c, g, or t
  misc_feature (116)..(116): n is a, c, g, or t
tttattgtttgtataaatnatttattataaattaaattatctttataggcatgatggtgcatgactgtagtcccagctacttgggaggttgaagtaggagaattacttgagtccanacggtcaaggctgcagtgagcagtgattgtgccactgcattccaggcgttttagccaggatggtctcgatc

SEQ ID NO: 581437 - DNA, 101 bp, Homo sapiens
acagtctatcatcactcaggatcttgaatctgatcgggaagatgccagtcgatacagcagctcggagagatgcagagtcagtccctcagaactgctctacc

SEQ ID NO: 581438 - DNA, 539 bp, Homo sapiens
  misc_feature (510)..(510): n is a, c, g, or t
atggaccgggatgaggttgtgggtgagccgcacagggccagggggtggaggatgataccttcaggatgctaccagtgctgtccgcagagagggcctgctcgatgcccatcagcagtggggtcacgtgtggccacccactcttcgtggggggcagcctcacctgagtcaccatctgcgggacagcctcgtgcagagccagatcggaacactcaaaagagtgccgatagtccttcagccggagcagggagtcctgcaaaagaagcaggtggggctgcctctcaggaatgggagtcatacactccgggtgtggggccgggtcaaacccaggggtgcacaaggtggggcggagcagatgcacaacagccttgtagtcgcctgcttcatacagccgttgaatctcctccagggactggcaccgttccagcgacttcaggttcttatcaatctcctccagggaaaccacagagtcattatggaggtcgagcagccggatgacaatgtctcttcgtncagccccttgctccagcgggatgggggtg

SEQ ID NO: 581439 - DNA, 1029 bp, Homo sapiens
ggagcacaagattccttccctcttcagcagaagatcttgagtatgctctttgatgctcttgatcaggcagttgacacatcacagaggtcactctggggaccgttatatgaagcctacagtaaagtctgtcgcatacagcaggtggcggcatgatggaccagtcagagtgtttgtcactttcacgggctcttggtaagccaggggcattttcaggattcaaagagaaacaaggaaacccgtttgaccaacaggtgctttctctcaagcatcgcacagagcaacagaaatagcacacatgctctgcaacagatcaacagcttctacattggcacacatatccttcaacaaaaacaacacccacagggcgcgagcccgaaccaagagcgaggaataactccccctcgagagagaggcacccccacggcctacaaaccgccgcatcacccgcaacacctcactcatgcgcaccacacaaaacgcgggaactcccacctcactagcgggccagccccagcaacacacaacccacaggacctacggaccacccgggcgcacccgacaacgatccacaaccccaaagggcaccacggcggaacaagcggacgacaccacaaaccggggccaatcagccctccgcgcaacaacccaagcgagaacatcaaagcgcgagcacccccgcacacaccaatacgagagaggcgggtgcaacgcaccacaatacaactggggcaacaccaaccccaaacgcccacacacagacacgacacattgacaaaacccgcaccccccgaaaaaggcgcccacaccccgcccaccagaaccacctacaccaacaccacgccgacacaacccacaccaggcagcggcaaacaccgcccacagacacccccccggacaacaacaccccgcaccatgacaccccgcgcccccgacaaccacaccgcaccacacggcccacacacaccccggaaccaaccactcgaacgcaacagcaccgcgccaaacacactaccaccaccacacacaaca

SEQ ID NO: 581440 - DNA, 124 bp, Homo sapiens
ccccccccccccccttttttttaaaaaaaaagggccttggcttgggttggagctgtcccccccccagtaagggggtttacaaatgttttcccctgggccccccaataaaaagaccccttggtta

SEQ ID NO: 581441 - DNA, 1327 bp, Homo sapiens
  misc_feature (308)..(308): n is a, c, g, or t
  misc_feature (389)..(389): n is a, c, g, or t
gagcagcaatatggctgtcgatgggtgtatggggtggctggctggcggctggagaacggagactcccccgagccacctgcgccggacatggcccgtagtcgtaggctatgtgcaaactggttggactggcaggccggacgtgccggtcagtcgacggtcgtgcctggcaggacaggcaggccggcaggagggcatgactaacgctcttgagaagtgaggtacggccaatatccaacgctgaatccgatctcagacctaaaacgcgtcctcctcactcctcctccatcctcttcctcttcttccttctntccgaccttcctacttacctaccttcgtcctacgggtaccacgagccgccagatggatgtgattggctgctacagttcatncctcggtagatcgcattggcagtgttgcgcgctagtcgatcaggtcccgtggagccaagctgccagtgtagtgtgctgcttctacctaggttctccctccattgcgtgactttctttccgcgcgggcctcttcagtcattcctttgctctgcgcaggacagctcaaggtacgctgtaggatcgctgtggttgctgcactaccttggcggtggtgcaaggaacgaaagggccacaccacctattggggggtccccccggggcatagatggcacaggctccagacacgtcgcggcgaatggcatagggagcgcgcgatgtacctggtcttggagagcccggcgggttatattaatctgcctgtgcaagcgatctgtcaccatgggcgctcgaaggttggctaagatgttcggtccgcgcttttagctcattctctggtgccagacgcccactcgtggaacttcgagtggctcgggcgaacaggctctccgaaggtgttatgggcttgctaagggcttcactgcgcttgggtcctgtacggtcggtggtcccctaggaagaattgtctttcccctttcccccaacaagcgccacctggggctgggacgataggtgtgggaccccggaaccacgctgacttaggaaaaaaccttggcatgaactacaccaccacccgaacacccgaccccttggcgcaaccacaacacaacccacaccccgacgagacacacccgcgcgagcggcgacccaaacgctgcgcgcgcagtgccaccacaaaccggcgcgactaaggagcgcgccccacctgcgcccaagccggcggtcccggaaccccacagcccctctgccaacccgcgcgggccccaccccgcgccgccgccccccacaagtcggccagcaccccaccaccacccaccacgcccacgccaacccgtgctagt

SEQ ID NO: 581442 - DNA, 173 bp, Homo sapiens
gaagtgtttctagggtgatcgtgtgagaaaccacatattaacagtagagaatagacgtagacatacgagcatattatcacctccgatacacataatcatcgctatccccaccggcgtcaaagtctttagactgactcgaccacaactccacggacagcaataatgaaatgatc

SEQ ID NO: 581443 - DNA, 104 bp, Homo sapiens
cacagtgagcacatctcacggctcccctagtgctgcccgctggcgggagcctgctggatacctgcagctaggaataatagaaatagaacctgcggtcctatatc

SEQ ID NO: 581444 - DNA, 101 bp, Homo sapiens
ccattgatgggaagttcagcaagatcagcaacaaaccaagaaaaaaatgatccttgcgtgcagaatatctgaaaagagaaatttttcctacaaaactcttg

SEQ ID NO: 581445 - DNA, 166 bp, Homo sapiens
gctcttggggaagggagaaggatttcttaaaccccggagcgaggttctgcttacccgaggccgctgtctgttccggaagaaccccccggttaaaggcaaccttcaatcatgtctgtaccaagaggcaaaaaaaccttcaactgtaaggactttggggggataaagc

SEQ ID NO: 581446 - DNA, 406 bp, Homo sapiens
gcagagagtagacatgtgactgttctagaggccagataactgtgtaagccaatggtattgacaggtcactcgatggcaggctagggtcccatcgaccggttataagcgaagcgggagtccgagcgcgctacgaccatcggtaacaggtccgtgagggtcccctgtgagcagggcgcgtgcactctgggggttcacacgacggtcgccgcgcggaccgcggcagtgcgcgtccgccccgagggcggcgccccttacaggtcctagtcggagtcgctgtagtccagactgttcctcggttggcagctactgagatgctctcgatgcagcgacaggctctgcatgatgcgacgcaggcagtacaggctctgcaggaacgacttagtgaaattgtcctcgtacatggggg

SEQ ID NO: 581447 - DNA, 121 bp, Homo sapiens
ctctagagtatccctgtcatttagtccactgtaggatatgaatgaagagtcagactggaaactgctgaatcaatggacctaaattgacaatggacctaaatggacaatggacctaaatgga

SEQ ID NO: 581448 - DNA, 2077 bp, Homo sapiens
aactttacgcgtagggtagacatggagagttagcatttcatatagccttaggacagagtttgttcatccctattttgatggcacggctactttatcttactgtgtttcctctgtgtccaagtatttattaatattttttaagattttcaagtcaaaatggcaatttgagtatatgtatgtagcctgacttcagaatcgggagagacttttcaaccttgagctacccactggcagcgtgagagaaggtgataggatgtcataggctcagcttacacaagtaagcatgcacaagtgtgtaaataggcaaaaacccctttccagattgcaacatttttcccagtcctgagttcagccctttctcaccaacataacaatctatatttcttttaacttttattttaggtttgggggtacatgtgaaggtttgttacataggtaaacatgtgtcatgggggcttgttgtacagattatttcatcacccaggtattaagcccagtacccaatagttatctcttttgctcctctccctcctcctaccttccccactcacgtagactccagtgtctgttgtttctgtctttgtgttcataagttcttattatttagctcccacttgtaagtgagaacatgcagtatttggttttctgttcctgctttagtttgctaaggataatggcctccagctccatccatgttcctgcaaaagacatgatctcattcttttttatggctgcatagtattccatggtgtatatgtaccacattttctttatctaatctataacctacatttcaaaatgaacactgcaggataatatccagaggacagaaaaggaaatgtgtgatggttacctttggggttatatctttctgtcatccagttatcccatctttctcctggggaccttgggttccagtggcataaagtcctagtccatcaggcaatgactaaagcacagatcgggatccttcgcagcaactttaggaagggtgccaagttcagagtccagaaaaaaaaagggaaacctacaactcatactcagcttccacacaccatgaatgaccccactaggcaaagagatgagttgcttcttgtttcagtattattccataacaaaccatccaaaaacctaatgacttaaactataatttgctatttttcctcacattttttgggtcgattgggctcagttggatagttctcatttagagtctctcatgaagctgcagtcagatggcggctggggctggaatcactggaaggttgattggacatcccagagggcttcttcactcctttgaccgccttcattgtacctcaacaggcctccctgcagtaggccagccaggatttcttacatggaggctcagggcaccaaaaacaggaagcagaaactgtcaggcctcagaggcaggctcaaagctagcacatcactttcattatattcaaaacaatcacagccaaccgagattcaagggagtagaggcatagacccctcctcgccacagcacatgtgtactacagggggaaaagatggcagccacctttgcagataagctaccaccaccacaaacaggaagcaagaattatttgggttggaagattttccttctgcccagagagccctgaaagagcaccctctgtgctactcttgggtggcccagtgattaaagagcaaagtttgtgcaaatataattgtgtaaaacgttggagaaaagtaacttaataaactcacaaccacccttggacttcaataaagcaagcagatgaaaaagtaaataaaagatatagaggctttaattaaatcgaatcaaaaaatgattaatggatatttaacagcacccttcaaataaataattcatattattttcttaacttgtaaaaatcaactataacttaggccacaaagaaaacctgaaaaaagagagaacatataatttttagagtccacatataccaccaaaaataaaaataaaaatctacaatttagcaataagggattaaactcttgcttcaaaaaagcacttagacaccactgcactccagcctaggcgacagaccgagagcttgtctcc

SEQ ID NO: 581449 - DNA, 128 bp, Homo sapiens
tagatcttgcccagcagacaacaacggagccatcgtgaaggctttccatctggagaagggggtggcagagatatgttttagaaagatggcctagctgggtgcggtggctcacgcctgtaatcccagca

SEQ ID NO: 581450 - DNA, 280 bp, Homo sapiens
ctgctctccacccggacacttctgagaaggccaaagatgttctgtttgatcagctgcatggggctgactatcctctgagcactatggctcgggcaaattggccagaaagatgtccaacgcttggatgtcatacttgccactgaagttcctaaggacagcctgtgcaatgtcttgcggggaaggctttctatttgaagcctttgctgcagcaaagaaccatattgctagaggctgtcgtagtccacgacgcccgaaagaattccttgtccttactcgtaca

SEQ ID NO: 581451 - DNA, 471 bp, Homo sapiens
  misc_feature (7)..(7): n is a, c, g, or t
  misc_feature (18)..(18): n is a, c, g, or t
  misc_feature (118)..(118): n is a, c, g, or t
  misc_feature (133)..(133): n is a, c, g, or t
ccccccnaaacctatatnaataaatatttaaccaaagccccccaaacctaataataaaatggattggaaatggggaacaaatccccttggtgccagaaagaatttccaaaataatttnatggtaggatacctncccccacttagtgggctcctgcatagtgaccttcccttgcagagtataatatggaaaggggggaaaagagtaactttacagtggagaaatctgacagacacccagctcagcccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactttcaaggccat

SEQ ID NO: 581452 - DNA, 103 bp, Homo sapiens
gctccacctataccaccagacaacacttagccaaaccatttcacaccaagattaaaggattagggggtgaggaaacttgacaacctgtggcggaataacatat

SEQ ID NO: 581453 - DNA, 335 bp, Homo sapiens
tgtcacagcacatccaccaacaggtaaacggctaaaggaaacacccgagaagaaacttgcaataaagattgtaaagcagacatttgcatttctgattgatgggaagctttaatatttgggcagcgccgagtttaatttacagaagagtttttgttgggaaagtggctctaatgttggggaatttgacacaagggccacatgtggggccttgttcaagccaagtgacatcccaaaatagagttttacttgaaaactttacatcagccaaagatgttttgtttgcataaaggaagtaggggtcagagggggtatttcactacaggaaaagcctttag

SEQ ID NO: 581454 - DNA, 444 bp, Homo sapiens
  misc_feature (1)..(1): n is a, c, g, or t
  misc_feature (70)..(70): n is a, c, g, or t
  misc_feature (106)..(106): n is a, c, g, or t
  misc_feature (141)..(141): n is a, c, g, or t
  misc_feature (298)..(298): n is a, c, g, or t
naatagttggtgttatgcacaagttttagaaacactaagacgtgtagcaatttttaagcgttcttagatnggaaaacttaagaggttttgatgcaatggtatgcantggttagattgggcctttagaaggcttcctacgtntctatcggagaatcaagtcaaaacgtagttttgaatcatggttgcactcacgcgagtttcttacgtactctttatccgaaagagatcaaaccaaatgtagttctaccaataaatctagtgtatctagcaaattttaggtttttgatagattttaagnttgttttagaaaaagttcaattaaacaattaaagttagccccatatgggtaaacccatgtgggtatgtcccttgtggggatgcttcctgggggtatgccccctgtggggatgcttcctgggggtatgcccataaaagcacacaatt

SEQ ID NO: 581455 - DNA, 999 bp, Homo sapiens
  misc_feature (6)..(6): n is a, c, g, or t
  misc_feature (10)..(10): n is a, c, g, or t
  misc_feature (15)..(15): n is a, c, g, or t
  misc_feature (33)..(33): n is a, c, g, or t
  misc_feature (60)..(60): n is a, c, g, or t
  misc_feature (71)..(71): n is a, c, g, or t
  misc_feature (79)..(79): n is a, c, g, or t
  misc_feature (100)..(101): n is a, c, g, or t
  misc_feature (241)..(241): n is a, c, g, or t
  misc_feature (248)..(248): n is a, c, g, or t
  misc_feature (296)..(296): n is a, c, g, or t
  misc_feature (743)..(743): n is a, c, g, or t
  misc_feature (778)..(778): n is a, c, g, or t
acatgncatngcgangaccgacattctttcttntacatctatatctcacaccgccgtacnagacagctagnagtttgtncgtcagagacagagcctaagnntaaaatgtagagtaaggctagagagaagtagtatatcgaaatgtcctgacgtggcagttatagctagcctctctagaaggacgaagaaggatagaactggagtgcactatatatgaggattagacagagctagatggaancaaaaanagatagcaattttctaggagagcgaattggataattagtcctgagatntcgaagcgatggaaaatgaatctccatatactaatgttcagcgctgaaatacaacgaactcttttcatcctagccaggtgcgtcaactctcatacatcgactgtataattctatactcttacaacacatagatctctttccactactaaggtcgttatacatcttatacttatctcatctcaagatcagtacttgccgtcacctcgtattaatacttgcgcgagcagctccggtatctctccgagagcagaacttgatcacattgatccccattaccctgcctaggtccggtctcattcctctacatgctgactcatgagcagatcctatatgctctcgcccctatgaggctagcggtctgtaatatcgcggcgttattcactttcactaatttaagaaacggaggagcataagcccaaattagaaagagtgaccaatcagtgtgcnaatcttcaccaagggaacttttttttttttatagntgactctcctgaatccattgttttatactcaatctcagccctccttaaatcaccccagtactcacactcccttcctcaatcctatatgtcctcctaatcttactctcctctattcttcttttctgcttctcacatctgtcctatgccgcttacgttccgccttcatgctcaatagttttctccccctaatcttattctatcttctctaccccccttccgtc

SEQ ID NO: 581456 - DNA, 400 bp, Homo sapiens
ctagtgtagggagccaaaggcttgagggtcgtgaccaactcagcattccactgaaggctatatgatcaaacagccaactgtttatcatgattgcaaaatgtgggcaaactcgcttctgcacctgccaccaggaggtttgctgagggcaattactccctggtgctgtgctccttgaggttatctactggaacctctggagactactgttcaaagaatgcagtcatacaagcctacactaagtcaagcagcttactgacaaccacccctttctccctatctcctttactcagtaaatacgaaggggtatagaagctcagggcccttgttccctagaagaaatgagccccctgaccccttcttccatatgtactcagcctacactagtggagggtaccgagct

SEQ ID NO: 581457 - DNA, 120 bp, Homo sapiens
tggctaagcaagacaaattcctgtccttgtgccgctatgagctgcccactgatgacgacacttatgaggagcacagacgagataaggctcgaaaacagcagcagcaaccccgagctggtg

SEQ ID NO: 581458 - DNA, 384 bp, Homo sapiens
aggttacgtactgtaccccaaactgtattggtatattatgctacatcgttagtggatagtcagtaagtgttaaagcaactgtttacatttctgggtactgtttgttattctacttaattgtttttattaagacaggaaaatgatgagtcgatggctgcagtaattgaacaacatcgaaatcctttggtatttttcccccaaatatagaagcgttcactattaagaaaggcacaatgacacagttttcaagatttaggagcatcacttgtgcagaacacttcaccagccttcacaatctgtattatatgatggacagaaaatttcttggccctccaaaattataattgctttattatatacttattcttaaactataatcatatt

SEQ ID NO: 581459 - DNA, 403 bp, Homo sapiens
cacgagggcgacactcacatccacttccccttgatcaacgacatagaagttgtctccttcattccctgtaacaaaagaagaaagtcaacagatacaaagtacatccagacatacaagttacagtttctcttgcaaacgactttcgcaacactgttgcagagaccctcgaagcaacatcctgggtgctaccaattctttttaatgacaagattatacaaacattgagataacttgttaaagagcctgttcttaagtttcattagtgaactttctctaaacaatgagaggtgtttttctttttgtttgttttttgttttttttgagacggagtcaggctctcggctcactgcaacctccacctcccaggttcaagcgattctcctgcctcagcctctggagtacc

SEQ ID NO: 581460 - DNA, 1543 bp, Homo sapiens
ctgagtatttggtgcttttgcctgtgtgttctttttgctaggtgtgtgtgtctcgtgttttgtcgtgtgtgtagctcgtatgttggcccctttgctcgtgtttctgatcatttttcttacatagggtttgtttctcctagttgtcgcccgttgttacgttggggggtattgtttttctctaccgctgttctaattggtcaatcctccgcggggggtggctccggatcgtcccctttactgagagtgccgtggttttttccgttgtggttgcctcgtttctcccaggtttggggtgctgtcgtctcttgtttagtgatctcgtcctggcgccccgttcataggggtgatggcttctacacgtttgttgccccgtgggggtgtgttttcttggggtccatgggtgccctatgggggtatgttttcccatgcgggcgaccccttgtggatgggtccccatagcctccttgtgtggcccctgttgttgtgtgctccccgtgtggcgtttttggtgggttcccccaagctctctttgtgtggaccttgtgtggtcgtggcccttgatatggtgcccccctttggtggttgcgccccgtgcccatttgattgcccccttcgtttttggggccccgcgtgtatgcctgccctcggggggtttcctgtgggtgagaatgtgtagggattggtggtgagaagatgtggtgggcccctttatagatggtgtttggttgtaattgttgttgtggcgccccggtgtatctctccccatgttttagcgtagtatctcccgcccgtttttgagtattttccgcgcctttgggcccactaagtggtgttttgttgtatggtttccctcctccacgcgctatttctggggtggccccccacgtggtagtagtgtttgattgatgtcccttctgtgcccctattggccccttcgtcgcgttatagctctgttgttggcctctctgacacttgtgtgaggtgtccacacagtgataggatatgtttgtgaaagggccacatgtggtgtggcttacccctctgtaagaggggtcccacacctctggtgtaccccacatggagagaaaaggggagttttctctcgggcactatccacacactctcccacaggctgtccacgggcctcgtcttccccctcggcgccacccctctgcacgcccctcgtctttggggtgtgttccctcagttctctctgggagcactccctcgggccacccacagggtctctggggtaattgggagagagatagtgtgtttgtttagggggagaggggagaatgagaacccatggatggggttcttggtataattggggaaaaacgtttgctgggtcttgaatttgttgggggaaacacccttatgcccaatggagcgccccggtcccctcgccaagaaagtgtgtgaaggacgcccccttatttggggattttatctctaggggcccggtttctaggcattttaaaaaccccctttcttttctttttgcttccgttaatagaagttaagtatatttacttgttta

SEQ ID NO: 581461 - DNA, 845 bp, Homo sapiens
  misc_feature (308)..(308): n is a, c, g, or t
  misc_feature (386)..(386): n is a, c, g, or t
cttccctacctctatacagttctgataacagaccagcctttattagtcaaatcagccaagcagctttctcaggctcttagtattcatgctagaataccttctcatatccccttacagtccctctcatcttcacacgaacaagtagacatcgttgactataacggtctttttaaatacacacagcctacaccaagcatcaaccaccaatcttcaaatacaggtactgcatccatgcttttattcaacttttcgtattactcaagaacttacctggccatgtacctcacgaatttgttatcacatagagntaccacagtaccagttatacacgactcgctagtatatgaatcgactactctctgtttacttgatgtgctcccatgatncttcagattcagacaactcagacccaaactttagaactgttgactcccccaaaaatattcttttgtctatacctcataactgattcatttctttgtccttacgttccacttacctcctcctaattccatcactatctacttaataactcacgtccaagatcagcagcgccgtgacttctttgttttaaaccacctagcctgagtttacaacttggttttctatcatgcccattcatacagctagattgtcttcattagagtgcttatcccgccaataactgggcaactcctcaaatgcctctttaaacgttacactcacaatatatctttatgtcttggatcgggtaccttattgctagatatctgccatttagcgtcaacttctcttactctcagatgtgtcctgaggctcctcacccaattctttatgaaccttttacttccctgtttgtcttacct

SEQ ID NO: 581462 - DNA, 141 bp, Homo sapiens
catgtcaacttttggctccccaaccagtaggttggcagtaaggcagggtcccctttctccctgaaaaaattgtgaatatttccaaatggattttctattgttactctggttctttgttttaaaataaaaattttgaatgta

SEQ ID NO: 581463 - DNA, 103 bp, Homo sapiens
ggtatattgaatgaatgtaaaaatttcacttcacagtgaacatgaaaccttcacacagtgtaatggtttagattcttttttttaaatttaacctctggcccct

SEQ ID NO: 581464 - DNA, 950 bp, Homo sapiens
  misc_feature (357)..(357): n is a, c, g, or t
  misc_feature (418)..(418): n is a, c, g, or t
agcggccttttcctccctgtcgccaccgaggtcgcacgcgtgaaacttctccgccgtctccgccgcactacgccgccgcgcatgcgctactgtcgtccgtccataccgtgctggctgccctagtgggtgcaaacgtccatccgcccaggcgccgaaggcacatctaagaagatcattgtggcatcgagcctggtgtgggtatcagaggccggtacggacgagccgtgcttcaatcacatggattatcacgctgagcatgaataggaaatagagagcacttgaacgtaaccgtcgattggtgactcccacgtggctactttggcaaggacgtctgaccaagattggtagcacttagcntagtgctgggggactcgtgatcaccgtcatcctggcatgtccctccaaggttctcttgacnaggcccctggcaatagtcgtagagttcattgctcccctgcattgccacgtcgaagaaggaggacagaagagattgatgaccgaaggcagggacggtcgtgaaagcaggtccagcatgcatgacaatggcgcattttgagccttttcctgcagttcaaagttccttgggctcccccctgcgaagaattaaaagcctttttggtacacgattcaaaagagaaaggacgaggagagaaaactctctcgtaaagcccctgtgacccgggcgccattaagggggccccatagaaaactcgtatccgaagggagtggagtaagcgccccgtgatataccgcaagcgcactatattgcggttcgccccctttttgacgtgagaggggggtaaaaagtttggccaagaacccttgtgcgccagttagagcatcagtgggggcccaattaaggcattcgtgttacccttcgtgtgtagcaaactttggttacatctccgggatcattggaagtttccaccgcaacattgggggagaccaaa

SEQ ID NO: 581465 - DNA, 328 bp, Homo sapiens
taaattcgcggccgcgtcgacattgaatgcatgcgcgccttagctggtttcatcatgcgcggacgtatgcaggccatgctcgtcgtggccggatctgcggcattgccgctgttgttctggttgagtgccgccgccgggtgccttgtgctcctgcggcgcggttcggacgcccttggcgtcattggtctgggtgtgttgtcggtgctgctgttctggcacttcaacatccagaaagaccccacggcccttctggtgctgctcgggtcttgcagcctggcgctggttttacgcgccggctactcctggaaccgcgtgctgctggtcgacg

SEQ ID NO: 581466 - DNA, 243 bp, Homo sapiens
  misc_feature (12)..(12): n is a, c, g, or t
cccccctcggcnatcgagctcctgtgcttcttccaggccctcgggccagcgcacctcggccagcggcttggcgaggtgacgcttgaagagtgcggccagcgcgccgggctgtctctgcgggtgagcaggtaggccgcgagcgcgggcggcagggtcttcgacgcgcagtcgccagaagtcctgcacggcttcgagcagcaacacgcggtcgtcctggagcaggatttgccgaggtgccagcgt

SEQ ID NO: 581467 - DNA, 106 bp, Homo sapiens
  misc_feature (1)..(1): n is a, c, g, or t
nggacaaagttatcttccacatgtttgacgtgggtggccagcgcgaggaacgctgcaagtggatccagtgcttcaacgatgtgactgccatcatcttcgtggcggc

SEQ ID NO: 581468 - DNA, 390 bp, Homo sapiens
  misc_feature (320)..(320): n is a, c, g, or t
  misc_feature (348)..(348): n is a, c, g, or t
  misc_feature (376)..(376): n is a, c, g, or t
ttctagaactagtggatctcgcgggcgggaccaatctgctggacctgatgaagctggaaattgaaacgcccacccaccttatcgatgtgaacggcctcgggctcgataagattgaagtgaccgacgcgggtgggctgcgcatcggcgcactggtacggaacaccgacctggcggctcacgagcgcgtgcgtcgtgattacgcggtactctcccgcgccctgctcgctggcgcgtctggtcagttacgtaatcaggcaaccaccgcagtaatctgctccagcgcacggctgcccctatttttacgacaccaatcagccctncaataagcgcctccccgggagcggctcnggcgcttgaaggcttagcgtcagcacgnggtggtaggcgtaa

SEQ ID NO: 581469 - DNA, 452 bp, Homo sapiens
gatccctaaccatggaaaaaatagaaacctagcggtgctgaaactggagaggctactctctgtcttccgggcaggaattcccaggttctcagctggctggaagaattgttgacatttgcttttggtagttgtttcttaaaggataacagtaaacattccaatgtccaagatctggttagtcttccactttattgcttgggatgcttctttggtgtgggttaaggtagggggcggcttgttgcttgatttctgaatggtcatcaatactttaggtcacctgcggatggtgaaagtgccgtcaggagccccgcgggtgtctcacgaacaggtcttcggtgggtgggtggaccacagggtctccagtgggggttcaaccgggcttgggctctttggcatcttgtgaaggagcgttaggaaggacgcgggcgacgccggtaattgtagggacgccc

SEQ ID NO: 581470 - DNA, 237 bp, Homo sapiens
tgaggtttttaaaatcaaaggattttaaaatctttatggctcgaaaataaaaacctcccagtggggaggctataatttgatttctctagactctagtggaagacctttggaaaggccatgcccaccgggcttggactgctagaagccctttatgtttcctttttgggggaaatggatttatgggggggctttaaacaaatagcaatacttataggctgaaataaaatggaacttcca

SEQ ID NO: 581471 - DNA, 128 bp, Homo sapiens
cgtttctccatcagcaacagcatctcctaagtcaaagtcatccccagcacgggtttctggggattgcaggggtttctgttttcatgtcaggaagggcatcggataaatcgaaaccaccacgacgacga

SEQ ID NO: 581472 - DNA, 710 bp, Homo sapiens
tcatcatctttagacttaaggaataaccaatgggtcagtgaagactacaccagtgctgagggcttcttggttcctggagacatgcccagctacagcaaacacagggaaacacgaagtgtgggcatgcgtggaagattgggtcttgaacttggtggggtgggtaagtgatgatccccacgacttggagcagcaggaaaaagtttgtgtctgagtgaagtgctgggccgcccagatgggacagccctgccctggagcttgtcgcctgtggatgtggaatgggaaacaagccccctccctcagtgctgaggaaaaggcacttggctggggtctacctcctgccctactccccatcctgtgggagagacggggtccttgcctccttgcccctttcagcctgcccagaagcctggtcctgggttcagcctctggaagaagcttttgccgaactcataggtgctgatcatgatgtgcacatggatgtgtggtgcagccttgatgatccgaggaagtgaagcctgcaaagagtcccttgtgtgccctgactccggcccggatcctccgcagcagaagccaggtgtgagtccacatgcagggggtgtccactctcacagcctccatcgctcccagagctgacctggccgtatgttctttaccacggtcacgggtaagtcagacactgaagcacgtccctgagatgcacagcaaaagta

SEQ ID NO: 581473 - DNA, 804 bp, Homo sapiens
ctggaggttgtgtcaagatttaagtctttatgggaggaatagcaagaggctatgaacacaaaagcttgttcatgaatatccatagcagcatgtccttaacaggcaaaaagtggcaacagcccaaaagtccatcacctggatatgttgtgaatggataaacaaaaagtggtctatgtagaccatggagtattggccataaaaaggaataaactactaatacatgctacaacatggatgagccttgaaaacattatgctaattaagagaagccagacacaaaagactgcatattgcatggttccattcagatgaaatatccagaacaggcaaatctacggagacagaaaagtaggttagttgttgccaggagcgagggaaatggggaaatggtgagtgattattaatggctgcggggtttctttcggggtaataaaaatgttctggaataagatagtggtggtggttgcacaactttgtgaatattaagggtactctcatacactttgaagtggtaaatcttatgaatttcatggtgggatgaatttatattctcagtttttataaaggaaggctaatgatgggtgacgaaggcgtgggctgcatttgctattgtccacgacgttcccttttgcacatgacttgttgggatgcctcgttggggcacggcttgggggttggacggtggggggaccctagcagttgatgttgcacgagacccttgccttttgccgctcccaagaaagggacagtcactttgccgacttaatggggggttacacagtggacaccaggggaccacatgag

SEQ ID NO: 581474 - DNA, 324 bp, Homo sapiens
  misc_feature (226)..(226): n is a, c, g, or t
  misc_feature (229)..(229): n is a, c, g, or t
aattgggaaagtatcttatctaatcaggcatgtctgtaaaatacagaaaaattatgggtgttaaaagaaattgataagaattcatctttggtggcaatctctggttttgagatttagttcatgggacttcagattagtatttggtggatggaacgcatgtgtttactgtcagtctctcctgcaacaccattacaggcatggtaaatatgagaagaggcaacagtanagnagaggcatcagcaaatttttggaagatgaaaagcaaatagacctgtggcatctgccttactataacagagtcgacgcggccgcgaatttagtagt

SEQ ID NO: 581475 - DNA, 1098 bp, Homo sapiens
  misc_feature (791)..(791): n is a, c, g, or t
agcgggggagaaagaggctccggggagatagcggaccattgagggctggccctcttttgaagcggttgttcgtctctttccgccagtggctctcccgagtatcacgcagagggcgggtcccgtgtagcgcgaggcggtgcagggcgggtaaggggagtggttggcatggttgcggcatgtcacgggactacgcagagcagctagtggtcgcttgtcagcgcagggccgtctggcagactatgggatgaccccggggtcgccacaatgatatagaatcttgtccctccgagctggccctgtaggcatctagaagtgcaacaagcggatgagcactgaagacgacattactagtttgtcagtgtaaggaccatcgagaacctgttcttgaatacatcgtatctggttctgttgtgtgatgatgaaataccctagcgacctattatagtgatattctgtttccttagaatgtcaaaaagagagggtagatttatatggatttattgaaatgtgaagaacggtgaaatacagacacgggagatatatcaatgcaagtgagcaataaatcactggagatagtctaaggcgaaaggaaccaggatttcggaggtatattgaacaatgcagatcattgaaggaaacagtccatctactttcatcatagaaagaaatacgattaatcctggtggttccagatatgttggaatgaaaaaaccagccatttaatggttttacagaagcgaatacagaatgggtttgtagatagaagaaggggcaaattagggatgtaaagngatgggtcacggcagaatacggggcatcttggggagttgaaaagcagaaaaaaggagtgttcccttgtggttccaaggggcatgggagattggactaatatttaggaagcgcgtaaatggggaggtgagtaaaagacatgttatgcgaagcatgtttctatgacagagaaagaataaggggggaacataagggtttgttaacaaaggagcacggaggtagaatagcaggaagtgagatagcgcaggacacacaatggaactgaaaaacgagggagattaggggataaagacagaaagatcaaaatat

SEQ ID NO: 581476 - DNA, 708 bp, Homo sapiens
  misc_feature (6)..(6): n is a, c, g, or t
  misc_feature (366)..(366): n is a, c, g, or t
  misc_feature (376)..(376): n is a, c, g, or t
  misc_feature (393)..(393): n is a, c, g, or t
  misc_feature (410)..(410): n is a, c, g, or t
  misc_feature (414)..(414): n is a, c, g, or t
  misc_feature (419)..(419): n is a, c, g, or t
  misc_feature (437)..(437): n is a, c, g, or t
  misc_feature (474)..(474): n is a, c, g, or t
  misc_feature (476)..(476): n is a, c, g, or t
  misc_feature (480)..(480): n is a, c, g, or t
  misc_feature (519)..(519): n is a, c, g, or t
  misc_feature (578)..(578): n is a, c, g, or t
  misc_feature (685)..(685): n is a, c, g, or t
cacttngcagcaagacaatggatgatgtgggaggtgccaggcccctgggttggcataatttggagtatggttgagacagggctggagagaggcatcttagaggtggcccccaaatccgcaatcgggagaaaaaggcaagaatcgactagagattgtcaggataaagggaggcactgcccacccctgctatgtctgtctgcccccacaggggcttctttaatacctggggttccctgggtgatgaatgtcctcctaccctggcaaggggccatacctgtcgccgtggccccataggcaaccctgataaaagagtatcatttccaagggggctttggtttctgggtggccccacctcgtcagtggggnagatggcacngaaatgctaactaaaanagccatggaagtcaccngggngctcngaaaagaaacccctaacntggaaagcatgcgctcctgcagcaccctttgtaatangnggcnatggtggatggctgccccgtgctggggcccttccggatnggtgaagacctgagacacgtccccgcattccggaggcgtgccgcgtgtaaccccaaacnacgctacattctgggcgtctaccgctggccccggctatatcttggcgggccccgctgggtgcctggcatcacgtggtacctaccaggggcggggcgagtggctccanctgaggagatcggtggtggcgtc

SEQ ID NO: 581477 - DNA, 132 bp, Homo sapiens
  misc_feature (2)..(2): n is a, c, g, or t
  misc_feature (89)..(89): n is a, c, g, or t
tntgttccacctcgtctcctcgaaataatctccctgtcccactttgtataaatgtggtctcggctcgtccctggtaattcttcgtccgnacctcgtcccaggtcgagtctgctcaaggtggaacgtaaccca

SEQ ID NO: 581478 - DNA, 171 bp, Homo sapiens
cgtgagactggtggcattacaattgtgctgtccaggagtcccgttgtggcgcagtggttaacaaatccgactaggaaccatgaggttgtgggtttggtccctggccttgctcccgtgggttaaggatctggcattgccatgagctgtggtgtagttcgcagacgtggctcg

SEQ ID NO: 581479 - DNA, 403 bp, Homo sapiens
taaaaaaggggtgaaaaaaaacaaagagggtaggtcataaccggtgaacatagcgttgtatcacatccggttaatgtaagggtttttcagaaatagggtgtgaatattttaaaatgtttctctttcagggtgtcagtttttctctcagaatagagtattctgtcacattgaatccaaaacagagagtaagctttctgacatttgtccacctgttgctctgtaattttttggatcccgtaaaatgccagaaatcaagccaggtcgtgggtgatcaaccctgtaattccagcactatgtatggacaaaagggtttaagagcgtacgcctaggagtagaccccagtctgggctcccatatagagacctgggctgcactatacaaaaaaaataaaactggcgactat

SEQ ID NO: 581480 - DNA, 351 bp, Homo sapiens
ttagccaggagtggtggctcatgcctgtaatcccagcactttgggaggccaaggtgggcagatcacttaaggtcgggagtttgagataagcctggccaacagagtgaaaccccatctctactaaacatgcaaaaattggccgggtgcggtggtgggtgcttgtaattccagctattcgggaggctgaggcaggagaatcgcttgatcccgggaggcggaggttcccgtgagccaacatcgcgccattgcactccagcctgggcaacaagagcaaaactccgtctcaaaaaagaaaaaaaaagctcccccgagtgctgccgcttgtgtggatgggtacttggtggttcttag

SEQ ID NO: 581481 - DNA, 523 bp, Homo sapiens
gaatgtatcagaatttcattccttttggagactgaataatattatgctgtgtagatagatacatcacatttagcttatccactcatccatctatggacagttaggttgcttccacctttaggctattatgaataatgctattacaaacatgggtatacaaatatctgttcaaatccctgctttcagttcttttaaatagatactcagaagtggaattgctggatcaaatggtaatcctgtttaattttgaagaaccatcataccattttccacagtggctataccagtttcacatttcccaccagcaatgcactagagttccaatttctctagcatcttcaagaaacattcggtagctttctgggtcttagtcatcgtcaccctataactggccatcctaattggttatccaggtgcgtatattcattggaagtcccggattctggcacttcccttacatgacttaggcaatatctaaggcatcgttattcatggtggcttatttcggccatttactcttcct

SEQ ID NO: 581482 - DNA, 1304 bp, Homo sapiens
cgatgatcaggactgggcttgctctgacagtccactagcatgggggtgtgctcaccaatggtgagcagatgagatgctccgaggtgctctctcatccgtgatgcatcagttgcctatccctggactggactcagtctttggagagcatggaaccatgggaagcgtcatcagcattcgaacgatcgtgtgggagcgtgtgcaacggaagcgtgactagatgcttgtgctcaaggttccgctggacgcgactctgggtccgccatacacataggcatcgccgttctactgagaagtggttagctacctggttacagacgggcgtgagtgactcctgctggtcaagactcatgggactctgcgacaaggcgttaaggaagcgtgtgtatagacctttgacagctggcataacaagttctgaggtaaaagtcactgatcttctgacctacgcagtggtacctagcactggcatcttgggggcacggatgtccagatctacatctgcaaacgagggacggagagttcttcacttttacagagcatagcgggctgtagcacaggggtggcctatcggggatgacgccaaggtacatcgcatgctaacaggcagtgggacagaggcctcaaagtactacaggctgtaggccctggcccttctgactggaagctgggcctcatctcagctagaggggtagaacttggggtctgcggggccggggtggcgggggcccctgattgggggccggcagggggctctgtggccggttggcgcattccccatctctgttgccacctgggttctcgatcattggtgggcccatgacgcaaaccagttgccgttgcgtgggccgcagccgctcgttcgcgtggtccatttccaggggccccgagtgggaagtccgcttgtgggattgtgacagaccctggtccccctcttgcttggcgtccagcggtcgtcggtacccgcgggcctattcccttctctgtgcgtgtgcactggcgtgtggcgggtgggcgatgtgtcacctccaatttcgtgtgtgtgttcctgcgttgaaaatgaggagtgctggcccatctgcgtctgttgatcgtattgtgcatctgctttcgtgcgctagttgctctgtgcattgtttgcacgctagaaaatcgggtgctgagcgtgccggcgtgtgctcgcttctatgctcttttgctgcggctgcctatgttttcatgcgcggtgtccgagggcatgtgcgtgattgctcctgtgtactcccctccgatcagatcttcgcgctctatacctgctcggtttcgtt

SEQ ID NO: 581483 - DNA, 325 bp, Homo sapiens
gatcctcctcacggggctattgccccactcattgcatcccggctcacgcacagagttgcttagtggtatcattctctgagtaacagcgccccattgcacgaccacatcatgttctgggatataacaagatagtcaatgcgttggaggaataataacaggggcaatatatatgcgctcatgctgtcatgttgtgttgcgtttagtcggggtccccgcactaggtataatagtaccaccctatgtgcggctgttctataagagaaacatatgatgggcgatgatttgcacaccaggacaaaaaaaaaggtaaacagacacacaaaac

SEQ ID NO: 581484 - DNA, 253 bp, Homo sapiens
ggcagtcatcttagtgcagatcatggtgctttattaacaaattcatgtattcctttcccattcctttaatacaaaaaaattttattcaatcatcagttactttcatctgacatttcactaaggtatagttttcataatgtcaagcgttattctatcagtcattcaatgtgggtcacgtaagtttatcctccttgtgccaaacacccacttgaaggatatgaataaaagatgtctccaggtgaatacaacaacc

SEQ ID NO: 581485 - DNA, 1468 bp, Homo sapiens
taaattttttcaccaaaaagcagctggaaatcacaaaaggcagctgccgctccgaggggtctcaaatccattaaaacccaccacagaaacaattaacaacaatcgagaagaagaagaaaagaggaaagaggaacacaagcgtccaactattggcgcattgggtatataactccacgaggttatcccagagagcttccctcttgtggaattgtgagaaggcacaacattattattgtggacaaaacacctgtggtttctctcaattacaacagcgcgacagggagaagccttcagtgtgcgcctccctgtgcgcaaacaaagaggccgggctctctgtggtgcccaagtctcgaagaaccgtggtgcggagtgtgcaaccaagacaagactctctcctcgaaggacgatggagggaattcaccgcgtgggcccctctttttcgcaactcccaaatatcaacccgcttgtccgagagacaaaattctcagacagagacgctataccaagagacacagcgtgggggtcctctcgtgaggcgtgggagtgtgaccccctataattcacccacccgaggggcaacgaaaggggggaccttggggggcccatattaaaataccccgagggacaacacgcgtgtggcgaggcccccgagagagcaaatataaacccccgtggcgtggggcaattcccctatactctttgcctataccaaaccctcttctggggtgggtgcggagaccagaagagggccgccccaatattatcccctaaaagcggaattcttttggggtggcccaaccacactcatactacatacaaaagatggcccccaagcagcgtggataacccccttatccttatcaccatgagggcttttccggggcagcttgctcgttggtggtcacagccaaacttgcgtgtcctaaaggcctcaaagaacgtaatattcgtccccaaaagacattctcccgccatttattcctttggcaacagagcaacgattcgtatcccgaattggcacaagaaccgtttgttaacgcacaaccacactgacggtggctctctccacatccacgcggtggggtcccgggccacacaagagcggcgctccataaagacaaacatctttgtctcccccccaaacagcaaaccgttggcgccaaaagaaagaactaggggggcacaaaggcccgacaccccctgttctaatcacccgtgcggtgcaaacaagagcgcggccgacgacgagaaaaacacccctcgggggacgcggcacacacacaaacacccttacataatactactacaaccaaaccagcagagccatagcgcaacatcacaccgtcgtccacaaggacacccgaccgaaatgtacgaccatctcactacacgtacgcacacacacggagcaaccgacccatactacggtgcgcagccccacaagcgactggagcgcgccaacacatga

SEQ ID NO: 581486 - DNA, 656 bp, Homo sapiens
  misc_feature (399)..(399): n is a, c, g, or t
gctcccgagtaagcgccggcggagcgtcctcgctattgagcgcgagcccagcgcctcgtgaggccgacccgcgctgagttggtcagcggctcttctgctctggcggtgcaaactagctaatgagtgcgaacttgagcctacggccactaagggacagcatgttgcgtgtttgccgccaagcgacacttgaatcgacttgctgtacaacgccagggagtgtctagcgcaggcatccacaaggacgcgagcgtgggccacttgctgcgacgcttgtcacgaggatcggcagcgagaccgtctgttgtcctagtcggccgtgaactaaacgaatggtcgaaactgtggggcgttgggatcacaccagagcgactagtccccatgattgtttacgccctcctnctacagagtcctcgtctttgggctgttcccatctcaatcgagcgtgggccttgtgggctgggcatttgtagcgagttaatgctcagcgagcaaagatgtgtcaactgttgctattcactgatggaatccaatctccatttgcgctcagtttagcgagttcctcgatggaacctcgcaaggaatgttgtggattccccaagtgacccattgaggctccgataaacgagaaaggtctgtctttgtcattgcgtgctgga

SEQ ID NO: 581487 - DNA, 84 bp, Homo sapiens
  misc_feature (65)..(65): n is a, c, g, or t
  misc_feature (73)..(73): n is a, c, g, or t
cacatggggccccaaagcactgcaggccaagcagggcaaccccacacccttgacataaaagcatnttgaagcnttaaaaaaaaa

SEQ ID NO: 581488 - DNA, 194 bp, Homo sapiens
ttttcaccccgaagtagtccttgccagtcacatacaatctcagagggtcctgtaccttcctttcccatcagaccaagccgagcgccatcaagactcatgggcctcccagtgcacagagttttcggattgacgcgcagccagcgactccactgctgcagtaagaccccgcccagccattggagcccatgcggccg

SEQ ID NO: 581489 - DNA, 179 bp, Homo sapiens
cctggagggcgaggaggagaggctgaagctgtccccccaagccatcctcgcgcgtcaccgtctccaagagccacctcgagcagcagcggcagtttgtccgtcaccgggcgcctgggccgcagtacgcggaagcggctggaggtggaggagcccttgggcagcggcccaagcgtcctggg

SEQ ID NO: 581490 - DNA, 127 bp, Homo sapiens
gaagcgtgtctcacagtggagactgagagtagctccctcgggtatctatccgagctcttcttcctccacatcacagcagcgaccacagggtccagtgaccacagctccaaggacaacaaggcagcaa

SEQ ID NO: 581491 - DNA, 414 bp, Homo sapiens
acagacagcatagagaataacagacagaacacccatccagtacagaatacagactgacccgtgagacaaagaagacacgtgctcattaggcactgtgggggtagcctgagcacacataccgatcccgaaacaacttcaccaacacatacaacatgaaaagtcctctacttatccgccttcactagcaaggacgagggcacctaaacgtgtacactccaacacactggacataccccaaccatctcctcccaagaacgtcacagatgctcagagacaaaatggtacaaagtgtgagggcatcagcctgctggctcagaacacctcgaggctgctgatgctcctgctctccctctccctcctccaggccacggatttcatgtccctgtgactggtggggcccatggaggagacagg

SEQ ID NO: 581492 - DNA, 291 bp, Homo sapiens
cctcctgggttcaagctgggggatcttgccttagcctcctgagtaggtgggattacaggtgcccgccaccacgcccagctaatttgtgtatttttaatagagacggggttcaccatgttggccagtctggtctcaaacacctgacctcagttgatccacccgcctcgtcatcgcaaagtgctgggattataggcgtgagccacggcacctggtgcatggtcagttgcaagtacattaaccatgctggttggcaactgtccctgaaatagctgtcgccgtcccaaagcacag

SEQ ID NO: 581493 - DNA, 423 bp, Homo sapiens
cacatacggttatatattcccaaagtgctttccgatttataacttgtttgggatattatatttttcaatgcaaggctgcttgatgagtatgactcagttgtcaggttaaatgtacaactaatcaataatacatttttaagttttccaatgattatttgcatttgtataactaaagagaaaaaaatactggtaggacaaaatggttcttcttggttctcacacaagctatgagtcattcactctcacgtacttatgaagtctcacttattcctgcaaacagaaaaggtaagttgatgtatgattcccatgaatactgctgagttccacttcaacagattaaagtcctggctcatgatcaattctggggaattaattcaataagttttgtttaacatacaacactgctatctgttctgctgatgc

SEQ ID NO: 581494 - DNA, 190 bp, Homo sapiens
tagagtgtactcaagacgtaggactttaatcgtgaacaaacgaacctttaatagcggctgcaccatcgggatgtcctgatccaacatcgaggtcgtaaaccctatgttgatatggactctagaataggattgcgctgttatccctagggtaacttgttccgttagtcctacgtcttgattgacactcttt

SEQ ID NO: 581495 - DNA, 875 bp, Homo sapiens
gccttctcgacgtggacatggatggctcctcgggtacatactggccagtgaactcagaccaggccgtgctgagcttgatttgggctggctctgaccttcggcttcagggcaccgaggtgacaccttggtgcagccaccgccccccgacagccccagtatcaaggatgaggcccgcaggatgatccgttccgcccagcaggtggtggccgtggtgatggacatgttcactgatgtggacctgctcagcgaagtgctggaggcgcggccgtcgggtcccagtctacatcctgctggatgagatgaacgcgcacacttcctggacatggccgacaagtgccgtgtcaacctgcaccacgtggatttcctgcgcgtacggactgtggcgggccccacctactactgccgcactgggaagtccttcaagggccacgtcaaggagaagttcctgctggtggactgtgccgtggtgatgagtgggagctacagcttcatgtggtcctttgagaagatccaccgcagcctggcgcacgtgttccaaggagagctggtctccagcttcgacgaggagttccgcatcctcttcgcgcagtccgagccgcttgtgccctcggccgcggccctggcccgcatggacgcctatgccctggctccgtatgccggggccgggcctctcgtgggcgtccctggggtcggggcgccaacccccttctccttccctaaacgagcgcacctcctgttcccgccaccccgggaagagggcctgggcttcccctccttcctcgacccggaccgccacttcctgtcggccttccgccgggaggagccgccgcggatgccggggggcgcgctggaaccgcacgcggggctgcggccgc

SEQ ID NO: 581496 - DNA, 370 bp, Homo sapiens
accggatcttaaacacgaattcatcctctgctgtgatggaacagaatgatggcctcagcaggaccaccccaacaaggaggcagcagcaacaagtccaccacctactcagagaaagccacaaggaccaccccaacagtgaggccatcccctacctcctcaaggaaggccacaaggaccaccccaacaggtaggccatcccctgtcctcctcgaggaaggccacaaggaccaccccaacagagaggccatcagcaaggtcctcccccaacgtcgtcctgaaaagccccagggaccacctccccaaggtggccgcccacaaaggacctccacaaggcgccagtctcctacagtaatctaggattccaatgacg

SEQ ID NO: 581497 - DNA, 364 bp, Homo sapiens
  misc_feature (330)..(330): n is a, c, g, or t
acacgatctttgcagataaatttgattttccctgtaaatgattatttatgagataaaacataaactaaaaatgattcatttccatcaagtgcaaagtttagctgcaaaatcataacattcttccttatatgtcacacaggtgaaattaatggcctgagaaatgtacagactgctcaacctggtttacgatgccatatagtacctatgtgtactcggctagtgagaccccacgttatgccatggtaaaccacgcttgcacgctttcttaatctctgtataggtagaaatacattgcatgattcatgtaacattaattgatcatatttacangcttgatgtttaattagagtttctttaccctctt

SEQ ID NO: 581498 - DNA, 109 bp, Homo sapiens
ctccacacagcaacttaggctttcctgaaattgccaagcctggtgcctttccaaaggactatcagggcctgtggtggagccagacagaagccacaggatatgtgccctg

SEQ ID NO: 581499 - DNA, 102 bp, Homo sapiens
gtctctgtacacagctctggccctggccttctgatttgcacagtgatgttaactgacctggcaccttcctcaaacaggtgattttgtcctcatcctaccaaa

SEQ ID NO: 581500 - DNA, 227 bp, Homo sapiens
ctctgtgggccaacgtcttccctgaacgtggtcctttctagccatgtttacttcttccaagtaaaacgaataagtccttttctgcctgggcttggggaggcttgcagatcttgccatcggtcggtctgagccttttcactattcccataagtgccccgttcgcgtctccgctattgtgctaatattccgctttccccttctgcaatcatgcgtttgcgaataagggt

SEQ ID NO: 581501 - DNA, 317 bp, Homo sapiens
gatcgagctcggcccctatttttatttctttttgcattgacatgtatatttgtgatgatggtcttatggaagatcgttgttgagctagaaacatgtccttcaccagtggaattcttagaagctttcctgtggtgacttcgctgggtgctaatagaccatgatcgtattgctctgtatataatggtacaaattttgttttataacactcagtcttaatagaatgggaatattttatcttactaacgtagtcattagctggccactctctgtgtccattggaccttatagggtaaagggagggcagtgcgtatttgaag

SEQ ID NO: 581502 - DNA, 403 bp, Homo sapiens
cagatttcaaactggacatttaattttcttgttgtttcttttaaagtgagtgtttgcttggtaataaaaattctagtatcatctctcaccctctcaaaaattacatgattgacttatccccaaaaccagaatattattttggtttagaataacaccacagggattatataatgacagaattattttgaattttgccttcaagtatgaccacggccatggtttctttaaggttaatagggacaagttcttctgcaggtacaagcccacattcctttcataaaaatgtgaaagatcttcagttttgacagcattttttagcttttacatcacattgtgaaacataatggcacacaatctttgtaaatagtgcaacatcaaataataaaggcaacaatcaaaatca

SEQ ID NO: 581503 - DNA, 373 bp, Homo sapiens
gggtagcagcaatcgtcacagggtagggagtgaaaaatagtaccactgtattggaaagacatttggtattatctagaaatattgaatgtgtacctacctacgtatgatgtagaacttgtattcctaaggtccatatcctagaaaatccttgtgcatgctcactgggtatcactgacaagaatgttcataagtgaaatttgtagtagcaagaactggacatgccacatatccttcaggagtagaacagaatatggcaaggaaaaatgaattgcagaacaatacatatatttcaggaaacttctatcgaattaaaaagaacaaggtctagggctgggcgtggtagctcatgcctataatcccagcactttgggag

SEQ ID NO: 581504 - DNA, 476 bp, Homo sapiens
gtgttaggagcagtgttatattcccagctcagagatgattgtgtgctgggaaatgcttatattcattatttcccaactaatgcatttggacatatgtattccagtttttcaaagacactacccaaagcttctttacatttgcattggttatatttaatatttcttaagctaagatcactgattatccacacgttattagaaatctttggttacagtgaggcttaacctgggctaaagtctcctaaatgggactacacttagatccgccctatttcacctttggactaacgttgactaaatggctcctagagttacccacagagggagcttactatgatgagagctactgtggggaaacatagtattcaacagagaaatggaagaatacaagtagcaatgttccttgtcttcaataacatttgagggaaaggaatctagaaatcctaaagcttagtcagggtgcctaaggtaagaca

SEQ ID NO: 581505 - DNA, 120 bp, Homo sapiens
acgcttgaagcgcacacacacaggcaccggagccggcaggccatcacagtggctggtgagcgtttccacatggtgcagaatgtgtccatggccgtccaccacatctgcaaggaacccacg

SEQ ID NO: 581506 - DNA, 162 bp, Homo sapiens
cccgggctcagtagccagagcctcaaggctacggtgagggttttgacttctgcgcagaagtggggagcccctgcaaggatttgggcagagaagaaacaaaatctgatttatacaacgtttaaaaattactctgcctgctgtgttgagaagtgcgcctgggtg

SEQ ID NO: 581507 - DNA, 354 bp, Homo sapiens
taaagacggagtcttgctctgtcgtccaggctggagagcagtggcgccatctcggctcatgcaacctacgcctcccgggttcaagcgattctcctgcctcagcctcccgagtagctggcattataggtgcctgccattgcacccggctcattttttgtatttttagtagaggcagggtttcaccatgttggccaggctggtctcgaaatcccaacctcaagtgatccacctaccttggcctcctaaagtgctgggattacaggcgtgagccaccgtccatggcctatttccctctttcatcttttaaaataattttctgaacatttaagctttttatttcctcttgtcacaatt

SEQ ID NO: 581508 - DNA, 240 bp, Homo sapiens
agggaagggggatcgttggaagtagcaagaagtaggagagaatcttggcaataagacgagaaacccgaaagaatcagaaagaagtctcatgttgagtagctgaaacattgggtgaccagaaagaaggtcggtgtaagtcaaggaagagttaggtgttgcttgatcaaagggctaagagaagcgggtctttgtaagttgatgtcagtcaggatcaaggaaaagcccttgaagttgcccggg

SEQ ID NO: 581509 - DNA, 180 bp, Homo sapiens
gcaaaggctgactctgcctcgggacacagcgaggtcccaagggacagcctgaactccctgctcatagtagtggccaactaactttggtggactgtgcaacgctactcctggctctaataccatctctgggcttaagatgagagacctggcactcttgagcatgcctaatactctccttga

SEQ ID NO: 581510 - DNA, 750 bp, Homo sapiens
atcgcggccgtggacggaaccgtcgccgaggccgagtagctcgcggagtcatggccgaggatatggagtgtatgcccgtcaccaagttgatccgcttgctcaagcacatgaggataaaggctctggcggagaaatatctgtgcttgctgcccattacggaatcagagatcattgaatgcttactgtgacgctctctcacggatgaggcttagaaggttaagccagagcgccagagctgttacggacagagacatgaccttcacggcatttgctgctatcgaactctacaatgtgcaagtagaactggatgatacagagtccatgcaggtgcaccatgaccttggtgaccagaacatagtgatcgcccctgttcaccagctcgggctacatgagctactcttgtgacctcagccaacgctgacctgctgatcgtcagtgcctcagctgatgccgtcgctgatattgtcatgcacactagcactatgacgagtgcatttaacgtagcattgccagatatagtcaacgagctgtctataatcactactgctagcacattggcctgcattacccaggttgtggactgacaccctggagcatcttactgcttgcaccactctggagcttcttcgacactgaaccacaatttacagctgcccatgcctgacgacccggcaacaccttgacccacgcatccctatccgctcattgcctgatccgctttagcgctcccgctttactctctcctcctcg

SEQ ID NO: 581511 - DNA, 682 bp, Homo sapiens
ccccggtggaatgcctcaccagagcagcgtgtagcagttccctgtggaggattaacacagtggctgaacaccgggaaggaactggcacttggagtccggacatctgaaacttgtagactgggagctgtacatggatgggagcagcttcaccaacccctgcaaagtgactctgaagaagacgacaagccctgctccagtcacacccggaagctgactggtccacgcacagtgaagcatgaggaaactcatcgcgggactaattttccttaaaatttagacttgcacagtaaggacttcaactgaccttcctcagactgagaactgtttccagtatatacatcaagtcactgagagaacatcacaccctgaagccagagactaacactgcaggactcagcagttgcttccttcagcctaagcacagcagccacagccctttctggctccattgctgtggtgtccctcatcttgctccctggtgggtctcttgtccatgaccctgaagacactggaggccaagagagactatttaagaaacacctgagggcatcagaccaaatttccccaaagtcctcggaatctttactgccatgctgaatgccatatattccaagtgatccaacctgggtccccagaaggagggcagactttggtgtttaacaaattgccccttttatcacca

SEQ ID NO: 581512 - DNA, 863 bp, Homo sapiens
  misc_feature (38)..(38): n is a, c, g, or t
  misc_feature (78)..(78): n is a, c, g, or t
gcgggtcattgccattaaatagagacctcaaacaccgnctgctaaaaatacccgactggaggagcataaaagcgcagncgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttttcaaataaagttcaaagc

SEQ ID NO: 581513 - DNA, 157 bp, Homo sapiens
  misc_feature (97)..(97): n is a, c, g, or t
cttaaggatccatccccggttctgggtagcgcggtctacgatctgtttcgtgacacgatgcggtagatctctgcaaagggggtacagggggacgtgnggtgagccagcacgtgccctggcctgcccgatggggaaccccctccctgcagtgactcca

SEQ ID NO: 581514 - DNA, 786 bp, Homo sapiens
  misc_feature (21)..(23): n is a, c, g, or t
ggctaggtagaggctgggtgnnnatcggccgagggtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttttcaaataaagttcaaagc

SEQ ID NO: 581515 - DNA, 1250 bp, Homo sapiens
  misc_feature (38)..(38): n is a, c, g, or t
  misc_feature (78)..(78): n is a, c, g, or t
gcgggtcattgccattaaatagagacctcaaacaccgnctgctaaaaatacccgactggaggagcataaaagcgcagncgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttttcaaataaagttcaaagcaccacctgaaaaaaagaaacaaaagagggggcggtactaaaaatattcctgaaagggggaccaaaactttaacgcagataccacaggctatcgtgtggaacagaagtgggctccactaaagtgaaggcggacatataagggaatagcgacctcgcctgttgtttaaacaaggatttgtgttacttgggaaagagatggtaagcataagaatcagtggtgaaaggaacccttaaatacgatgtgaggtaacagtaatggggcgaaaatagtaaaaaagttaaaggactacgggtaatatgacactttagctgtaaaatgtgttaacaagctagaaattgtataggataagaaaattggaacagagatataagtttgaacattttacag

SEQ ID NO: 581516 - DNA, 218 bp, Homo sapiens
ttttttggcctgttaacgcttcaactggggaacggtgcagtggctcatgccataatcccagcactgcggaggatcgtttgagcccaggagcttgagaccagcctgggaaacagtgcgagaccgtttctacaaaagtaaaagttagctgggtatggtggcagtgcgtacggtcccagctactcgggaggctgaggtgggaaaactgcttgaacgtcgac

SEQ ID NO: 581517 - DNA, 225 bp, Homo sapiens
aaaggaaagtttggtggtgcaaagggtcgctaaagtgcccggactttctggttcaggtcgaggcgacgaaccagcggaacagcaggttgtagttgagttgttcgtgcagttgctgttcgttggggactgagtacaggagttgcagcagcaggatctgcaagacggtctggggggcgatctgggtgccgggttgggcctggagcaggtcgcgatggaggtcgagga

SEQ ID NO: 581518 - DNA, 934 bp, Homo sapiens
  misc_feature (38)..(38): n is a, c, g, or t
  misc_feature (78)..(78): n is a, c, g, or t
  misc_feature (756)..(756): n is a, c, g, or t
  misc_feature (783)..(783): n is a, c, g, or t
gcgggtcattgccattaaatagagacctcaaacaccgnctgctaaaaatacccgactggaggagcataaaagcgcagncgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgccacgcagtccaacgagatcaccatcccagtcancttcgagtcgcgggcccagcttggggnccagaagctgcaaaatccgatgagactgccgccaagtaaagccttagcccggatgcccacccctgctgccgccactggctgtgcctcccccgccacctgtgtgttcttttgatacatttatcttctgtttttttcaaataaagttcaaagc

SEQ ID NO: 581519 - DNA, 1321 bp, Homo sapiens
  misc_feature (38)..(38): n is a, c, g, or t
  misc_feature (78)..(78): n is a, c, g, or t
gcgggtcattgccattaaatagagacctcaaacaccgnctgctaaaaatacccgactggaggagcataaaagcgcagncgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttccgcgactggtacccgcatagccgcctcttcgaccaggcttcgggctgccccggctgccggaggagtggtcgcagtggttaggcggcagcagctggccagaagctgcaaaatccgatgagactgccgccaagtaaagccttagcccggatgcccacccctgctgccgccactggctgtgcctcccccgccacctgtgtgttcttttgatacatttatcttctgtttttttcaaataaagttcaaagcaccacctgaaaaaaagaaacaaaagagggggcggtactaaaaatattcctgaaagggggaccaaaactttaacgcagataccacaggctatcgtgtggaacagaagtgggctccactaaagtgaaggcggacatataagggaatagcgacctcgcctgttgtttaaacaaggatttgtgttacttgggaaagagatggtaagcataagaatcagtggtgaaaggaacccttaaatacgatgtgaggtaacagtaatggggcgaaaatagtaaaaaagttaaaggactacgggtaatatgacactttagctgtaaaatgtgttaacaagctagaaattgtataggataagaaaattggaacagagatataagtttgaacattttacag

SEQ ID NO: 581520 - DNA, 195 bp, Homo sapiens
cctacggagctatgtgaagggcagggctcccgacagattgagggggtggggaaaaccaaaataaacgtccaataaattgtgtaggaggagtccagcttaggaccgggccagacgccaggccaaggctcggggacaggggcctactgcagagttcagagagatcaatgtgtggcaacaacgagcaacctgaggagc

SEQ ID NO: 581521 - DNA, 210 bp, Homo sapiens
aggagaattgcttgaacccgggaggcagaggttgcagtgagccaaatttacgccactgcactccagcctgggcaaccaaatgagactccatctcaaaaaaaaaaaaaaaaggaacccttaaaggaaagccctctcatattcaggggtgggaagactaaatttgggggaatattaatattggaaatatcctccccaaaataggctatagat

SEQ ID NO: 581522 - DNA, 232 bp, Homo sapiens
tggatcctcggccactgtagggaggcaggagggaaagtgcagacaacgatacaccagaaagccccagggacagcgccagtcctcccacgaaaagcctgcccatagcccagggcggtgtaacacccgtgatcccctcctgtagtgtccacagtccaggtcccacaatgatgattactcctaggatgctgcccgacagtcctcaccagtcgtagccactgagaccctggcctct

SEQ ID NO: 581523 - DNA, 578 bp, Homo sapiens
gactttctctccccaacatctcctgtcaccacatactctctctccaatctccacccgcggtatctctctttccctctcccaccaacaccacaggagagcactcctctcacttcctccccaaagggccccccttcttgggcacaaatgcgcactttgtagcgtgcccccttctctccatcgtctacgtcaatctcaccgcgaggctgggcacagaaagtattggcttctcacacctgtcagggccaattctgcgtctaacactgggtgaactccgaatgttttaacaccctgcacccaatattggtgtgtgcacctggaggatggaggtccggccagtgaggcagggcttccgtcaaggtgacctcatcaaccatgtcaatggggaaccatgtgcatggcactggtgcacacggaggtggtggagcatgatcctgaagagtggaaacaaggtggccatttcggacaactcccctggagacacatccattagatgggccactcggaagggcagctacaaggccaagatggcccgaaggagcaagaggaccccggcaaggatgggcaaaaaaaaataaaaa

SEQ ID NO: 581524 - DNA, 171 bp, Homo sapiens
cttcagatttccattacaacgaaagatgcgacggattttaaaccacacctaaaagaaaagaagtggtggcgaataaattgtagactctcccaactcatcatcgcacatatattatacaatgcaaattactaccactccttggagaatattcaatgaatcgcctttacccgt

SEQ ID NO: 581525 - DNA, 916 bp, Homo sapiens
tggagaaaaagtctcactgttttggcccaggctggggtgcaggggtgcaatctgtggctcactgcaacctcagcctcccgagtagccgggattacaggtgcatgccaacatgcccatctctactaaaaatacaaaattagccgggcgtggtggcatgcgcctataatctcagctactggggaggctgaggcaggagaatggcttgaacccaggaggcggaggttgcggtgagttgagatcgtgccattgcactccggcctgggcaacaacagcaaaactccgtctcaaaaaaaaaaaaaaaaaattgccccctcaaagtctctatcgtgggcccctgtggttgcaaagttgcctcctgaattaaaagggaaggggaaaaagatttagctggaaccgagtgggaaaaagatgctgagggcggggcgctggccagacagtgccccacaagggctacagggtgcctcaacgccctattggggcagaggcgtcgggggaggggggcagcggcgtttcgcccccttaaaaatatgggggccaaacggcactgatgttattcgacccgtgaccctgccctgcgtactaaagaaattatttcccggctggtaataataatcccgggtataacggaccatgtgggacttttcaaaggactcgcttggcccccaatgtccactggtaccctggggtgatggtccccctaaaatttctgggcataaattcgggggggacaaagcggcatccggtttaaccatatgccttggcaacgtaaactttctccgggaaaaaaaagggggcgcaaatcccgggccaatcgccctttgaaaggcacaggggatacagcgcgggacacggacgcagtcttcaccctcgggtgaccaacacaattctacctggcagattaacatacgatacaagc

SEQ ID NO: 581526 - DNA, 393 bp, Homo sapiens
taggcaagaagggtggccggtagggtatgtgtgctttcttggccttcctatttcctttcaaagaaatctctggtaaattacaaaacggtgaatggggtggccaaaaacggtggcccttcgttagatgcttcaaacagggtaaatcctataggggacccggtccacctcggccctagcatggaagatttacttcctcctcttcagagctgacattggtccggcgcactactcttatctttatcggcctaggtgtcagagggggcttagtaaaaaaggaacctggagaaacaaaacaaaacagaaaaccggggaagaggcgttcacaaagaacagacggtcagatttcggtcgggtatcaaacaactggaatacagctctagctgaggaccatcg

SEQ ID NO: 581527 - DNA, 104 bp, Homo sapiens
ctgtgtgatcagcagtgtgggaagaatttcacagagaaatgtctctgagggctggtaatggtctaagaagaattcatagaggaagcaggtagcctgggcaacat

SEQ ID NO: 581528 - DNA, 798 bp, Homo sapiens
  misc_feature (103)..(103): n is a, c, g, or t
  misc_feature (796)..(796): n is a, c, g, or t
gggccgagcacattctctgttagctgcaggcggatgcgtctcgattgtgtcaagaagataacatcgcccctctcggaaagaaacctggtcacttactcccctncactggctaccaaggtatttatggatggaccaagaaactgcccccaagccccgaaggtcctcccccaattctacacccccttctcccctaatacacgctttctttactcccccccccacagaccctccgaaacacctcacaaccctgcccaccgccccagtcgcacgcccccacacgcggcaagaaccgccaatacatcaccctccgtgcaatccttgaccacctgtcaagccccccctcaccttaaccgcccatcccccccaccctgccctctccccaccaccacacataaaccgaccttcactcccccattacccaaccgccccacgcgcgggcaccccaaccacacaccctatcccccgcccctgcccatctctaccacatctcccctccttcaccatatctcgcctccattcacccctcccctctcccgccccctctcccgcacccgctctactccaacgaccgccccgcctcggcaacgcacttcttactgattccctcactccgtgccgcccccctcttcatacacaccaccgacacacacttaccacactcacggcgctgtcgccccgccctctctagctactcactctccaaccccgctcagactgacaagcgatccctcgcccgccctcgccgcctcgctcccaccccaatccctccaccctcgcgagcaccccacctcgcaanat

SEQ ID NO: 581529 - DNA, 220 bp, Homo sapiens
gaggatctgaagcatcctaacagtaatatcaagctctgttggattgaggcagtcagggaggacttagggcaggaggactggtcagggaggagacttagggcaagaagactggtcagggacgagttatggcagaggactggtcagggaggagacttagcgcaggcggactggtcagggaagatacttagcgcacgaagactggtcagggaagacttcgcgc

SEQ ID NO: 581530 - DNA, 125 bp, Homo sapiens
cactatgcccagctctatggttttaattgtaattctctgataattattgatgttgaacattttgtcatatatttttgggcaattttttttcttcttttaaaaattttgtttttagccataaggcc

SEQ ID NO: 581531 - DNA, 156 bp, Homo sapiens
aaaaccactaaaataccctgcaaatcatcaccagaactaggaagacaccgcaacaaggctcaaagagacgggcccagggacacggtgcccagaaagtaggaggtgaaggagggagctgtttagcagtttggcaaggctcacacaaaccctcaaggg

SEQ ID NO: 581532 - DNA, 215 bp, Homo sapiens
  misc_feature (31)..(31): n is a, c, g, or t
  misc_feature (40)..(40): n is a, c, g, or t
  misc_feature (49)..(49): n is a, c, g, or t
  misc_feature (101)..(101): n is a, c, g, or t
  misc_feature (125)..(125): n is a, c, g, or t
  misc_feature (160)..(160): n is a, c, g, or t
atgggttgataggtgcagcaaaccccatggnatacatttncctatgtancaaacctgcacatcctgcacatgtgcccagagacttaaaataaaaattaaantttgctaaaaattattaccacaantaaacaataagtatttgagatgataaatatattantaggcttgatttggtattccataatgtttgcatatatcaaaacatcacattctac

SEQ ID NO: 581533 - DNA, 146 bp, Homo sapiens
agcgagcgctaggtattgggttatggcaggggttttatattgatattgttgtgatgaaattgagtggcccctaagatagaggagacacctccaggtgtaagcggtggtggttatgactttggttacaatggagacttctacagggc

SEQ ID NO: 581534 - DNA, 148 bp, Homo sapiens
gttggttttgcattaaatgacggcgctgcccacgggcagcacgaaccttctgcagagtcaggctccagagccttgcagctggcggagctggaggagggtgtgtcactgaagttggaggtggcagggcccaggggtctctggctgaggt

SEQ ID NO: 581535 - DNA, 639 bp, Homo sapiens
  misc_feature (271)..(271): n is a, c, g, or t
  misc_feature (278)..(278): n is a, c, g, or t
agcggattgagtccaggacaggcagaaggcgtcgagggggctgccctaaggctccacggcatgtgcctgtgattgctgggacgatcgagcggttcccaagatcgaagccgtgaaggactcaagactagacatcatccttctaggaggtcactgtagcagcgagcattgtcgaaataaacgtattcagaatgatgcatacaccgtagagagaaagagaatgatggagactgaagtaacaaggtgttctcgaaggggccttgcgtcgcgtaanttctcgnagatagctcagtgacctcgctaatctccgaggatggtcttgtatgtaagaggaagagtgtcatacagaagctgtgtctagtaccattcatccgcagccaactgggattcagaggtctgcgagagacaagctgagagagtgtttcacaaataatggtcatcttgataaagcaggagtctatttgaatggaaaccatgctccagacagaaagtatgtggatagtgaagatcaagtgacatatccatgaatttgatcatccagaaaataaatgcaatactccactcaattttggcagaacatgtacaacacagtgcaagtattctaatatcctaagaaaaagagagaaaacctcgtgcagggct

SEQ ID NO: 581536 - DNA, 847 bp, Homo sapiens
  misc_feature (847)..(847): n is a, c, g, or t
gtgtgtgtgtgtgtgtgagagtgtgtgtgtgcacgtttccctgcctgagcactgagcacacctccgcacaggcaactgtgccaccacctcatggtctcccagtagccactatgaggagggcagaggccaccgctttagcccagcaggacgagggcctcgtgacccgtggggggagcagagcagggtctgtgtgcctcgtgacccctgggggtgggcagagcagggtctgtgtgcctcgtgacccctgtgggggtgggcagagcagggtctgtgtgcttcgtgacccctggggggtgggcagagcagggtctgtgtgcagggttccttgccaggcacgtggcagcactgaggagctggcattgtgggtggctcggacgccctgaccccgtgttgatgtttttggtgcagccctgcccgctgtggccttagggtgacccatgtgaccacagcccatggtcgggcaacatgcacaagggaggccacttccaggcctaggggggttagacttgtggtttcttggcacctggaggagacttggcagcctgtcgggtgccaccattggtccgggggctgaggcctcccacagaagaccccgtgaaggccccggtccttggaccaaggggcctggcccgtggttgcaaccttgaagccacaggacaccagcaatgctggccctgaaaccgggggagttaacccgtggagcgattttaaagctgctacgttgcgcgtattggtacaggatattgatgtctgatcacgctggggtacgccctgactgtgcgtctcgtggcctaggtagcatagcttggacacaggccaagccaatttccattggcccgcttagccn

SEQ ID NO: 581537 - DNA, 691 bp, Homo sapiens
  misc_feature (64)..(64): n is a, c, g, or t
agcgactgagaagcccagtctgcgccctcaggatgactgagtgggaagcagccacaccagcggngcaagagacccctgacatcaagctctttgggaaatggagcactgatgacgtgcagatcaacgatatttctctgcaggattacattgctgtgaaggagaagtatgccaagtacctgccccacagtgccggacggtatgctgccaagcgcttccgcaaagcacaatgtcccatcgtggagcgccttactaactccatgatgatgcatggtcgtaacaacggcaagaagctcatgactgtgcgaattgtcaagcatgcctttgagatcatccacctgctcactggtgagaaccctctgcaggtcctggtgaatgctatcatcaacagtggcccccgagaagactcaacacgcattgggcgggccggtacagtgagacgacaggctgtggatgtgtccccactgcgtcgagtgaatcaggccatctggctgctgtgcacaggggctcgtgaggctgctttccggaacatcaagaccatcgccgagtgccttgcagatgagctcattaatgctgccaagggctcctccaattcctatgccatcaagaagaaagatgaactggagcgtgtggccaagtctaaccgctgatttcccagctgctgcctaataaactgtgtcctttggaacaacta

SEQ ID NO: 581538 - DNA, 128 bp, Homo sapiens
cttgagcacatgagtcacctgagcagcttggataaaccctctttgtacatataatatttgctgggtgtggtggtacatatttctagtcccaatctactagggcagctcagaggaggggcagctcccgc

SEQ ID NO: 581539 - DNA, 254 bp, Homo sapiens
ggtcgacgcaatcagtgttgcagtgttaagatgttgaagcctggcacaatggctcacacctgtaatcccagcatttttggaggctgaggcgggaggatcacttgagcccaggagttcaaactagacttgacaacatcgggagaccccatctctagaaacaattaagaaaagagaatagctaggtgtggtggcacatgcctaggaggctgaggtgggagggttgcttgagcccagaaggtcagggccacagtgag

SEQ ID NO: 581540 - DNA, 291 bp, Homo sapiens
atccgacgagtacaccgactacggcggactaatcttcaactccttacatacttctccccattattcctatgaaccaggcgacctgcgactccttaacgttcacgatctagtattactcccgattgaagcccccattcgtattataattacatcacaagtacgtctttgcatctctttagacttgtccccacagttatgccttacaaaacagtataccacttcccggtacgctctaaagccagatccacctttcaccggcttcactgaccggtgggttatactacgtgtcta

SEQ ID NO: 581541 - DNA, 347 bp, Homo sapiens
tatttaaaattttgcttttaggcgaggcatggtggctcaagcctataatcccagccctttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccagctacttgggaggctgaggcaggagaatcgaacccaggaggcaaaggctgcagtgagccgagatcatgcctttgcactccagtttgggcaacccagtgagaccctgtttcaaaaataaataaaatgaaaaaattgcttttaaatcatga

SEQ ID NO: 581542 - DNA, 587 bp, Homo sapiens
gaggctgaggtcaaataataatgctgagtaagccacaccaataaaaaatttgttttttaagacggagtcccactccgttacccaggctggaatgcagtggcgtaatctcagctcactcactgcaacctccacctcccaggttcaagcgactctcctgcctcagcttcctgagtagctgtgaccacaggcacacaacaccatgcatggctaattttggtatttttagtacagatggggtttcaacatgttggccaggctggtctcgaactcctgacctcaggtgaactgcccgccttggcctcccaaagtgctggaattacaggcgtgtgttaccatgctctgccaaaaaaaaaaattttttttttggagagggtgtctggtcctggtggcccaggctggattgcgagggctcaatctcagctcatggcaacctccgccgagaaagctctctaatggtcttggcccctagctacggatagggcacccacggggcaggaaacttacggcgtatggaagagaaattcccagcttcctatccgggctacaggcagggcccatgctatggcctggagccccttttgaccttc

SEQ ID NO: 581543 - DNA, 528 bp, Homo sapiens
  misc_feature (210)..(210): n is a, c, g, or t
tggacctaagtagacagcaaaaatggcgggggtcgcaggaatctgactcaactgcccacctggctggcagggactctttgtaatagcgtatcgttgtagcgttgagttcgtgggctcgtttcgcttggtgctacgtgacggaccgagggtccgagctgttcgtagagccgggtaattagaaggcctagagcggcctgaaaaatggttgtnttggtgatgacacctgggggtccttccatctctggggcccactctcttctgtcttcccatgggaagtgccactgggatcctctgcctgtcctctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttaagatcagcctgaccagcatgg

SEQ ID NO: 581544 - DNA, 468 bp, Homo sapiens
  misc_feature (97)..(97): n is a, c, g, or t
aaaatgaaggcactcattgcagcactgcttttgatcacattgcagtattcgtgtgccgtgagtcccactgactgcagtgctgttgagccggaggagnaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccagggaaatactgggaatgactgtgagccacctgattccagacgtccatcttgaaatagtgatcggacaatgtaaggtaatagctacaagacattcccatggaatctcaggacctcagagtgatttgactttaactgcaccacagttctgtctcttcaggcactggccaataccaaagatagtcccggtcctcatagattttcttttgagggttacttgagg

SEQ ID NO: 581545 - DNA, 854 bp, Homo sapiens
ggctatgccccgcccctccccagccccagacacggaccccgaggtcacacaagcctccctggctgctacccctcaccccacccttcaaaactaagctgctgcgaatcacctgcctgcctccacaccccactctcagtgccactggcaagcactccctactccctcaaccctgcacagactggcctgcccccactcccgcacaccccgtcccttctgcccagcccggacatccactccggccctccccaacgcaaggatgtcccccgtccaagaacaccaacgccgcggcccctccactcctccacaacccctgcctgcctacccccacccacgccaccaaccgggcctcctccacccaccgacccaccagctgcacgcacaccctcgtccccaggcccctccagccaaaacccacggagcctccactcgcatctctcccaaagtgcgtgcatcgactccacacacacgacccagctcggagccagttccaagggcaaggcatctccgagctccgctctcgacccgacgctcgcgcgcgatgcccaccgcatcctgctacaagcccaagccgccgcgcccaccgtgaatgcagcgaccccctcgcgcgcacagcaaaaccaccccaccacaaagcccagaacggtgccttcacactgctccgctcgcgcgcacaaccccaccaagaagtcgcatgcacgctgcacacctccgcgccgccgctctcgccactttcgaacgactctcccctgcccacactcgctcccacagacagtcggccacacgaaaccgcaacggcacacaggcacactatccaccgacctcacttggcaccggcgctccgcgcgctccgaccc

SEQ ID NO: 581546 - DNA, 877 bp, Homo sapiens
cgcggtggctcacgcctgtaatcccagcacttgggaggcggatggatcacgaggtcaggagatcgagaccatcctggctaacatggtgaaacgccgtctctactaaaaatacaaaaatttagccgggtgtggtggcgggtgcctgtagtcccagctactcaggaggctgaggcaggagatggtgtgaacccaggaggcagagctggcagtgagccgagattgcgccactgactctagcctgggcaacagagcaagactccgtctcaaaaataaataaataaaaataaataaattaaataaataaacaaaccagtaaaagatatatcccacacaggtgtagtctgaaccaaagctgtccctatctaagtgaatacaaaagagtactgaactgagaaagccttttgctggttttgggaaatgtctttaatgtggacagagaaactctaagactctctttcctatagcatatatcaatgagctatgtgccaaaaagtttgttaaatactaaaaggtagccaggaaaattacaatgcatttccctcaggaaagaattctaaagcgggcgcggtggtcacaactgtaatccagacttggagggctgaggggggcagaataaggagggtcaggagcatggaagagcattcctagcgaaaggtgaaaacccattttatttaaaattcaaaaaacaaagagaagaattttaaagagggtaggtctaggtggtacaaagttccacttgcgagggcaggaggccagaggaaggggtaaaggcacatagtacacgaaggttttttgaaaaatggagggagggggaagaaaccaaaagagaaatgtgggaacagaggcattaaaaaattgaagggagagggatgaagaa

SEQ ID NO: 581547 - DNA, 149 bp, Homo sapiens
atcattgatcaatgatatggtttggattactgccccgcccaaatctcttgtccaattataatccccagcattggaggaggggcccggtgggaggtgattggatcatgggcatggacttcccccttgctgttttcgtgataatgaattct

SEQ ID NO: 581548 - DNA, 220 bp, Homo sapiens
aggcgggctgtctagaggatcccaaaagtatccctatcaccagactgaaccctttatgatacaaagtaaagaacgggaagaatgggtggcaaggtggctccgtggaaaagctcacccagcacaggtgccctgagctcggagccttggtttctggtccctgggcgcgatttatatttaatcaaatttttatatagaatacacatgagaaatagaaaatata

SEQ ID NO: 581549 - DNA, 1443 bp, Homo sapiens
acccgatgagggaaccgagcgcagaacgcctgaacgcaggcatcgatacttgccttattctgacagccctagtatggctcccgtgtccccatactcatcggcgactaacttgtagcagtcacaacaccgcgtagtgctcagcgtaaaccagttctactaactcagctcgtcgactggccgcgaaggaacgtatcaacagcatcctggagactcaacacatcattaaagtatgactaagcttataacaacgaatcagcatatatatgagtaggtgagcatgcatcaccttgcattatacagtgcacgtcacacatgtaataagacattcccgtaaaaaggccacaatggtcccgaaggcccgcacaatgccgcttagcggtacgaatcagtgacgtattgtcacagtctagtaagcatctatgatacacctttaggtggcggggcataagtcgtgtcattaaagtaacggtcgcgtgcaatccagctttctactttcgtactagaacgcacactctttgaaacgaagagagcaactacttatgtcgcataatactccgccttatacgcttttgtttacctgtaagttcactccgtattgaaaagggccacatataagatagtattacacaacatacaggccatacacatgtacgtgcgcccgtatacgggattcgaaaaagggcatgggagacacgtatacgagacctacgtcgtgccatgtatgtgcagctataccttgcttacaaactgtacatgactcaacatataagtccgcattcggatacgattgcatcgaggcacatatatacctacaattacccaaacaacccacccgcgttgaagaggcctgtctacccagagacagccaaggttcactttcctgcagtgaacctccagacgcgcaacgtggaccgttttaacagttcgcgtcaatttagcgtaatctcctgctccttaggccacaaaatcttcgaagaacgttaccggaatccggccacattccacccagggtccggccagtgccaatagagtccccttcttacctctacatggcgagcttttcagaaggacagtccataacttgaccccaacgtcaatatgaggcccttctttctggactggaccttcctaaggcaaaggccttcggtgtaaagccttcgcccttttaccccgccccaaattaatttacaaacccgtaactggggggaagaaaacttcttcctaggtggacactaaattaaacacaaacggttgccttacccttggaatccaaacattactgtgagctcatttcctagctgtgacaagggggacttcaaacgagttaacgtacagatcctatcaagcgccttaaataagatgcgcccttcgttacacttaatgtcagccacatacatccaaaatgggggtgctgacatacaaccacgacgcaacatttaagga

SEQ ID NO: 581550 - DNA, 138 bp, Homo sapiens
aaagatgcactgaagtctctgcttagatagcttagtggtcaggtaatgattaaacaaatttctttaaatttctgttaaatttcttaaacattctgttcacactgcctggaagcagtgagtatcccagtttttgctttg

SEQ ID NO: 581551 - DNA, 125 bp, Homo sapiens
aggcatatatggcaggcaggggcatatcgctcacgcatgcaggcatggcatagtcaatagggccaaggcagccctcctcagtttgttcgggcaggcatcggcagcaattgtgtcaggcagcaatc

SEQ ID NO: 581552 - DNA, 261 bp, Homo sapiens
  misc_feature (100)..(100): n is a, c, g, or t
gtgtatctcagggaccctgctctctcctctacacatgcgcacgcaaacacacactcacacacacacacacaatgacacggggtggtctggtctaatatantgtgtctgaattcagagggcaaacattaacagccaagttttgttttttttgagagagagtctcactctgctgcccaggctggagtgccgtggcacaatcttggctcattgcaacctctgcctcctggattcaagcaattcatctgcctcagcctcctgagt

SEQ ID NO: 581553 - DNA, 377 bp, Homo sapiens
gagagaaaacgagcaaagggtaggaacagggtagaagagagcgaagacgaagatggacaagccgaagaggacgctgaagaaaacaagacgaaaaaagacacggacaaggaggagataggcggattaagggagtagggaaatagtggaagagagccataggaactgagagagtgaaggagacaagcgcagagcgaaacggagagggagagaaggaaaaggagaagagaacaagggaatggggccagaggagggggcaaggaagcgatggcagaagaaggatgatggaaatgagagatgaaaggaagacagatctattaggggtactcctcctagtgccaatggctagaaatctcaattcaatcctgcttctttaaaat

SEQ ID NO: 581554 - DNA, 91 bp, Homo sapiens
aatctgcttgcctttcctgaaagtttttggggcttaagattccagactttgattcattaaactatagtcacccgtgtcctgtgaaaaaaaa

SEQ ID NO: 581555 - DNA, 389 bp, Homo sapiens
acctcatggaggcacccacgttaatccacactcagtagtaaaatgccggaagtctctgtgaaagtctactgaaagtgcttaacccggaagcaacttgaacgtaggtgaagtgatctccgcctcacagagctgaggtttaacgggacattaggaggactatgagacaacagtcgtggttacataggaactcatttgtgcatttgaatatgaggatgagtgagagagaggatttccatgtgacttttgggatttaagtacctggtagggtcatttcactgagataaggaatatgagcaggttattagaaatggaagtaatcttaaaagattttctagatagtctgatattcctaaatcattaggtaatgaaaccgaggggctgtcaaggtt

SEQ ID NO: 581556 - DNA, 822 bp, Homo sapiens
ccaggaggagcgcgcgggcacagggtgccgctgaccgaggtcgtgcaaagactccagaattggaggcatgatgaagactctgctgctgttgtgtggggctgtctgctgtacctgggagtagtggtgcactgtcctgggggaccaggacggtctcagactaatgagctccaggaaagtgtccaatcagggaagtgaggtacgtggataaggaaatgcaacaatgctggcaaccggggtgaaacagatagaaggactctcagtggacaaatacacaaacggaagagcgcaagacactggtcagcaacctagaagaagccacgaagaagaaacgaggatgccctacatgagaccagggaatcagagacgaaagctgacggagctcccaggagtgtgcgacttgagaaccatgtagggccctcggggcaagtagttgtacagccctgcctgagacagatctgcgtgaggttgctgacgtcgacgcgtgcttgcaggaaagtggctcaggccttggttggccagtcagcttggaggagttcctgaacgagtagctcgcccttcttacttactggatgaatggtgaacgtcatccgagtccctgctggagaacgaccggctagcatgatcgcacatgctggatgtggtgcaggagcacttgcagccgcgcgtccaagcgtcatagacagagctcttccaggacaggttcttcaccggggagccccaggatacctaccaatactggccttcagacctgcccaccggagggctcgacttctcttttcccagtccgaatcggcggagtggatgcccttctctcgtaagagc

SEQ ID NO: 581557 - DNA, 142 bp, Homo sapiens
tgctacctaggaccgcccacagagagagtagagagagcgatgaacaggttagagtaggactagaattgtctgtcacacgcaatgttcgagagcaaggcgtcgagcctgaagaacacagtatgatattgtaatgcgatatgga

SEQ ID NO: 581558 - DNA, 397 bp, Homo sapiens
tatgcagatagtcatatttcatgtagtccaacagtcactctttacactttcatggattccaattaataaatggtatatatatttagctaacattatcaggagtgaaaagaaaaagaggaaggaagaaacccctctcaggcaatccatgtacagccacccgcaaccaacgcaaatgtaatacattcgttaagcacaagatgacaagcacagcagcatggccagaccaccacagcatgcacactgtgcaaagttccgttttcgttaagcaacatgcaaaggcacagccaggcactatctataattcacttcacttgcaagcaacatcattcagccacacaagttccattccaattcccagcacaaacactccatggcatgcagcactcacattccagca

SEQ ID NO: 581559 - DNA, 486 bp, Homo sapiens
  misc_feature (29)..(29): n is a, c, g, or t
  misc_feature (99)..(99): n is a, c, g, or t
  misc_feature (156)..(156): n is a, c, g, or t
  misc_feature (161)..(161): n is a, c, g, or t
  misc_feature (164)..(164): n is a, c, g, or t
  misc_feature (188)..(188): n is a, c, g, or t
  misc_feature (229)..(229): n is a, c, g, or t
  misc_feature (294)..(294): n is a, c, g, or t
  misc_feature (380)..(380): n is a, c, g, or t
  misc_feature (382)..(382): n is a, c, g, or t
  misc_feature (429)..(429): n is a, c, g, or t
  misc_feature (435)..(435): n is a, c, g, or t
  misc_feature (459)..(459): n is a, c, g, or t
tccccacccctcccagaaaaatgccatantttatggaggaaaaacacagtccaaggcagccgggggcctcagcccatcttcttccagatggtgagttanggggtgagcactcccgccacatagatggtcacggtctgccacgtgggcgtcccaaanttggngangaggccgtcccaaccaccctggtnttggatccagcccaacagccgctcccggaggaagttcaatntccagcccatgatggttcttatcagttccggcaccttggtgcacagggccttgagcaccagtttnctggcaaagtagaaaagggcgacaacccggccccagttgaagttgccgttagaaaacatgttagctgccacttggaaaaagacctntnggggggagttttttttcacggcggcaattatcctctgcagctccatnttactnttcatttcgtccccgatgcgcttnaaaaatttgctcagcttcttggtggac

SEQ ID NO: 581560 - DNA, 513 bp, Homo sapiens
  misc_feature (65)..(65): n is a, c, g, or t
  misc_feature (114)..(114): n is a, c, g, or t
  misc_feature (129)..(129): n is a, c, g, or t
  misc_feature (131)..(131): n is a, c, g, or t
  misc_feature (198)..(198): n is a, c, g, or t
  misc_feature (201)..(201): n is a, c, g, or t
  misc_feature (229)..(229): n is a, c, g, or t
  misc_feature (239)..(239): n is a, c, g, or t
  misc_feature (246)..(246): n is a, c, g, or t
  misc_feature (248)..(248): n is a, c, g, or t
  misc_feature (250)..(250): n is a, c, g, or t
  misc_feature (254)..(254): n is a, c, g, or t
  misc_feature (273)..(273): n is a, c, g, or t
  misc_feature (306)..(306): n is a, c, g, or t
  misc_feature (315)..(315): n is a, c, g, or t
  misc_feature (317)..(318): n is a, c, g, or t
  misc_feature (322)..(323): n is a, c, g, or t
  misc_feature (331)..(331): n is a, c, g, or t
  misc_feature (346)..(346): n is a, c, g, or t
  misc_feature (394)..(394): n is a, c, g, or t
  misc_feature (488)..(488): n is a, c, g, or t
gcgagaggagggcgaggcagtgccaggagagggcagctctgaactgctggctgggacagctcagnaggaacagatgaaaggaagtcttctgaggcagtgggctcgacgccagtngcctcctcgggtaanangggccacgcagtaaccaccgcgggaccagggctggtgagcagccaagtacgcaaagttccagcggcngcngatcaacacactgaaagctgtcttgcancgacccggangccttgntnantcanatagacatccgaattccangacattgaaccgcgtgagtatgaagcggagctnacaaaacantnnattnnataataanactttcataaaatanattcacgactaaaagaggataaatgcggagagtatagcaaaacccganacatgaatacagaacacgtagatacactcgaaagagcggcttcatacatgttgcatagaatatacaagctttaatgggagacgaaaaagttttnggagaagaagcatcgcgtaacctta

SEQ ID NO: 581561 - DNA, 95 bp, Homo sapiens
  misc_feature (20)..(20): n is a, c, g, or t
tgtttcagggattctttagncttagcaaggtcttcttttaacttgttgtattgctgcacatcaaagtgctgttgctttgatttcttgtggaagaa

SEQ ID NO: 581562 - DNA, 175 bp, Homo sapiens
tgcggtagtatcagtgcagaggtttggaatcagaacaacctaagttggaatcctgtctctagccaggcaagttgcataacctctcttggtgtttccgtctctgtagaatggggcttatagttgctatacctaacctacacgttatgtcactttatgcagggccaagtgtgataca

SEQ ID NO: 581563 - DNA, 192 bp, Homo sapiens
ccggggggggggggggggggaccccaaggggttttttttttttggggccaagggcccggcgggcccccccggggggggggggggggccccccccttttccccccgtttttggggtttttccgccccggcccccggttttgggcccttcccccgggttccttggcggggggccataaggggttttgtttccca

SEQ ID NO: 581564 - DNA, 164 bp, Homo sapiens
tggagcgatgaattgacggaaggtgaggaccctacgtgttatgcttatctagtttacaaaaaatagtagcatagttaaactagataccagaactagaagttctcttaactcaaataccataatttttccaagtcagaagcagaaacgagaagggtgtagtcttt

SEQ ID NO: 581565 - DNA, 392 bp, Homo sapiens
  misc_feature (4)..(4): n is a, c, g, or t
  misc_feature (12)..(12): n is a, c, g, or t
  misc_feature (165)..(165): n is a, c, g, or t
  misc_feature (303)..(303): n is a, c, g, or t
cccnaccctagngggtccaaggctgatataattaaaagtcctgatgttttgtcctcaaaaagacccaatatgaccctagttggagtaccgtatatataaatgtgtatgtgtatgtagcattcctatattcacaagcctttaagtgatttttcctaggaattaatnagaagtaaaggcccaggcacagtggctgcacttgtaatcttagtgctttgggaggctgaggcaggaggattgcttggggtcaggagtttaagaccagcctgggtagcatagctagactctatcgctacaaaaaaatgnaaatatttagctggccgtggtgccacatgcctttagtcccagttacgtcactccatacactccagcctgggtgacagagtaagaccctg

SEQ ID NO: 581566 - DNA, 826 bp, Homo sapiens
ctctgtacccactcccacctaagattcctacccctgtgtgctagctggtgactcttgatctggccaggccagcaacaaatacttgagactaggcagcgatggggtggtgcgcaggcctgcctagaggccctgggctccagggaactgagactagggctgtatcattcatgagtgcctgattcacagctcccgctagtgctatgacctggcctccatcggcctcggcgcttgccttatgagcaccgttaacccacgccaaggggctaggcagggtttcgcggggcctggcccaaggtctccagcagagcagtaacatcttcccaggttgggttgccacagacacccatgctcctggaggcccccagcccagtgcccatcttggttgtctacccctgtctgccttggcaggcctagactcagcgcctccttgtccggtcagcctgggggtccctcgggcacggatgccaccacatgggggccggtttagtgcagcctggtcgagaacgctgactgggggccggggatgctcacgcgggccctgcaggtgtcttcgccacaagaggcgtgcttttccgtgccctggctccacccttgtcgggctttggctcattttccttgccgcgtgtcacgaccatccacgggcagtgacctccgtgccttgcccctcctcagagccggtggcctgtggtgtgggacccctagcctgggccgtgacccgtgcccattgcctcattctccaaggctcatcagcgggtttcagcaggaacttttcctcacgggttgtggcctggacgtgcgagggcctgtctggcggctgtggttcccc

SEQ ID NO: 581567 - DNA, 605 bp, Homo sapiens
  misc_feature (355)..(355): n is a, c, g, or t
  misc_feature (600)..(600): n is a, c, g, or t
gtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttagttttgcattatgtgtatggccctgaagtagttggactntgcaaaagggcgaagaaaggatatttgcgacatacagtgtaaaagtgtcacgagcacattgtggtattatttcttatcaatgaaagtcatcgttatttcttcgtgattggttctagaacatgttcataacatactcttatttgtcgaaatgcacaaagaatgatcttaaaccattcaaaatataatcgtttccctcttgcggttcgagccacatttcaatataaaatagaagctaaaattaaaanaaaaa

SEQ ID NO: 581568 - DNA, 254 bp, Homo sapiens
  misc_feature (57)..(57): n is a, c, g, or t
  misc_feature (123)..(123): n is a, c, g, or t
gaagaccgtcacgtctgcgtccaacaatgagacctactgccggtccttctaccccgngcacagcatcaaggagtggctgatcggcatggagctggtctccgttgtcttgggctttccgggggntttcccttctccattatcgcctgtcttctacttccctgctggccaaggccatcttgggggtccaggtgcccggggaggccaaggagcgggaaggtcattttttctcgggggggggttccctgtttctgggc

SEQ ID NO: 581569 - DNA, 160 bp, Homo sapiens
tatacaaagatcatagtcccccctaatcagcttatgagtagaagccagaatacactgtagccatttaaattgtcagacattatagctcttataaggtatgcaccgaagttcaagccataaatacatacattaggttcaaagccttacaagtatgctacgc

SEQ ID NO: 581570 - DNA, 309 bp, Homo sapiens
actagtccacggtggctggggttagaggtctgagccaccgcacccagccaacttggtcattttagagatagcagcatatgccttatcgtggtcctgaggcatggtggctggaggtcaagtctatgcagttagctacgatgggccacggaaagattctaaacttcttgtagccaaccgtggactagtactagtccacggttggctagtctcaaactcctgacctcgggtgatccacccacctcagcctcctaaagtgctgggattacagatgtgagccactgcacccagccaaccgtggactagtgggta

SEQ ID NO: 581571 - DNA, 112 bp, Homo sapiens
aaagccttcatttttgacctccccttacttgaataaattgaaatatgaagtttgcattttctgaacctggccttagtgattgagtatctatgtaataattataatataatcg

SEQ ID NO: 581572 - DNA, 1667 bp, Homo sapiens
cacctgtcagagtgacgtgatatggggtaaggaggtgcttttttaaaatcgttcatagacttctgtaaaatgcaagattaaattgaaacgttattgataacagtcgattctttcgaagaaaaaaaaaaaaaaaaagaaaaaacaaaaaattttgtgtgggcgccgtttgggcgccctctggaaaagaggtttttttaaaaccatttcgtgttggggggcgggggcccccaaggtgggtaaagtggaaagtggggcaaacagcagggtgtctccctaagaggaggaagcactgggggaacatagagacaaaagagcggggcgggtctctcaccgcaccaaatataaaaaaaaccgccggggggagcacccccgacgccgcggttgctggacaccaatacctccagaaaagcggaggcacacagagaggagcaaataacagggggagtcaactccaacaagggcgagccctaacagagaaaggctcgagcagtaaaacaaaaaattaagagcgccccggagcaggaggggaggagaaaaacaagaacagacagcaagacaaaaaagaaaaacgaacaatgaagagagaacacgaaaggagagagaagaaacgagagacgaaccaagcgaagagagaagacagaaacataaggacagaagagaacaaaaacgaagacaaacagaacaagccagcagacagcgagacacaacaagcgagaaaaccaaaaatagaacaaaaggaacgacaaggaaacaaaaacagaggagagaagggaagggagaagacaaaaacagaaaagaaaaaaaggagaaaaagaaatggaagaagagacaaagaagaaacaaagaaagaaggagagagaagaaaagagcaaaagagagaagaaaggaaaaagaacgacgaggaggcagaagcaaaagagaagagaagaagggcaaaagagagagacagagagaaaaagggacgaaagacggaagacacagagagaaagaaaacagaagaaagaagagaaagaaggaagggaaaaaggggaagaacagaaaggagaaaagaaggggaggaagagagaagaggaaagaagaggaaagggaagagggaaggagaaggagaaggaagaaaggggaagccgggcggacagaagggaaagggaggtaagggcggaaggaaagcaagcgaagccaagagacgggaggaggacgggaacagaggaggcacgcgagcgagagcgaggaagcagatgcagggacggggggagcgagagaagaagaggagcaggagaggaagagcccggaggacagacgagaagaaagacaaagaacacgcgacagaaagagcgaagaaaggaaagctggggaggaacaggaggaggatagcagcgagggccagcgagaggcaggaggagaggagggcaggcaagagaaagacgaagagaacgagacaggaacagagagaaggcagacgcagggacaaaggacgagacgaagcgggcagagcagagaacacaagaaacgaccggcgccgacagaagcagcgcgggggcaacacggagcggacaacacagcaccaaaccacaacagtccacacccgcagcacccaagaacgagagcgcgctgcggcgcctgagccagagacgggagcgcccacagacggcgcacacgcagacgaaaca

SEQ ID NO: 581573 - DNA, 395 bp, Homo sapiens
catctttcctgttgctccgcagctcagcaccttgcttgcatctttcataatattggccacaatttctcattggtcaacccgtctgtttgattttttttttctgtctgtctctctcactagacaaagtacaaaggggcagggatcgtgtctgtcttatttatcgtggtatcccctcagctctgagccagctaccacagtaccttgtaaatgcctagtcaatatcagtggaataaatgattaggtgttaacctcaattgtccagcactggggttcaattcatgtccaatatttcagacttagcatagtgaaacttccaacaagcctgtttttagttcctgttggttggaagtataagctgagggtgatcctctagaacactatgacgtaactcggat

SEQ ID NO: 581574 - DNA, 527 bp, Homo sapiens
tttatttgtttttccccaagttttttttccccccggggggggggggttttgtttcccggggggtgtaaattggggggggttttggggccccccttttcccggttttttgggaaaattttccccttccccggggggggtttggggccccccccgttttttaacgggttttaatggggcccccgggtcccccctttttgtgggggccccccccgttccccttgggggtttccccccggagtcccggcctttttcccgggggggttttttggggggtaaattgccccggttttgggggggtttcccccttttttttccccctggggggttttttttttttaacctcccccccccgggggggcccgggcttggtcccccggttggtttttggattccccccggggggggttttcttttttacctttttttcccgggccccccccggggggcccccccttttttttccccttttgtttttttttttgcccttgggtttgtttttttttgaaaaacccccctttcccggggga

SEQ ID NO: 581575 - DNA, 338 bp, Homo sapiens
  misc_feature (1)..(1): n is a, c, g, or t
ntctgactctgcttccgagtagctggattgcagacacgtgcagcacacccggctataggcgtgtatatagcagagatggggtttcaccatgttgtccaggctggtctcacactcctgacctcaagtgatctgcccagctcggtctcctaaagtgctgggattacaggtgtaagccaccatgcccagacgctacttgtgttttttccctcaagacatcacagttatcttccccaaacaaaacaagtatgattgtatttgccagaaaatatactgagtaagcagaacaagatccattactaaatcaagcctcagcccatacctgggcagccccctcagga

SEQ ID NO: 581576 - DNA, 117 bp, Homo sapiens
atgatagtgcagcgagctgcagcagccgtttcgtgggccccgcagcctccagggcctacggccgccgcacaggatagctggatggctcagtcatgaggcttttagacttgtttcaag

SEQ ID NO: 581577 - DNA, 874 bp, Homo sapiens
  misc_feature (11)..(11): n is a, c, g, or t
  misc_feature (88)..(88): n is a, c, g, or t
  misc_feature (108)..(108): n is a, c, g, or t
  misc_feature (137)..(137): n is a, c, g, or t
  misc_feature (164)..(164): n is a, c, g, or t
  misc_feature (169)..(169): n is a, c, g, or t
  misc_feature (173)..(173): n is a, c, g, or t
  misc_feature (187)..(187): n is a, c, g, or t
  misc_feature (226)..(226): n is a, c, g, or t
  misc_feature (228)..(228): n is a, c, g, or t
  misc_feature (263)..(264): n is a, c, g, or t
  misc_feature (288)..(288): n is a, c, g, or t
  misc_feature (295)..(295): n is a, c, g, or t
  misc_feature (299)..(299): n is a, c, g, or t
  misc_feature (301)..(301): n is a, c, g, or t
  misc_feature (309)..(309): n is a, c, g, or t
  misc_feature (319)..(319): n is a, c, g, or t
  misc_feature (412)..(412): n is a, c, g, or t
  misc_feature (414)..(414): n is a, c, g, or t
  misc_feature (454)..(454): n is a, c, g, or t
  misc_feature (476)..(476): n is a, c, g, or t
  misc_feature (507)..(507): n is a, c, g, or t
  misc_feature (550)..(550): n is a, c, g, or t
  misc_feature (626)..(626): n is a, c, g, or t
  misc_feature (648)..(648): n is a, c, g, or t
  misc_feature (674)..(674): n is a, c, g, or t
  misc_feature (683)..(683): n is a, c, g, or t
  misc_feature (727)..(727): n is a, c, g, or t
  misc_feature (736)..(736): n is a, c, g, or t
  misc_feature (747)..(747): n is a, c, g, or t
  misc_feature (758)..(758): n is a, c, g, or t
  misc_feature (768)..(768): n is a, c, g, or t
  misc_feature (773)..(773): n is a, c, g, or t
  misc_feature (782)..(782): n is a, c, g, or t
  misc_feature (788)..(788): n is a, c, g, or t
  misc_feature (796)..(796): n is a, c, g, or t
  misc_feature (863)..(863): n is a, c, g, or t
gggtcctgcgnagggggcgggccccacccacagggtctccctggactgggggggggtgggggtcaggcagtgggcaggggcctgagcnaggctcccaatctgcctggngcccaaagcctgggcacagtggctcagcnactcagcgttgagcgtctgtgccgggnaaatnagcntctgcaggaggaanaaggggagaaaaaagagcccggaccacgtggtgaagaangnatgggccccggaaaaaaaaaaaaaaaaagagaaanngggggggggggggggggtgggggnggggggngggngntgggaggngagggcaggngcttggcccccagcctggcccagcaccatcccgcgccctcacctgaagcggccaccagggggcccgcggccctggccagagcacctaggctgngnagtgtaaccatgaccgtgcccttctgaactggtgagaaanagaaaaaaaaaaaggaggaaangaagggaaaaaaaaggagagaggaaaaggantagagaagaagaaaaaggaaaagaaaagggaagagaacgaaancagaagatgaggaggaaggcgggcacagcagcaggagggcccgcttcacggcagccacttccccgccaggttgganccgccgggcataggcaccctgnatggtggccatggtgaggccgatgangaaaacatnttccctgctgtaggctactgaactggaagcgctagtgtgtgaanaaaaaaaangtgtccccccngcccgagaacnggaagaggtngaggnagttgactnggcccnggcggcgncggctgctgagcctgtctccagagggtgggtcctggccacgagcgacaccgagaagcgccaggggcnagggggctgag

SEQ ID NO: 581578 - DNA, 474 bp, Homo sapiens
  misc_feature (4)..(4): n is a, c, g, or t
  misc_feature (39)..(39): n is a, c, g, or t
  misc_feature (57)..(57): n is a, c, g, or t
  misc_feature (117)..(117): n is a, c, g, or t
  misc_feature (123)..(123): n is a, c, g, or t
  misc_feature (136)..(136): n is a, c, g, or t
  misc_feature (142)..(142): n is a, c, g, or t
  misc_feature (162)..(162): n is a, c, g, or t
  misc_feature (185)..(185): n is a, c, g, or t
caanaaaaaggtggtggttctggcatccactgagttttnccaagggacttatagtcngattattttgaataggaagcccgtttagcagcataacctttcatgtccagattttgaaanctgtgnagctagcctgagntcctgnataaccagactggggaactnggtagttagtctggaatgtgggncgtccagtatgctctggaggtccttggactgctgctggaggataactgaggggcatacccagctggcaaagtatgttcctgagcggaggagcctccatttgcaagcctttctcatgcagctccaagtgaggcgaattcctagaatcctagcaccagcagcgactcagctctccagactcctctcagaaaggcataggtgctgcactactccactagactaaagtcagggagaaaaagcacctggactttgaggcagtttaggttttgtttcctgagtctttagatttcc

SEQ ID NO: 581579 - DNA, 803 bp, Homo sapiens
agggtacataagggccgagatatatcgaaggattttgctcagcggtactttgctagagttagtcttgggtattccccggccccccccttccccccggagggacagggtcgtgcccactcgaatcgtccaagttaatatgagccattgtatgggtttgaaacacagggtggatgaagccttcagagactttatatttggaaaagggatagtccgtatgtttataattttattaccgggactgatatttataaaattttgataaactgtaccatagctgctgcataggtttcaagtacatgttggaccagtaaggattgggggagttgttttttaatggtcaccttaaagccagctgctataagaaatagttggaactcaaattttgcatctggtcataaccctcataagccatttatccatattgccagataatattttcccatccattatttaaaaaccagggacttttaggcttctgaagatcatagtggacccgagccaaattaaagttccagtttgtgtgcaccaatatcattgcccagacattcattggaatagctttgtttgatagatagtatagttcatatctccagctttatatttccagatagcttaactggggccaatagaagtctaacattccagggtgaactttttcatgtttaatctcaggctaaaagtaaatgatatttgtaaagtttggattaaattctgtttactcattttgagttagtatgaaaaaaagtgattgtatgtttaagaattgaaattgttcattttgtgataaatgattaattcccaga

SEQ ID NO: 581580 - DNA, 330 bp, Homo sapiens
  misc_feature (26)..(26): n is a, c, g, or t
  misc_feature (43)..(43): n is a, c, g, or t
  misc_feature (124)..(124): n is a, c, g, or t
  misc_feature (130)..(130): n is a, c, g, or t
  misc_feature (140)..(140): n is a, c, g, or t
  misc_feature (221)..(221): n is a, c, g, or t
  misc_feature (269)..(269): n is a, c, g, or t
cgtgatgattatagacacaattatcntactctcttccatcaanttttataaaagccccgtacctttcccactgaaatttcaaatttgccgctcaaaaccatcattttcttcttttttgtgaaanttttantggagcgaantcttattctcacttttttgtgctaaccactttgatttttcccccatttttattgagtccatttccgtggcgaatccaaagngctttctagtacacattctcaatgttttctacaaggctatttctcagnattttattataattaccatctttttcaaaattttaactttgatgaaaataaagtgttaatc

SEQ ID NO: 581581 - DNA, 653 bp, Homo sapiens
ggcactcactagtcaacacaagatctgcgtatcactcaggaatacagtcccgtggcagtccttcacagttcctagttcttatcattatcaatctgagcggcactgaataggccaaaaggtcatcgaggtttagttttggcagacatggcagctatggtagtgcacgatcatgcattatggtgaatccgggtttagaccctctcagcacgtggaagtgtgagtcactacacttccaatcctgtcgttttgccacaggcaacagatactgattatctgttaacatgctaacgtgcgtttggtaacagatcatccaatggtcattatgcaacgtatattaataaggcacccaggtttatgtggccacttctagtgatatatcgaaacaactgggatttagtgcagtcacagagatactattactatgagtcatagaagattagtgcgccaaaggatattcaatccatagaattagcaagcaatcgacagcaagttcgacgtattcaactccaagaaacttgcatacatactttgcagggcaacgttatctttgtccctgtcacatcctgtccgtaaacattatgctatacgtattctcacttagtcctggtaggtagcgtctatccttagtcgtgtaactgatctttaatacgcta

SEQ ID NO: 581582 - DNA, 933 bp, Homo sapiens
gtgggaggtgtctggtaaggtcatggtgggaagggagatgagagaggagatatggcagatgtgaggatatggggccctagatgtgaggaaggaagactagatgaatgttcttgaatagctgtgggatgttgtgtgcaaaaggtggattgatcaggatctcagggttatgtctaggaagggaataagatgaaactagaatgtcaggcaaaagcgtgtctgtgcaaactgtaggactccttcctaacttcctgtgaatcaaatggctgagctattcagtccagtcacgcaggctggcagcggagtggttgagtgtgctcgcgagggccagtgccacattggctgcgataggaatttcagggtagcattagccatcgtggagcgatgctacttatccagggactccctcctggtccttcctgtgtcactttcacatagtgtgcacatgttaccccatggcatgtcccaacagggccaggcccagtcacagctgggcttccacaggtcagaatatgggacaggacatggtcagggagaggaccctgtgagttggtgacatatatgtggcagagatggtagtgttcagctgcttcagcagtgtccccaacatcccaatagggtgggggcctgtgggccagaggactccatgacagtagccattggagtcccacctgtgccaggtcagagccaccggcaggttcagaagtggtcagcccagttaaagggtgggagtctggagccagacagccaagccccttccaatctaccggtcactggtcatcctcacaacaggcaggggtgaatctcaactcttgctgttatgtggggtgtgccgaatcacccctttagcaatcattcattaggccaatttattggcctcgggaatgtcaaggaaccccttggacacaaaaaggggactacgggaaatctcccccg

SEQ ID NO: 581583 - DNA, 153 bp, Homo sapiens
aacgaatggtcctcagctgacttaaacaagattatcctggagtatctaggagagcccatgtaattacaagcattctttaaaactggaagagggaagtagaaggttaagaaccagagacggtgggcacaatggctcatgcctgtaatcccagca

SEQ ID NO: 581584 - DNA, 1011 bp, Homo sapiens
  misc_feature (1)..(1): n is a, c, g, or t
  misc_feature (77)..(77): n is a, c, g, or t
  misc_feature (81)..(81): n is a, c, g, or t
  misc_feature (83)..(83): n is a, c, g, or t
  misc_feature (97)..(97): n is a, c, g, or t
  misc_feature (99)..(99): n is a, c, g, or t
  misc_feature (111)..(111): n is a, c, g, or t
  misc_feature (132)..(132): n is a, c, g, or t
  misc_feature (143)..(143): n is a, c, g, or t
  misc_feature (154)..(154): n is a, c, g, or t
  misc_feature (196)..(196): n is a, c, g, or t
  misc_feature (204)..(204): n is a, c, g, or t
  misc_feature (214)..(214): n is a, c, g, or t
  misc_feature (240)..(240): n is a, c, g, or t
  misc_feature (321)..(321): n is a, c, g, or t
  misc_feature (328)..(328): n is a, c, g, or t
  misc_feature (365)..(365): n is a, c, g, or t
  misc_feature (472)..(472): n is a, c, g, or t
  misc_feature (489)..(489): n is a, c, g, or t
  misc_feature (531)..(531): n is a, c, g, or t
  misc_feature (571)..(571): n is a, c, g, or t
  misc_feature (625)..(625): n is a, c, g, or t
  misc_feature (643)..(643): n is a, c, g, or t
  misc_feature (790)..(790): n is a, c, g, or t
  misc_feature (864)..(864): n is a, c, g, or t
  misc_feature (881)..(881): n is a, c, g, or t
  misc_feature (903)..(903): n is a, c, g, or t
  misc_feature (931)..(931): n is a, c, g, or t
  misc_feature (964)..(964): n is a, c, g, or t
naagagcaactgaaaagcagcctgcggtatatggcatcatcacaccaccggtgggtattttaatcctccccctgccncccncntccccccccccccncnccccggcccgcntccccccccgcccccctgccncgccggccgcntcccgcccccncccccccccccccgcccgcccccccccccccgtccccccccncccccccncccccccccncccccgccccccccccccccccgccnccccccccccgcgccgtccccctccccgcccgccccccgcccccacccccgcgccccccccccctccccctccgcgccctncgcctcncccgcccgccccccctccccgcccccccccccccccncccccccccccccccccgccccccccccgccgccccgccccccgccgcccccccccccgcccccccccccccccccgccccccccccccccccccctcccccccccnccccccccccccccccngcccccccccccggcggccccccctctccccccccccggccnccccccccccacccccccacacccgcgcccccccacgccngcgcccccgcccccggccgccccccctattttgaacaaggaagtggcataagcnactcagtgtgtgcccctnagggtgggagctcttccccctaccactccccaccccaaggcatcattttggagagaaaagtgtcttctatctggctagctgtgttatctaggattgcaccttcttacacggcaggcgcggcatcacgtccagatgggcatctaaggnactgcatttcgggagatgaaactttcatttgggactcaactgtatgcatgaactaacacagggccatggacccnccagtcttgattgagtnacagaaaatgaaggtgactctntacacttccaagttgctttctagatctnttcattacaaaatattctgatcaaataatcttncaaggtaagataaactagcctcaggctatctcttaaagcacagagaa

SEQ ID NO: 581585 - DNA, 570 bp, Homo sapiens
ttaatgatgttaaacatttttatcttattttttctacctttgcaagggcaaaaaacatgttttaatgggtaatgttaaatcattcacctttattctaacctggtcaaaaaaaaaactttttactttttttctaaggaggaagggcctactggtcctgaaagataccatgccgccttgcctgggttatttgggtaaaagatacaatattgctgacaaccaattgtttcaggtctacgaaacaggtgggagctacttactacatatttttcggacgaccctttcctggtttggagaaaatctcaactcaagccagggaaagaagggaatccaattttttctctccctttctccttttcttctctctcctttttcgcaaatactttccccctttccttttaagggggtcccggggggggggtttttttggtttttctcttttccctttaatattcccctcttccccacttttttttcttttttacccttttctttggcccctaatttcttggacttttttacaggacccagaagaacagttttctattggccttggggctcccaaagaacctg

SEQ ID NO: 581586 - DNA, 697 bp, Homo sapiens
ctggtgggcgagccctggaccctgagcaagacctgcagtgaagcggatatcctcaccgtacaattactgtcacgaagtttgagatgcatcgaatgatgagaccgagactggaggcccgtgttgccgctagagatcgccgtccacagtcaaccttgtgtcacgtgagagccctgacagccctcaaacaagccctgtcgtgcagggttcacctacctgaccatgtacgggcgaggaggtggagctgtgcgagccggggccggctactatccttgtggcgtgggagaacaaggacatctacgcggcagccatccggagcctgcggctgcgtggagctgcagaatgtgctggagtgccgtgacggaccggtgctgggccgtgcacatggagcgtcgctatacatcgcccgcatgacaagattgctggacacagtgctcaagcaccactcggaatatggagctgcggaccatgtggtcatccccatacatcaacctcgagttccttcaaggtccgctacaagcacatgtaccaaggtggcggcttgcatggagacggaccagcaacatcgagtccttctggggggccctggtagatgttcacaccaggaggagctgtgcaagagtcatcaagtttgcctgcaaccaggagcgcatcccgttcatctgcccgtggaaatattgaggtccgaaaatgccgatgt

SEQ ID NO: 581587 - DNA, 113 bp, Homo sapiens
  misc_feature (86)..(86): n is a, c, g, or t
  misc_feature (110)..(110): n is a, c, g, or t
attcgaatcatccgtccttgacttggaacttggacgtgatatacggaaagagtgtctagttatagacataagaataaccttagagntataaggagactctaattaaaccnggt

SEQ ID NO: 581588 - DNA, 426 bp, Homo sapiens
ccaaatcttagagcacaagtagtcagttaaatactggggcaaactaaatcccaatcacactgccatctttatcaaaaccaaccctgaaacatgcacttaagtggaacagaagcccaggaactgctacccagcttttcccaataaaagaggggaaataacacctgggcctaaagaccaaacatattgtcaaaacacaggagaaatgccaaattcttatatctgacttacgtaggtaagccaggtagaacaagagaaaatggatttaaactagaaaattacactacttggagtctgactataagaatctgctagactacaaaatgagttgggttgaaagagataagggaattttccccccagagtctttaaaaggcagagaatgaaataatgaccttttcagctacctttctgacctcttattcctga

SEQ ID NO: 581589 - DNA, 770 bp, Homo sapiens
gaggaacgagatggcggttctctggatgctgagtgccgtatgcggtgccctaggaggtccgagctctgttgcttcgaactccagatgtttcagacctgctcatatctcagctgtttcttcatagtacctgacctatcccatgtaggtggtgtggagttgctatgctaggcagtgcacttgtcaccagagccacccattctggcttccaataggctgctctctctccatcgtggactatgcgagcgggtttgtcagtgttttgctccgtgggtctgcttccggctgcttatttgactccttgctctgcgatggaagtattccctggcttgcagccctcactcttcatggtcgctggaggccttgagatcggatgcttgttacgtgactatgttcttggggagtgccttgtagacagttgccaagagcagggtcttgtggcagctttcatgctttaacctttgctgcggctttgctatttcaacctatctcgactgtgggctatctgcgaaatctgattgccatgctgtgcgaagctctgtacgctttgttgacttcatactttgaatgaattgatgtatgcctctttgcctctgcttatgtcatgccattagagctcacgaatagaggaagcaacataccagataacgtccattggtgcgacgagagcttctttctcttcaatcagcaaggattatatccagaagtttaatctttgcaggaaacaggtttgagaggaattatatcttaagttgatgaacactgagtcctat

SEQ ID NO: 581590 - DNA, 771 bp, Homo sapiens
gacagcggacaccaggactccaaaatggcgtcagttggtgagtgtccggcccagtaccagtgaaggacaagaaacttctggaggtcaaactgggggagctgccaaggtggatcttgatgcgggacttcagctctagtggcatttccggagcgttcaaagaggttactaccgtactacaacaagtacatcaatgtgaagaaggggagcatctcgggattaccatgtgctggcatgctacgtgctcttaagctactccttttcctacaagcatctcaagcacgagcggtccgaaaataccactgaagaggacacactctgaacccccaaccaaggacttggccgagccctctcggtgaggaaacacaatctcaatcggttgtgaatcctttcatatcctaataggaataaactccaaataaaatatgactggtacgtgttacaaaaaaaaaaataatacaaaaaaaaaaaagttttggggggcttcgctgagagaaggttttctaaacaccatcgggtggggggcgccagccccaagaagatatcgacacagtggcgcaaccgggttcccaagcgcaaccctgcgaccatagacaaaagggggtggctccaccaaaaaaaaaaccggggcggagcacgcgagcggtctgtgaacacgcaagatggggtcgggcgcccaagcggattcaacacagagccagagaccaaatcacgcaccccggggtgggtagaaatcgacgacaacaagaaagcaacaagaaagagaaacaagat

SEQ ID NO: 581591 - DNA, 353 bp, Homo sapiens
actcttatccgaaaggcacatgaggagagggcctgcccgcctgacactgggcctgaggacagtgcgaccgatgatgctagcaggacgcactttaatgcttatagctctccctgctcgcagtgagcgaggtggtggtgtacttgatggtggaactgccgcctccaacagagctgaggccacccccaatggctctgccactgctggaactgaacgccacctccaacgccaagaccactgccattggagtagctgcttcctccacccaggcctaagccactgccgacaccactggcaccgccatagccactggagacggtggactgcaccacagagatgttgcctttcggagaaga

SEQ ID NO: 581592 - DNA, 102 bp, Homo sapiens
cttcggatggagcatcggtattactattcgtctgagagaatgtgataatgcctgtgttctttttgccgtctctgttcttatgtttataatcagttcaatgct

SEQ ID NO: 581593 - DNA, 800 bp, Homo sapiens
  misc_feature (20)..(20): n is a, c, g, or t
  misc_feature (83)..(83): n is a, c, g, or t
  misc_feature (85)..(85): n is a, c, g, or t
  misc_feature (103)..(103): n is a, c, g, or t
  misc_feature (106)..(106): n is a, c, g, or t
  misc_feature (108)..(108): n is a, c, g, or t
  misc_feature (118)..(118): n is a, c, g, or t
  misc_feature (126)..(126): n is a, c, g, or t
  misc_feature (209)..(209): n is a, c, g, or t
  misc_feature (223)..(223): n is a, c, g, or t
  misc_feature (233)..(233): n is a, c, g, or t
  misc_feature (275)..(275): n is a, c, g, or t
  misc_feature (288)..(288): n is a, c, g, or t
  misc_feature (298)..(298): n is a, c, g, or t
  misc_feature (310)..(310): n is a, c, g, or t
  misc_feature (327)..(327): n is a, c, g, or t
  misc_feature (371)..(374): n is a, c, g, or t
  misc_feature (378)..(378): n is a, c, g, or t
  misc_feature (390)..(390): n is a, c, g, or t
  misc_feature (401)..(401): n is a, c, g, or t
  misc_feature (418)..(418): n is a, c, g, or t
  misc_feature (429)..(429): n is a, c, g, or t
  misc_feature (432)..(432): n is a, c, g, or t
  misc_feature (434)..(434): n is a, c, g, or t
  misc_feature (451)..(451): n is a, c, g, or t
  misc_feature (609)..(609): n is a, c, g, or t
  misc_feature (614)..(614): n is a, c, g, or t
  misc_feature (635)..(635): n is a, c, g, or t
  misc_feature (645)..(645): n is a, c, g, or t
  misc_feature (650)..(650): n is a, c, g, or t
  misc_feature (790)..(790): n is a, c, g, or t
aatagctctatacacatttnaaaacacacatgtaggagacagttaagatctattcagtctgtgataatgtctagaactcattnanattcatcaaacccctgcnatnanctccaaaaanccttaacnaaaaacagctgaatcactcatcaaaccatcagtgtcttcctcggcagaatcaagggttggccagaaagagtaaatattctgcncctccacaaaatanaactaaaatncaattctcctgcatctgacaatacaaggctggacagtatganctgcatgactgtnaaccaatgangcttctcttggnctcatttgtaaaaaggngattaactctgtagtcccgcctatattgcatggtctccagatannnnaatnttgtggtaagtntaaattaaaanctcctctcctttaaaangggaacaccangangngagagtaagaaaagganaaggaaaaggctctttccagtgaccaacacgctgaatttgatgaaaatccataagaggttatgctaaactgagaagcataagggtggatctaccattgccacctcctctttgtagcaaaaaaaatcttaacacggccccctcccagctgttgcactgnggtgnctaagggtacattttgagggngtagctccangtacntttccattttctctgtgccttcacatacatcttatggttatgaacagcacccttcatccatccacggaagcgattaaaaaaagggtgggatggaaaaattaacccaacaatattagatcaatacgtgtattttaagtgtncataatgtga

SEQ ID NO: 581594 - DNA, 204 bp, Homo sapiens
attaaaggccccaagttatgccaagaattcagttatgctataaattacataaggtggtcgttatataattaactgcctttgttttgcttttgtaagtttccttattaaaatctcgctcagtttttgttcaaggctcagctttttggatgtggattcattgggccagagcatacctttaaataaatatcctcctttattgactca

SEQ ID NO: 581595 - DNA, 87 bp, Homo sapiens
ctcacacatccctcccctagggggaggcccagggccacgccacggggctctctctgtcccctccctggccccttctgtcgtcttctc

SEQ ID NO: 581596 - DNA, 158 bp, Homo sapiens
ttttttttatagtctaataaaattttattgagaactagtaagtcaaatactttacagaacatagaatacatatgacccagccttccattaatgacacataacatggggtagttctgaatcaacagttgcttatatagagaacgtcgctacgctcattt

SEQ ID NO: 581597 - DNA, 470 bp, Homo sapiens
tgccaggggtaagagcttggttgaagggctaaaagactagaaactactgaagatgcccttcttactgtcagtaaagctgctggagacaaaagaagttgttctcgctgctagagtggtaatttgagaatcatcagtattcctatgtgacaatccaaaattactggttttcatttgacttgtaaatgacacccatcatccatctgcccacaaacctggccaaatgtgatacaacctgaaaacctgatggactaaaggagtactatttaacaattgattgcctttgcactttattcaggttgtttcttaaattttggtagacagatccatttgtatatgtgtgtgttatatctagtttatggctatagagaaggtttaaaatactacagtgtccttccctcaaggttaaattagaagctgcctgccttttagttgtttcttgcctttaataaaatgttatcagttcccccaga

SEQ ID NO: 581598 - DNA, 837 bp, Homo sapiens
attctgtctcccaggtggaggagtcagcgtattaccttgactttgccgaagtcctaggcacgcccagtgccctcagagtctcattttgaatccaggcacttagggatgctattttcccacatcaaacatgcttcctcccagccaaagaattctggtgacaggtagtgaagataattgtgtcactcctgcttacaggaatgacaaagcgaaagcaaatgaggagaatgaatgaagtaaagaccaccacaaggaagagagacgtgatggcatccttaagaatgatcttgataaaggaatggtggctgatggggtccatctcctaaaccagccagccttagctagactcccgtaggagcatatgccactagcgagaagagctgcgaccttgcaggggaagacacaagagatcctggagtggtagaaacaaatggggtaatgatgacagtcttcgaggtcttgagagtaacgcagaagcgagaagagcaagtgtcattgtcttcatctttatgaaagatgggttccctgcgttaacgactttctcgcgatatgattaagatttcacattgatgttccaggaaagaaaagtacgattatgcggcttgacaaacataaatttgacgtctagaaacaggtggcaaggacagagataggtttagtccactatccaagaagacctgtaacatggggtacagtcgagagtgaatggtcgtaccagtcataacaagaatgttacctgggagaagtctctgcgtgtctacctgtaactgaggggggtgtaaccatccttgtggaagcgtccactttgatcgacgattgcgttagtcactctgtgcttac

SEQ ID NO: 581599 - DNA, 155 bp, Homo sapiens
tcctctcatataggtttcccatggctttgtgaatggatcatgtgtctctaggtataaagctgacatcatcttgccacccggcttacctccaccagatcttccccatgtatctgtctccactctttctacctcgcagctgcgttttcacttccaaa

SEQ ID NO: 581600 - DNA, 255 bp, Homo sapiens
agggtgtatcatgggtattgagaagccccgtagacagtgccatgagtgctgaggagtgataccgatgtcggaggcaggaggaaaaagaagaccctgagaaaggctgaggtacactattagagaacaggaagctagagaacaagaacgctttcttcgagaataaaactgtgcctaacaagcagaggcctcaagaccgaagcgaaggtgcgtgcaaggtagagaagctgattcctgtatctgcccaaaagccaatgg

SEQ ID NO: 581601 - DNA, 912 bp, Homo sapiens
  misc_feature (912)..(912): n is a, c, g, or t
taaacccctttttattaattggaaaattataaaaatatttttaaaccaatttctataaaaaagtcccattttgggggggggttttctaaacccaaggtgtgtgtttgtgtgtgggtgtgttaaaggtaaaatttttgtgtggggggattaaaacaatattgtgtgggaaaattttgtgagccacacatatatgatgatgacgcgtgtaaactctcgcgggaaaacccgcgtgtgggtgtctacacaaaatttttgtgccgccagaaaatatgcccggggaaaagtgtgggtaagagcgagaaacttcaaaattcctctctgagagaggtcttttgtgagaggagggtataaaatataaacacaccgcgcaaaaagtgtgtgtgttatataccgcgccggtgtcttatatattctatatttgtgtgtcttctggggagtgttttctcatatatataacactatatgggggaaccccgcgacgggtgtatatgtgaataatcctctgttgagatggcccgacaatcataaactagcgagtgtatgttgtttttatagagacagtgtgggagacaatatctctaggaggggggaatattatagcagcggcgtggtgatacaatccccgctggtgaaggggggccccaaagtgtgccccctctcctcctattataatgtgggggggggggggatataagggggggacaactaaggggcggtggacgagtctgtggtgaataacaaaaaggggggcgtctcatataaaaacacacactattctcctgcggtggacaacaacaaaaaaaaacacacaactcttctctgcgagagaggcatatataaacaacaatgtgcggggtactcttatctaccccgcatatcttaccaaagagaggcccacttttctgagcgacn

SEQ ID NO: 581602 - DNA, 204 bp, Homo sapiens
ctacacgatgcagcagtccttggatcagtactgaactcagttccatccgtaaaatatgtaaaggtaagtggcagctgctctatttaatgaaagcagtttcaccgtgattttagttagactacaaatttgacttgtgatacattagaacaacaatggaacgtcatttttttttaagagagtaaagatttttaattcgtgtgattg

SEQ ID NO: 581603 - DNA, 233 bp, Homo sapiens
gtgggccatgcccataatcccagcttcttgggaggctgaggcataagaattgcttgaacctgggagatggaggttgcagtgagctgatgatcgcatcactgcactacagcctgggtgatagagcaagactgtctgaaaaaaagaaaaaataaataagagaactgaagtttattcagtaccatgagattggggttggttaggatgggctttaccgaggtgggtcagaacataat

SEQ ID NO: 581604 - DNA, 280 bp, Homo sapiens
gcacgagagcaatctccacgtctctattaacctctctgtcaacccggcacagatcatgctcataaggtaagggttatgtcggagctcctggaatcttaacccgcctgtccacatgtgtttgagaactatgtggcagatagtccggtgtgttgcaagcgcagtcgagttggctttgtcgcaacacaggtgtaccggaagagcatgagacgactggcccctatgctatccacataccggtgatatactgtggtggttttacattcacaggcctgacagtttg

SEQ ID NO: 581605 - DNA, 708 bp, Homo sapiens
  misc_feature (234)..(234): n is a, c, g, or t
ccatttagaatgttttggtattttaaccccctatagctctagtttaaaaaaacaaaatcaaaaaactcgcgtttgttattttttattttttttccataaagttgtaaaacgccaaaaaagtgttttgttacaaaaaaaatcttttaacgcggtattaaaatacccttcatcaagggaatttttgagttccgtgcttcaagagtattgagtctttgaatgttggggtggtctctnggcattcgacaagcaatgcttctctcatagtgtaatagcttggcaaacccacgcggtagattatttcccgaaggtgttcattttgtctcaactgttaaatatcagcacatgatgcgggtgtattgaccttcaattacattgttcagatgaataatataatcaaaatcttttgctatctttgcacagatccatgatagatagcgctattagacacaggtgttcgtagagttgccctttttcagggcaaagaggcgaattgtatgattgttagatggcaatagtcattagaaacatacaaaaatgatgtctttaagtgtagtgttgtggcagttttgtaacatggtccgtccaagtttatgcccgcatcgaatggcagctgaatgtttctacctttgagctctggtctctctcggaattagatgtttagacagaatgagcatctctgatgttttctccataaaaaattattaagtt

SEQ ID NO: 581606 - DNA, 259 bp, Homo sapiens
tgcaatgggacgctgattccgatgacgcccggcgacaacggcgccatcagcaaaaatggctccacctatgccaattattcgattccgctgtcacagtgcaacactgtgaccattccggcgatcacctcttcacgaatctatttgagcgtgggtagcccgatgtatctgcgcagtgccgggaacccggtctatggatacgtcggcccggatatcaataaccctgcagacccaaatatcgacgtgactttcgactttatcg

SEQ ID NO: 581607 - DNA, 322 bp, Homo sapiens
cacgagggccatgatcgaagcgtgtgcgctcaatcccagcggcgcgtgagacggcggacctggggcatatcgaacacgtcgaaataagggctggtgccgggcgcatagtcttcggcgtatttgtagccgccatcgcaccagggattgccataatagccgtaggggccattgttaggcttgcagtcgcgtgcgacctcgcgatcgcgaaccggcttgcgcttgccgtgggcaaatgcgtcgggcggcgtcatggcgaaggcggcaatgccaagcgcggggattgtcagcatcggtttcaaggtcatggggctcggctcctgtc

SEQ ID NO: 581608 - DNA, 119 bp, Homo sapiens
ggctgcatatggtacgatgttgcattcaacttttaataaaccgtctgacagttttccaaagtggttgtaccgttttgctttttgtttttttggggccagggttttgtttattttcttgt

SEQ ID NO: 581609 - DNA, 445 bp, Homo sapiens
ttgagtatggcacgtgttaaataacagctaggtatagatgtagaggagagcttatagccacgggacaccaccatggagggcctggcctttggcggtggacagtctgtggctgggtgggaacgtcaggagtggggcctgcctctttgctgggaatgccgtgcactcccagcccacttgccccatgccagcactcgaggcaggacttcgcaggtgagcagtaacggaaatcagccccgtttattcctcccagcacctgccttatccaactccccacgctgtggctgagtcccagcctgctatggaagcatcactggactcccattgaactctgtgcagattcgctgttcgtagacatggtacctgatggacaccaagctacgtacagcttcaaggccccttctttctttgctaataaaaaataaaaaataaaaacataatacacgtt

SEQ ID NO: 581610 - DNA, 711 bp, Homo sapiens
  misc_feature (263)..(263): n is a, c, g, or t
ttgagtatggcacgtgttaaataacagctaggtatagatgtagaggagagcttatagccacgggacaccaccatggagggcctggcctttggcggtggacagtctgtggctgggtgggaacgtcaggagtggggcctgcctctttgctgggaatgccgtgcactcccagcccacttgccccatgccagcactcgaggcaggtgaggcccagccatgggtataaggtgctcccagggcgggattatgctcaaggaggcaggggntccatgtttctgctcctctcccattactaacgggtgtctgctttaggtttgatctccctcccttctgcccctctcctggtaaagggatgaataatgaaggccttccttgggaagtctgagatggattaccccaaggaggctcgaacatgggaggacatgcgagaactattgtcacatgagttttctttctatcctgtctgcaggacttcgcaggtgagcagtaacggaaatcagccccgtttattcctcccagcacctgccttatccaactccccacgctgtggctgagtcccagcctgctatggaagcatcactggactcccattgaactctgtgcagattcgctgttcgtagacatggtacctgatggacaccaagctacgtacagcttcaaggccccttctttctttgctaataaaaaataaaaaataaaaacataatacacgtt

SEQ ID NO: 581611 - DNA, 765 bp, Homo sapiens
tgcattaccttttaaaagaatgcgatattgataccgatgcttacttttttttttttactactgggttattccttccagaaagtatagcccgcctttctatagcatagttctctttagggtgggaatgattcctataagatttctcattattaaatcatggcttttttcaagatgggaatcaatcttggatttaatctaagctggatattctcattggttagaagaacaacctacatgctagagagagaggaggaaatatacccacgaccacacagccagttagtatccagtgggggcgggacctccagccagggtgtccgtgcctcagggtagttaacatgatatttagaaacggtaaactttttaaaagaaactatttaattaatatattcctattaaaacattttaagggtaaccacattaaacaagggttaattttccccattccaaagtaaatgctaagcatgtttattactgaagcagtactcctggatttagtcatatgacattctgaagttcaattaaacctcatggcgactaaaaggtggtcttcctgggaatacggcggaggatttgagcgatgggaatatagaagtaaagcgcttgctttaagcactgggagccccatcttatagctattagatgtacgaaaagagaattgccccttctaaactaattaagggaagtgttctatccccagcagatttcggaaacggacctttttgattccacttcagacctactaacatctcaagcctaattaaa

SEQ ID NO: 581612 - DNA, 289 bp, Homo sapiens
tcgaatcgacggtttctcagcctgtgcacaagagcaaactccgtctcacacaaaaaagaaatattaatatgagttcgagaccagcctgacaacatggagaaacccattctttggtaaaagtaccaacaattgggccggggatggtggcgcatgcctgtaattccacctatttgggggcttgaggcaggagaatcactttgaaactgtgaggcggagagttgggggtgagccggagagcatgccattggactgtggggctgtgggataagagcgagaaaattcggtctca

SEQ ID NO: 581613 - DNA, 199 bp, Homo sapiens
tagctatggggtttaccatattggccaggatggtctcgatctcctgacctttcgctctgcccgcctcaacgtccctgaatgctgtgattacagatatgaggcaccatgcctggcccttcgcctgactaattttttgtctttccagttgacacggggttgcgccgtgttggcagagtatggtctagatctcctgacctcg

SEQ ID NO: 581614 - DNA, 1286 bp, Homo sapiens
ctactgctgtctctgtctttgtggttgttggcgcgcgcgggttatggtacttcggctgctgtgccgcgaccggtggctgtgtgttgtaactcacccggccggtgggctcggccggctctggtagtgtgtcgtcgtccttttatggtggctgccgccagtgagccccccgcctcctttcttttgttgttggttgcgccccgtgctgctcttctctctcgctggggaggatgtcggtgtcgtctgttttttgttgggcgccccgcgatgggtggcccctcttttttggggtgtttccctcccccgcgtggtgcaccgctcctgtgtttgttgggggttggtgcccccgccccctccttttgtttccctcccccgtgccttgggttggcatcccctgcggggggctgttttgcctcgccgctctccccgtcgtgttgtttgctcaccgttttttgtgctcccgcgggggagtattgttctccgcctccccttgtgtaaataactacgacgcgggcgccgttgtttttggtgggggcgcgcccccccctcttggtggtgggggtgtgtagaggtgtttgcggcgccctcccttctgtggtttcccgaccgacagagttttgtgttctgtacgctcccccgctggggggtcgtttcttttttgttagtacccttcttttccgatcagtgctctctcgtgcgtcgtctgggtgccgctcgttcttgggcgcgtgggtgggggggtggttgtctctttgtggggggggtgtgttgctctttttgggggccgccgccctccccttctttgtgtggtgccctcggtgcgcgcgacgccctgtcttttttggcgtcgggtcgttcgcgctcactcctggctgtatagagttggttgtttgtggtgttgtttctcccgccgccgccgttgttgcccccctcctgggtgatattttgcccccctctcgtcgacaagaaagatgggtttctctccccctctctctctgaatatattttgtttccaccctggcgcccccctttgcgcgcacattttttgtttttttttttttttctttcttgggggccctctctctccgtttcgcccccccttttctctttttataaaaccgccccgttttctctctctcttctgcgattttttttgttgccacacacacatctttttttgtcggtacaattttcctccgcttgtttaccccgcccgattatttttttttcttttttttttttaaagagagagagagagaaaaaaaaaaaaagaggaggagtttccccca

SEQ ID NO: 581615 - DNA, 341 bp, Homo sapiens
  misc_feature (95)..(95): n is a, c, g, or t
agccccggcccttcccccgttttgaaaatgtgtaaccgacagtttgcttgggccacagccttttcaccttggtattgcatgcacgcaatgctaantgccccttttccgttttgggcaccccaagttttccccgacccccgggtcccaggtatgttcccccctccacctgccccactcaccacttttgttagtttcaaacacctccacgcccacttggttttttccctttgcccacaaaagggggggcacaagggacgagtttattttagttgggaggagcagggtaagggtgggggacccaggatttcccctcccttttccaaataaaaattagggtttta

SEQ ID NO: 581616 - DNA, 329 bp, Homo sapiens
taagagcacgaagtttggaaatcccctctcggtaatttcacttcaagatacagctgtatttgtagtagagcatccaaggtttgccaacaaatagtcaggaatcctttgggaagtaccagcctagagctcatgtaaagagtttccgtatcgataagcctcctctcataggccagaatctggactgaatagccggtatctctgatctccacgtggaaggttcctgggttcacacgcaactgtaattccgtcaaataatactgtcagaatcacttctaaaagacattgtcggaactggacacacgcactgagacttcctgagcatagcactt

SEQ ID NO: 581617 - DNA, 326 bp, Homo sapiens
cccttaggtcctaaaatagaaaattgtaaagggtaaatctcagggcttgaaaattgttgaggcaatctctaatgatggcaagatctagctctgttaggacttctaagcagtattctttagtatactctgctataggacagaaccatttgcaaggaaaggatgttaattcgggtctctctctccctcttgcaatatggtgccatttttgatctcagagccatcgtgcctcatttctaacaccttgtcttcaatagtctttttttcttcttctgcttcaggtgcctaaaaattagctctcttatcctctctctctcttctactcttct

SEQ ID NO: 581618 - DNA, 216 bp, Homo sapiens
ggtggacgctcgccctaagaccagggcgcccggctcaccacatcccgccaccgccgaactagaggtctcagccaggacacttagggaagaactcaacctagctcgaatcacagatgacaggatcctgtgtgcaccaagtcctggggactcccacgtgagcaagctcattcaccgactaacgcagcagctcagccagggtagcaggggccagggcaa

SEQ ID NO: 581619 - DNA, 693 bp, Homo sapiens
  misc_feature (46)..(46): n is a, c, g, or t
  misc_feature (66)..(66): n is a, c, g, or t
  misc_feature (125)..(125): n is a, c, g, or t
  misc_feature (137)..(137): n is a, c, g, or t
  misc_feature (153)..(153): n is a, c, g, or t
  misc_feature (164)..(164): n is a, c, g, or t
  misc_feature (175)..(175): n is a, c, g, or t
  misc_feature (183)..(183): n is a, c, g, or t
  misc_feature (189)..(189): n is a, c, g, or t
  misc_feature (193)..(193): n is a, c, g, or t
  misc_feature (205)..(205): n is a, c, g, or t
  misc_feature (211)..(211): n is a, c, g, or t
  misc_feature (238)..(238): n is a, c, g, or t
  misc_feature (294)..(294): n is a, c, g, or t
  misc_feature (322)..(322): n is a, c, g, or t
  misc_feature (390)..(390): n is a, c, g, or t
  misc_feature (401)..(402): n is a, c, g, or t
  misc_feature (430)..(430): n is a, c, g, or t
  misc_feature (432)..(432): n is a, c, g, or t
  misc_feature (444)..(444): n is a, c, g, or t
  misc_feature (572)..(572): n is a, c, g, or t
  misc_feature (646)..(646): n is a, c, g, or t
ccggtgtcccgacggcggctcaagttagagttgctgggttttgctnagattggtgtgggaagagcntgcctgtggggagcggccactccatactgctgaggcctcaggactgctgctcagcttgnccgttacctgangaggcggcggacggcnccctgaccggncaccatgtggnccttctcngaattnccangccgcgctgatnaatttnatcgtctcgctgctgggatttttggcnacagtcacccttatcccggcctttctggggcctacttcattgtctgcgcgcctctntggtcaggaccttaacaaaaccagccgnctagcagtattccagaatcccagggagtgatcagcggtgctgttttccttatcatcttctttttcttnatcctttttcnnttcctgaactgctttgtgtaaggagcantntaaggcattccnccaccatgaatttgtggccctgatatgtgtcctcctttccatctgttgcatgatcttcctgggctttgcggatgatgtactgtaatctgcgctggtctgctatatagctgctgctatcctacagctgncctcactacctctcctcatggtctatttcaccaactttggcaacacgaccattgtggtgcccaagcccttccgnccgatacttggcctgcatctggacttgggaatcctgtactatgtcta

SEQ ID NO: 581620 - DNA, 100 bp, Homo sapiens
tgtacctggagactggttttctcccagttcctggcagcacccaaacatcttgccttcctaattatgtgaattgtgaataaatggccctctagtagctcca

SEQ ID NO: 581621 - DNA, 871 bp, Homo sapiens
ggaactggtattaagcagtaatattgcaggggttataaaattggcttttgaaaattcatggggatttttgtgttctacccctttgtttcctttgcttgcatgcttaggaaaaatcattggctaagtcaatcaagagaacctgagattaaagccaatattttaggtaaaaatgggatccttaatttctggaaaactgagttctttctagcttatacattatgcccagaaggcagtgaagtcttacagaaacggcaaaatcttactaaaggtaacttactgtagaacattccaaatgaacaacaattcattgaagtacatttgaaaatgagggctctcagtaaagtctcttttggctaagaatgggtttggcactatggcatgttaaccgctattccctttggattaatctgtcttacacttttttctgacagatatgggtgacaggataaggcatttacaggaccatgggatatggggagctttttcctccccaaaaggggaaacttgagacctgatgggactgctggaaaagatccctttgctactgacaagtggctgcctgaacttttcagtgtcactgcagtgggtaggtctttatctggcctccttgagctattcaccttccccaacctgccacaggcaatacttttctctctctacttttcctttcctatcttttctgttacacagggcaaccatcttgcccagaaaccacgtgttgaaattcctaagtcagaggttggattaaagatgatggggggtctcatctgagggcaatttaagccttgtcagttgatatgggagttaagcagaatgggtaatgtctacgttcatcatacatatttggtctgggcagaacaaaaaaagataa

SEQ ID NO: 581622 - DNA, 364 bp, Homo sapiens
tagatcgagctcggtacctggattatagtgaggagttagtgggtgcagcgcacagcatggcacatgtatacatatgtaactaacctgcacaatgtgcacatgtaccctaaaacttaaagtataataataataaaaaaaaaaaagaaaaaaaaaaaaaaaaaaacagttccaaacaatttaattgattttttccagggggccagccatcagttggaaaagccaagaattatattggagtttctgatttaaaagtgctcagatgctagggtgtctaaagctttcaggtgaaacacggcttttaacattattcaaacattattcacacgcaaattaggaaaaaaagaaaaaagtttcgtgcccaaga

SEQ ID NO: 581623 - DNA, 845 bp, Homo sapiens
acgcctagctttgaagaaggcaaacatggtcatcaagttctcagacgaaaaagaatgagccctaagtctgagactttactgaagagcaaaaagcagtgagattcggggaagcttttgatattttcgaatgcgggattggaacgtggcaacgcaactagatggttgagagaactgaaggtggcaatgagggccggttgggcctgtatgagctcgcaagaaagagaagaggagtttaatgaaaagtgatagggtgaaattgaataaggaagggactaggagatagatgaactttggctgaatttgtaggctggtgaatgtacccaaggaaaaatggttgaaaatgatactatgcagaagaaatcatgaaatgtcttgcaagctctttgatgatgatgaaagggggaatgatttcgttcaaaaactctgagagatgcgtggcaaggaagttgggtgggaacctgaggtgatgaggagctgtgggtaaatgatgtgatgacgctggatcgaggatggagatggagagggtcagtgatgctatagttcctgcagcagtcaatgatggaagagccacccatcatattaagattccagggtcttcctaagtcgtagcctgcaacagcacttgtgtggactagatttgatggtgcctgaccatggtgtgaaaatctaggctattgatgaccaccgaatttcacaccgtagggacctcccagttatcaatttaaatagtgacctggagcttttataagcgttggaaagtgtcttggatattcacagtcctttgtcaagggacctgggaataccgtagtgtcaaaagcaagaaggcgcagaacggaaagacacga

SEQ ID NO: 581624 - DNA, 748 bp, Homo sapiens
  misc_feature (123)..(123): n is a, c, g, or t
  misc_feature (128)..(128): n is a, c, g, or t
  misc_feature (142)..(142): n is a, c, g, or t
  misc_feature (153)..(153): n is a, c, g, or t
  misc_feature (252)..(252): n is a, c, g, or t
  misc_feature (700)..(700): n is a, c, g, or t
  misc_feature (706)..(706): n is a, c, g, or t
  misc_feature (728)..(728): n is a, c, g, or t
  misc_feature (730)..(730): n is a, c, g, or t
  misc_feature (734)..(734): n is a, c, g, or t
gaccgcccccaggtgtcaggctcaaggtacaggcccagcacgactacagcggccacggacacacgacgagctgcagctcaaggctggtgatgtggtgctggtgatccccttccagaagccctnaagancaggatgaaggctngctcatgggcntgaaggagagcgactggaaccagcacaaggagctggagaagtgccgtggcgtcttccccgagaacttcactgagagggtcccatgacggcggggcccangcagcctccgggcgtgtgaagaacacctcctgcccgaaaaatgtgtggttcttttttttgttgttgttttcgtgttttcatcttttgaagagcaaacgggaagatcaagaggagaccccccaggcagaggggcgttctcccaaagattaggtcgttttccaagagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttncaaacnaaatgaaacaaaaaaaaaatgncnccanctctcaaaaccaaa

SEQ ID NO: 581625 - DNA, 871 bp, Homo sapiens
ttggtcaacctaactgaagacataaattgcgccccgcgctccatgtcataacagttgtggctatctcgcactcaccaagtgcccccgctttttcagacgacccaactgttgttctccacaacacacgccctatggcaattcgagcccgcgccactaaagcatctttttgtttatacgttacgcccccgactcggagacatctccccactacacttatgtcccttcatctacggcgactacgtatcccacgtatatgggggctaacgccctaactcgctacgctttccctccatgagaatctttcctcgtctattggaatagtcgacgcacagtatcttactccgccaccacacacaacactatgtgtcttgaaggacgttatcttcccgcaacaacctatctatttgatccccaggcgaaccgcccgcccttctgtaatctcacgcctctctgcggaggagaagttgcatctacacgggttggatgtccaccgcacacacgctatggtcttaatgctgctcaacataattaaactatgtctcactctctctcctctcacggctacgtccactcactctcacagttttgttcgcccgctccaacgcgtacatcctcgcctccgtcctacacacagtgttctccccacccacccccgacaactgcggtgggactcgcccctcaccccacccccctagttctcacacacacagaacctcccttcttctccccactcggtaccacccccaccgctctttcttttaccttaccgcctcctcacgccgactcaccctctcacgctactcgctcctctctcctccccaccccgcctcctctgtcacgcctcggccttcttctcctctcttgattgata

SEQ ID NO: 581626 - DNA, 171 bp, Homo sapiens
gtaactgtggtgttacgtcaaacacccacaatccccacacaatcatagacacacatgccacacataaagacacttcccacaaaagcagtccctcaacacataaacccacacacctatggaccaaacacctcacctacaaatccctgtaaacatccacagacacattcccac

SEQ ID NO: 581627 - DNA, 197 bp, Homo sapiens
tttgctcgacatctagcaggatccccgttaactacgtacaaccaacgcccagtatcatacaaagcccccgcaccaataggatcctcccgaatcaaccctgcactctgaccaatcaataatttccacacttcaggcccaccctggccagtggtgtcaccctgcatcctctctgacctgaaggtgctgatttatacacg

SEQ ID NO: 581628 - DNA, 467 bp, Homo sapiens
ggaccgcgccaaggcgccaatactgacgttgtaacctggagccggaggacacgcgaggacgccagagccgaaaccggttccagggcactcggccgttctaaggctcgaactcgccacccaagaccacgcagagcttgcgaaaacggggctgagccggcgcggcgcatgcgcgggcggcgtcccgcgcaccacagggtcctgaacacccgcagttcccggggcagggccgcgtccggaagtccgtggaacggatcttccgatccttgttctttgattcgttaccaaccttccacttccgtagacagttcttcccgccttccgccgtctgctaggcgtgtcgccgcaggaggtgcgcgcccgccctgttttgtttccgggggaatctacttctctgaaggacgctcgggacttccgtttgttcccctcagcttctaattggctacttttatgaatatattagggcacga

SEQ ID NO: 581629 - DNA, 511 bp, Homo sapiens
aacgatggtctcagctggccggaaggtggctcatgcctgtaatcccagcactttgggaggccgaggtgggtggatcacctgaggtcgggagttcgagaccagcctgaccaacatggagaaaccccgtctctactaaaaatagaaaaactagcccggcgtggtggcgcgtgtctgtaatcccagttacttgggaggctgaggcaggaggatcacttgaacctgggaggtggaggtcgcagtgtgctaagattgcaccattgcactcaagcctgggcgacaagagcaagactctgtctcaaaaaaaaaaaggtcagccggacacgggggtatgcacctgtcgttccagctacttgggaggctgaggcgcaagaatggttggagtctgcagaagttgcagtgagcggcgctcacgccatggtaccccagccggggcaacagagcaagactccatctcaaaaaaaagaagaggaagagtttaatatttatataatagtatagctgaggaccatcg

SEQ ID NO: 581630 - DNA, 1437 bp, Homo sapiens
gagacacgtgaaatgccccggctgagtccttcagttgtttgggtgaaacgcatacccgacactaaacacacaaacaaaaaaaaaaaaagacttcccgtccgccagtctccaggaaaacgtgaaacccccttcagaattacccgtggcaaacattgtgtaattccccttcgctgttgtcatgtgactggagcggtcatacgcgtcggcacgcacagacacagaccgtggtcctaaaacttctccatattagaaagacacacactggtgtacgcggctcattgactcactggttatccccagcatccccaacgcatgacatgcgccagatcttctccctcaaaccaccatctaagactgcattctggtacaccccaaaacattaaatgggcgacaatgtgcccgtggtaccccacaggagcccttccttacaaacgcatggccctctccttagtcctacctgagccgctgcccatttggttccttggttttgcgcctccccactagcctccacgagacccgcccttccctggcacgctcccccagcactgtgctcgcccccctccatctccgcacctccgacggtccccccccaatcaacccttcacgcctactacataacccgggctcaagggcctgcacggtgctccaaagctccatgccagcacccattttcgagagcgctctcacgtcccgaataccctcgcttacatcgcccccataacacgggcgcgatcgtggcacacagctgtgagtgcctctcaaccaacgtcagtgcttgccactccccaactagtgctcccccctccaaccactcttgtccccacacacgctgcacaccctcgtcacagtctcgatccatctagcctcccttcaccaaccttaacctcttcgctcaacccgacttctacccccctcactcgtctgcacatcatactcccacaccactcgacaaaccatagtctctaccgctacactatcatttcgctgagtacaaactccaactcctccctccttcctcccacacactatcctcacttctaccatcccctcactctctcctatatctcgcctcctcccatctcccccccacccaccatccccccccccccttcctatgtctccctactacaccttccccccgtcctcactccccctctacaactcactccctccctcacctgatccacccatccaccacctacccaacaactccccacccacaacttcctactcccttgacatcctcaccatcaactctcacatcacactaccatctctccacctcatcctcctctctccacagcaaccacaccaaccacccactccccacaaccacacacctccatcccccacctgcacactctccatctacacctcatccccaccctctcctcttcaaccctccactcctataaccaaacacacctactcactcat

SEQ ID NO: 581631 - DNA, 101 bp, Homo sapiens
gaagagaaaaccttgtagagagagtaaaaaatttaccaccatagtaggcctaaaggagccaccaattaagaaggcgttcaagctgaacaccatcactaaaa

SEQ ID NO: 581632 - DNA, 510 bp, Homo sapiens
ggcgccggcgtgtcatccaccttacttcccaatacatgcaggacgggccggcacagcatcctgacaggtagagatgtccagcctcttctggatggcctccggggacgggaaactcaggggggcgggcagtggccatctgtcccttagccaatgaactcatatcttatggctgctcccataactcaccacaaacgggtgggcttaaaataatacacatttaatccattacagttctgggaggccagaagtctggaaatgggatcttatgggggctagaatcagggggccagcggggttgcatacctcctagaagctccaggggagaatctggtgtcccggccttttccagttcctagaggccacctggtatgcgtggggtggcagttccttcttccattttcaaaaccagcagagtaacatcctcagatctctctgactctgacctcggcttcggtggtcaaatccttctccctctcctacagaccctggtggttacaagggaccctgagt

SEQ ID NO: 581633 - DNA, 518 bp, Homo sapiens
aacccttttttattgtcattttttgtggtgcccagggttgtatgatttttgaccaggcccacgctagagcgcaatggtgcaatcttgggtcaccacaacctccacctccggagtgcaagtgattctcctgcctcagcctcttgagtagctgggattgagggcatgggtcactacactcagcttattgcaaatgcttacaagagcaaacttggtgcagcccacaggccagggggggcagcaccctggaaacgactgtgaaagtgaaccccccaaatgtttaccagggttgagtgggggaggcaccgactgttttttacccacatggtgtgaaggtttatggaaggccttccatgtggaaacatgcagcacactcccatatctgctaaaccgttgcattaggcccctttttccactaaagttttccctttcttaacccggcagaggaacatttcgggccatgggaatctgtaaagaactcagttttaatttccaagggcccctgggaggaatatttagag

SEQ ID NO: 581634 - DNA, 184 bp, Homo sapiens
tgaccgagatcgcgccattggacttccagcctgggggacaagagcgaaactctgtctcaaaaaagagaacagaaattttccctacttaggacaagaacagaagacaatttaacgaaaaactaccgggtgtgagtctcaacttctccttgggtggcacttggaatgaatatctggtgcacattcc

SEQ ID NO: 581635 - DNA, 125 bp, Homo sapiens
cacctatcacgttccctagctgaacggaccaggctttgtacttctcgcactcattccctactgctgcacgcgcactgagcagctgactccatgagcgctgctttttgaaacgcctagccactaaa

SEQ ID NO: 581636 - DNA, 758 bp, Homo sapiens
  misc_feature (403)..(403): n is a, c, g, or t
gtgccttccatgtgccaaccccaacagtgagtgagatctggctggcagcctgtgaatgctggagtcctgagaatgatgagtatgatgctgtggccctggagtgctgctggccaatggctgctggagcagtgcccccacctgccctgtggtgttcattgaatgtcttgtgaatgcttggatgttgtgtgttgcaatgacatacactcatgtggcatgcccaactgatcttgtgctgagtgatgtgccctgctggcactactgatgtgacttccctcaatgcttgtgtgattgacttgaatgtgtgtgcagatctgatgtgcatgcatgaatgtgatgatagattgtgagaatgtgctgctggtgaatgcctaataaaccatgggtgtttgaatgaagttgtccnccactccatcactccctgttgtggcctattattggctactactacgttgccttgtgcatgtgatgcaatcgatttgtgtgcatcgctatacctctgatgcactgtggcccatttttggaaaatgtctctgtcttgaatgaacccaaatgaaccctgggcttgtggtttggatgtcctgtgctgtgcttggagtaacctgtgctggtggcttgaatgaacatctgcaaatacactacataggccaatgtgcgctgcaagtgagtgccccaactcctggtatccctgtggtcttgagtgccatcttcctcgaggcaaggccccagaggaggaccaatgagcgttggatgccctgaaa

SEQ ID NO: 581637 - DNA, 874 bp, Homo sapiens
  misc_feature (470)..(470): n is a, c, g, or t
  misc_feature (557)..(557): n is a, c, g, or t
gccagaattatgaaagacaacaatatagataaatgtgaatcataagacgaacagttaacaagtctgatacgaaaatagtaggcccgatccagcctgggcaacatggtgaagaccctgtcgtctacagaagagaataaaaaagagaatgtcacgactgggggcttgcgaccttataggttcccagctattctcaagtgaggcttgaggcaggaggattcattgggaggcccccaaggcaggctagagggctgtgctagtggagccaagtggatgggccaccaattgtggtgacgtcccgagccgggggtgggacgaggagctaagaagccttggagttcactcaacaaaaatacaagaataaatacaagaagacaagaaaacacaatactgtgagcgagcgaggtggcgacagtgactgcacgccagaagaaaaaatagtcttttatgttgtgaataaacagtcgtgctgngtggggagcgggcggggagaggacaccacacagggtttgtagcgttagagagagagccataggaggggtgcacacatacatgtaggngatgttaacggaccgcaggaggagaccaagcgctgtgggtagatagaaaagggataatacgtgagaggagtggaggtgttgatcttccaactacatacagattaaaaagaactagcgcacggagtgagagggatccagcggcgaggagggagttttttcttgaggaatataatcgccataggatatagcgagggtttgaacgagggagagagagcagtaccagaggggagcgtatctatctatacaacatagaggagggagcgtataccaagggggacgaaatcggatcggattacaacatatatatttaaggcacc

SEQ ID NO: 581638 - DNA, 565 bp, Homo sapiens
caatccaatccaagggttcccaaatcgcccgcacatccaaactcctaaacctaaactttgatctaaactgcaattccgtattcgccggaggtttaataaatccgcgcaatcttcgcgggaggaaggaggggaggaagataagaaggagctctaaggccctaaggactatgtaccgcgataaacctactaataaacgtaagtatcctcgctctcaccgtctaacgagtcataagccctctacgccaagccgttagagcgtttaccggaagaaggcctggaaggagtgttagcatctctgttctaccccgactaagacgttacgactccgaaggagtaggtgcgtaacttaacgttttctgtaattgcggaaaactactactactactaaaggtcttccttacttgtagagccggagatatatccgctagaggagtcggtaggtcgccaaactataaacgtaactgtctgcggtataacgatcctatacctcgtcgctactcctatcgccgtagttctatccgaccgacgaagtacgacctttacctttacctctcttaccgtgatt

SEQ ID NO: 581639 - DNA, 425 bp, Homo sapiens
  misc_feature (57)..(57): n is a, c, g, or t
  misc_feature (92)..(92): n is a, c, g, or t
  misc_feature (153)..(153): n is a, c, g, or t
  misc_feature (355)..(355): n is a, c, g, or t
  misc_feature (376)..(376): n is a, c, g, or t
cccggaagggtcacgtggcctcgaagtagccctagactgcgggttgcgcgcaaaggnggagttctgtataaggttatataatagatcacttncaactagaaacccgaaacttgccccgcttgaagcacgcactgaatgtataggaagctccgntctgtatgtttctgggtacgtcccaaattgcgtcgcttactgtaggaagcaagtccttaatctctccccacacctccggctcgaggccctctgtggtctggtgtctgatgcatgtctgtctgtccgtcggtcctgctcctcactccgagtactgtatgtaaacctccgaagtccggagttatacaagtaccccagaatctancaaacaatagcgcactaaaancttactaccttaccttcgacctttcggctgcctcgggggtagcctggtc

SEQ ID NO: 581640 - DNA, 357 bp, Homo sapiens
gagagagagcactagtctcgagtttagggggttcctctttgtagagactggggctatgagtacatgtagacccagcctggtctggaaactcctgggctcacgcaatatctcccacctttgcctcccaaattgctgggggattaaccgcgctgtattcaccatgcccagcctaggatcaggtggagtcaaatcgggtcatcgctgggagacatgggaaaagccagtgttaggcggcatcccatgtgtctgtagcgaacggggtctagtggggttggattggttacgccttggacggactaaaagaaccctctgcaggaacagtcttggacacccagcacaaccggcacgcccggcacc

SEQ ID NO: 581641 - DNA, 174 bp, Homo sapiens
ttggggcgcgtgccagaagtactcgtcgagccaggagatgtcggtggtcgtgacgtccgcggtatcgatggggccagcagggaggcgagggtcatactggtcctagggcaaagagcagttccggagtatacgttagggcgcgcgatacgttaccgcccgttacctcgtgagaat

SEQ ID NO: 581642 - DNA, 399 bp, Homo sapiens
  misc_feature (210)..(210): n is a, c, g, or t
actcgagaatcagggacgtcaattttcagctgagctaaattccaaatccattcttacaagaaaaagtattagtttatatagcacctacttatatataaaatataaattggaaaaatgcttttaaatgggtaactccaagcttttggtttacccagttatgttccaactgcgtgggtaggtgaagcagttttaacaccaacttcttccccncaatttttttttttattttttttacaacttcagagctacagaataacccagaatgaaggggcagctagggccagaatggcacgggtgctatataaaggaggttaaggggtgagaaaagtcaaccgtgaaagtgaggttcccggggtatacatggaccacgggggtaccggaggctcgaattcggaaatc

SEQ ID NO: 581643 - DNA, 386 bp, Homo sapiens
ggtgcaatttcgcctcgtggcagcctcgacctcctggactcaagcaatcctcctgcctcagcctcccaagtagctgtaactacaggtgtgtgccagaccccagctagtgtgtgtgtgtatacaccacacacatatatagtagagacagcatcttgagatgttgctcaggctggtctcaaactcctggcctcaaacagtcctcccaccttggcctcccaaagtgttgggattacaggcatgagcaccgtgcctggccttagcctgtgttttgtgaacaggtgagttccctgtccccagaaggatttcagcagggatagcattcctcacgggactgagtccatgtggtgcaatcagagaaaagagtcactcacagctggagttggtca

SEQ ID NO: 581644 - DNA, 207 bp, Homo sapiens
acagcttatcagacttctctcagaccaaggactatgaagttgatgctctctgaagtctctcaacaaacagattgagacccttcttactcctgaaggctctagaaagaaccagctcgcaaatgctgtgaattgagactcagccacccagagtggagcagtggttactacttggattgaccctaaacaaggatgcactacgtgatgcta

SEQ ID NO: 581645 - DNA, 252 bp, Homo sapiens
acgcattaaggaagatatgtctgcccaataaacaaaacatcagcagaactatcatatactgagcacaaaaatcaggctgataacaaacagcaacatgcaacataaaacaagacacaactataaacggaagacaactcgtgctgagctattaaacaaccagtctaaactatcaagttcttgtgcaacctagcacagacactaagtgcggctatcaagatccaagacccctaccaagggttaagcttgtggctg

SEQ ID NO: 581646 - DNA, 203 bp, Homo sapiens
gccgcccaccacaaaccttgcaccaattcccctctccctacccgggaccggcgagtcttcttggaaattaacaagtgacaagggagggcagtgccttgcaaaaaacaggcgcatagaaaatggcttatttctttgaacagctcttttcgcttaatccatctcttgaaaaataaagtagttttgaaaaggttctgctttaaaaa

SEQ ID NO: 581647 - DNA, 495 bp, Homo sapiens
aatgtaaattgtattacctattagaggttttgtttgtttgtttagtgtcagggtctctctctgttgcccagactggagtgcagtggcgtgaccatggctcactgcagcctccaacttctggggttcttacaagtgatcctccctcttcagcctcctgaatagctaggactataggcactggctttataatttttatttttaaagatgggggtctcggtatgttgcccaggctggtcttgaacacctggcctcctgcaatcctgcctcagcctcccaggtagctgggattctaggcatgagtcatcacacctagctagaaaatttttgagacttgttttacgtccaggtgtggccacttttttttccttttttttttttttgagacacggtcttgctctgtcgccgggctggagtgcagtgagccgagattgtgccactgcacttcaacctaggcgacagagtgagacaccatctcaaaaagaaaaaaaaagaaag

SEQ ID NO: 581648 - DNA, 161 bp, Homo sapiens
ttcaatctctacacgatacacgggaaacttgatgaacagagaccagaaagagtaaaaccttttatgacagtgtggtgcagacatcaatatcaagcacatccttgcccatttacacaacactaccaggttcttgattgagtgaaacacatgacatccatgta

SEQ ID NO: 581649 - DNA, 443 bp, Homo sapiens
cgtagtttctctgaatctatgtaagaatgcaagtcatcatgatggaaatgcgtgtctcggtgtcatctagagtcgaactgtcagattgcacccatgtggtcagctcccagttgaccgcgtcatcgaccagtatcccattatgtgtatctcacagcctttgtagtagtcccacaactacaaaatttaagattgtcaaaaaaaatattgaaatatgaaggcgaatatgttgttccacttttttttccccaccctttttgaactttcctgtttcggttttggaagtttctattgacacatcctcaagctgggggttccttcctcagctgtgtgcagtctaccagtaagcatcaaaagcattcttcatttctctaacagcattttttttttctgagacagagtctcgctctgtttgcccaggctggagtgcagtggcatgatctcag

SEQ ID NO: 581650 - DNA, 171 bp, Homo sapiens
ctaccaaacgtctcttaggacttggtacgttccaaatatacattcacaaatggttcccctttaagcttactgaaccatatacttcatttctgagtaacttagaggacctattacagaacacgctttgtacaatacagcatcactactgagaagggctcgcggactggtcat

SEQ ID NO: 581651 - DNA, 659 bp, Homo sapiens
ccccttggaaaataaacaagtcccccgttctcattaaaagttatcccgtttgtttccctccccaaataggtgtcccaccgggaccaaatgttctcccggggtgggaaaaacccagggttttttgaacggcctttctcaagaagccacctccgtgtattgagtataagtggccatcgttagagttttaaatgaagagtccattccaccaactctgtcttgggcatttgccgaaggcattaccagtttccagggtgcaagtgaagggcctctggtttgctcgaaaagacaaattcatttttcaagagtcactttcttgggtctttggctgtgcccgcccaaataagccggtgtctatgttcgtgttcaagggtttgtacttgcatcgagggagtgatcagaaataattaatggcgggtagtcagagtgacgcgctgactcccctagaggctgggacgtgggtagggatttagcatgctggaaataactggcagtaatcatacgaagacactgtccccagctaccaggtacgccaaacctcggcattttttgtgttattttctgactgctggattctgtagtaaggtgacatagctatgacctgtgttcaatatcatcgctgtggttaccgttgatttggtaaattttggttttggtcctca

SEQ ID NO: 581652 - DNA, 169 bp, Homo sapiens
cagcgacgacagcagcgtgtgcagctcgtcgttgtcctgcacgtcgaagatgctgacgttggcgtagcggccgacgacgcgccacaggctcttccacttgccgtcgcgttgcagctgctgcgccagggccttttcgtcggccttgagcttgtcggcttgagccgccggc

SEQ ID NO: 581653 - DNA, 224 bp, Homo sapiens
  misc_feature (77)..(77): n is a, c, g, or t
gcacagcagtcaggacggcaacagacttgttctcagtgtactcttatctcgtggcactcttgtctgcataatcggcncagtcttgcatgcgtctcgggtccgatactgctccagtgcaggtctggtgtgctgtacttggatggcgtgaacggtggagaagatggtgataccaaactctccctgtgcatctggcagttgggtcttgagcgcgcaaccggactatc

SEQ ID NO: 581654 - DNA, 208 bp, Homo sapiens
tgctggatgtgaatgaagcccgccatcttagtgcctcctgcaaagagagtggaagtgtccgaggactttggcagtgggacaggaaatcacatcctgacaatgcccagagagccagacacatttatggaacagacaatcacatatcggatttggagcgacactgccaactggactggacgcattaatccggtacactggatgccaatat

SEQ ID NO: 581655 - DNA, 113 bp, Homo sapiens
catatgcagcatggaggagggaaaacctctgcctgggttgcgaccactgtctccttttcaactggagttgggctctgaggggtctggaccgtctctttaacaggctctgagct

SEQ ID NO: 581656 - DNA, 492 bp, Homo sapiens
gcagcagatgtcacaacctgaccgggctgcacataggagacagaacaccaggctctatattcatcgcgcggcttggcccatggtggccatggccagcaggcatgggtggcaaacagagcggatacaacggaggtatggcgcatgacgatcccggtcctagtaggtagttatcaacagagagacttcctgctggcttacagccaggcagacatcactgatcccacacacagcaagtgcacttcccagagtgatgcctctgctgtcctacgaccttatggggcgctgcacttgcagtaaatgcgtcaattctgactgaccttgtaggcaacggaggcacgggtcgcagttcattgctgtaagacggcaacgcttgcaaacgtagtctgtatcctacggtccaggcggatggaatcacggcgacgtaaggaaacgtcgccgttattgaaccttacttgccgctgacgctaacgccgtagacggagttcaagccaa

SEQ ID NO: 581657 - DNA, 738 bp, Homo sapiens
ccagcgcgtgggccccccgtctgctccaggccgcgcgtgggcctgagtgcgggctgggtggcgctggcctgcgggccgggcggcgagctggtgggcgcgggcgtggcctggctgcagtccacgggccgggagacgggtgtgcaggtgtacaacagcctcatccgggaggaaggaaccccgtaatcgtggcgcacgccgaagccgtctcctggtatagctgtggaccaagtgtatatgagtcatgcgcaccttggccatgcttgctcgatagtgttagagttggatatcattcgaaggatcctaaccaaggcttatcggatgcagctatagtcatggtggatgggtattacgagatgtagatgattaagaatcatcaaacagagccaatgagatgaagtatttcccgccgcttcccgtcggccagctctttatgaggaagacgttcaaggcaggagcatggcgagccctgtaaggttctcccacaccacggtggtacctgagggtaaccgagaacatattccgtcagagtaatttcttgtcattgaagcgacatcatgtgctcgtagggaaccgcttagtatcgaacggccaaagaggcaatggtcgtacttcgagtctgacagtctaggaggcagaacacagtatggcaacgattggatcggcagtggctcccgtgggtccaagtcgggcagatgccaagcggcacctcctgacaaaggcgtcattgcccagtgactc

SEQ ID NO: 581658 - DNA, 296 bp, Homo sapiens
attggctactgccatctcctcgctttcccatcaatcatccatgtcagcctatggagcaacacaatgatcatcctagcaggacaggctagctgccattcttaggctgggcccggtgtttcacttttgtgattcccagcactcttgggaggccgaggcacgcagagatgacctgacgtcatcgttgctgcctacgttgtacaacatggtgaaaccccatctcgactaaaaatacagaaattagccaggcatggtggcaaacacctgtaatcccggctacttgttcggttgagcggaga

SEQ ID NO: 581659 - DNA, 115 bp, Homo sapiens
ggatttgctggtgcagtacaactaggcttaatagggactcgaattcgagctcgaattcgagggaacattcaccatcattgatcattttctgggccataaaacacacctcaacaaa

SEQ ID NO: 581660 - DNA, 966 bp, Homo sapiens
  misc_feature (966)..(966): n is a, c, g, or t
gtgacgccggtgcagcgtggggggcccgggggccctggtggccctgtggatggggaaccgcggtggcttccgctggaggtttcggactagtggcatccggggccggggtcgcggccgtggacggggccggggccgatggccgcggagctcgcggaggcaaggccgagtaataaggagtggatgcccgtcatcatagttgtggccgcattggtcaacggatcatgaagatcaagtccctggcagcgagatctatctcttctccctgcctattaagtgatatcagacgatcattgatttcttcctggggtgcctctcctcaacggattgagcgttttgaagatatatagccaagtcgcatgaatgcgagacccgtgcccggccagcgcacccagtgttcaaggcattcgttgctatcgtgggacctacaagtggcctcaccggatcaggtcgtgtgagtgttaatgtgctccactggagagtgtgcaccgtcatccgtgtggccatcgatcctgtgccaagctctcacatctggcccccgttatgcgcagaggctactgggggaacaagactcggcaagccccacactgttccttgcaaggtgacatggccgtttgtggctcttgtgctggtacgcctcatccctggacccaggggcactggcatcgtctccgcacctgtgcctaagaagctgctcatgatggctggtaatcgatgactgctacacctcagcccggggcttgcactgccaccctggggcaaccttcgcccaggccacctttgatgccatttctaagaacctacagttaccttgacccccgaactctggaagggagactgtggttcaccaagtctccctatcaggagttcactgaccactcgtctagaaccacaacagagtctccggcaggcggactcaaggttccagtgtggctacacatagggttttatccacagaaagtaagtgan

SEQ ID NO: 581661 - DNA, 515 bp, Homo sapiens
caggatacgtgcaatctggatagggagagcgaaagctagaccgaaatcaaagaaatgaatgttcaaaaagcgaaacttgttaccgaattaacaaacctaataaagatatgtacttctatgcatatacaaaaagtagatttaattctccaaaaagctacagtgatctctgagaagatcgcattagaatcagattatatggcagcatcttcacaactccgtcttcagaagcacattttcattgaattggatgaaaatagacagagattattgcagaaatgcaaggaacttatgaaaagagctaggcaagtatgtaacctgggtgcagagcagactcttcctcaagaataccagacacaagtacccaccattccaaatggacacaactcctcactccccatggttttccaagaccttccaaacacattgaatgaaattgatgctttgttgactgaagaaagatcaaaaaattcccccttcacgggactgaatcctacaattgtacgggaatatgcaaa

SEQ ID NO: 581662 - DNA, 163 bp, Homo sapiens
gctaagtttataagaagggcaagacttgtaggccctaatctatgctgtgctagtgctattgggcaagagctgacacaggccaccgaacaccaggcgctctaaacccaccgcatccacctcctagaatttagtccttcagaagcactcccttgtctgtgcaacg

SEQ ID NO: 581663 - DNA, 236 bp, Homo sapiens
cactattgattggtccacttgggctgttaggagttcagtaataggtgttgtgggattaaacaaggtagtgcttgtagaacccgagcgcttgctaaatagagtgggctggtttaaggcctactatgggtgtaaaatcttttacgtctctctacaaggattgaatcgctagtgtccaaagagctgttcctctttgcgactaaccacgtcaagtatcacaatggcggtttcatagaggt

SEQ ID NO: 581664 - DNA, 162 bp, Homo sapiens
  misc_feature (115)..(115): n is a, c, g, or t
  misc_feature (133)..(133): n is a, c, g, or t
tcaggtatgtgactaactcttctatgcccagagctggaaggcggggtcccctaactccctgggtgcccacctgcccacttcaaccatttgtggccccttcctttccttacatcantttagatgctgttccagnggctccatcgccttctccctgttttctcc

SEQ ID NO: 581665 - DNA, 211 bp, Homo sapiens
gaagacgacagaagggggagtccgccgccaacgcgcaggtgctagcggccccttcgccctgcagcccctttgcttttactccgtccaaagttaacatgtcactgaaaaacgagccacgggtaaatacctctgcactgcagaaaattgctgctgacatgagtaatatcatagaaaatctggacacgcgggaactccactttgagggagagga

SEQ ID NO: 581666 - DNA, 331 bp, Homo sapiens
  misc_feature (33)..(33): n is a, c, g, or t
  misc_feature (38)..(38): n is a, c, g, or t
  misc_feature (46)..(46): n is a, c, g, or t
  misc_feature (60)..(60): n is a, c, g, or t
  misc_feature (64)..(64): n is a, c, g, or t
  misc_feature (101)..(101): n is a, c, g, or t
  misc_feature (103)..(105): n is a, c, g, or t
  misc_feature (109)..(109): n is a, c, g, or t
  misc_feature (112)..(112): n is a, c, g, or t
  misc_feature (116)..(116): n is a, c, g, or t
  misc_feature (231)..(231): n is a, c, g, or t
  misc_feature (234)..(234): n is a, c, g, or t
  misc_feature (238)..(238): n is a, c, g, or t
  misc_feature (280)..(280): n is a, c, g, or t
  misc_feature (296)..(296): n is a, c, g, or t
  misc_feature (301)..(301): n is a, c, g, or t
  misc_feature (321)..(321): n is a, c, g, or t
ctcgtgcgaagcaaattggcaggtaatatttcntaccnaaatttantttttttactttgnttgngaattataatgatatgccccttttctttttaaatcantnnnaaantantganacacagtgaatttgtagagtgggggtatttgacatattttacagggtggagtgtactatatactattacctttgaatgtgtttgcagagctagtgtatgtgtttgctctacaagnatnattngctgttacataacaccccaaattaactcccaaattaaaacanagttgtgctgtcaatncctcnatactgctttaccttttttncctggatatc

SEQ ID NO: 581667 - DNA, 371 bp, Homo sapiens
gcgcatccattaccgtgcgttatcatcttctttctaatgcatacggctttaaacttttactttctacctttttgaatgctatacttttttgtaaaattttaattaggttaatgcattgacattgttcacacattcaaacgatggaaagggtgagtgtggaggtttggttaccccactttttccagccatgctgttgcccttctgcagaggcttctagacattttcagatgaatgagaatcctttcagaaataagtctctgcaaactccagcacacccatagtgctagggtgggtcttagtacaatgtctgcagggtaagcacactgttttgcactccaccacaattcacttccacaatatttcatagcaga

SEQ ID NO: 581668 - DNA, 440 bp, Homo sapiens
  misc_feature (207)..(207): n is a, c, g, or t
  misc_feature (227)..(227): n is a, c, g, or t
  misc_feature (240)..(240): n is a, c, g, or t
  misc_feature (245)..(245): n is a, c, g, or t
  misc_feature (286)..(286): n is a, c, g, or t
  misc_feature (290)..(290): n is a, c, g, or t
  misc_feature (292)..(292): n is a, c, g, or t
  misc_feature (296)..(296): n is a, c, g, or t
  misc_feature (314)..(314): n is a, c, g, or t
  misc_feature (321)..(321): n is a, c, g, or t
  misc_feature (328)..(328): n is a, c, g, or t
  misc_feature (331)..(331): n is a, c, g, or t
  misc_feature (335)..(335): n is a, c, g, or t
  misc_feature (339)..(339): n is a, c, g, or t
  misc_feature (367)..(367): n is a, c, g, or t
aacgtcctggggagccggggcgtatcaaagagccttctctctgggacaaatcaaatggcaggaagggtccatacagaaaagaacgtctctgaggtccttgcgtttttaataaaatggtaagagtctttcgtgtggggcctcccagctgggcaagccttgattggccaggagtccaggtgcccgaggtgtgacctcagcccctcgccntgagcaggggcgctgggcanaagcctaggcccncaganaggcccgtccgccccatcacacgctcatggtcatccctggngagnantggnccgccgcggtcacggtcntgctctngccgccncgnccgncggngcctgccgccagccctccgcccgacccnccgcggggggggagtcgacgcagtcgctaacgctttcgctcgggaacgggtgcaggaaggtgccggcggccgc

SEQ ID NO: 581669 - DNA, 454 bp, Homo sapiens
atcatctacagatccccatcatggcgtcctggagctactatatgtttctgtggcctccttctgtcgtatcttgtatactgttgtataagcaaagatcatatagtctgttacccttcatactgacagtcctttcacttatcttaaaacagctttcacatcttgccttaatctgtgtttacattgtattcatgtttggaaaagtcagcgcttaaattataaaggtagaacaatttcatggttttagtttcattagagaaaactatttggtttattgtctttaaacaacagaagtcacttttatacattggttcttgagattcagttctaatctgctggtgtgaaagtagcacaaattactgatctaatattgaatgctttggatactgacctaaaagtcaggtaagtatcttttccagaacttagttgtcttttattttccttttttacattttta

SEQ ID NO: 581670 - DNA, 506 bp, Homo sapiens
acactgattcctttctatgctcatgatactttcaccaagatagactgggttctgggatataaaacacgcgatatgacctctaaacttaatgaaacgagactggaagtcagtaatagtatccatagggaattctaaaatttggttattgaacaatacacttctaaaaaatctgtggttcagagaagaaatcaaaagggaaggtaaaatgtttcaaaataaataataataatataacagcaaaactggtgggaaatggctaacagtgctcggagtgaaataatacagctttcaatgtgtctattaaaaaaattggggagatggggagttactcctgaagggtatgcagttcctttctggagtgataaaaacattctaagattgattatagtgatgattgcatagctatgagtatattaaaaaactactgaaatgtagactaaatgggtgaattatatgaataatcataattactaattatgtgatttgtgtctcgttaaagctgtcaa

SEQ ID NO: 581671 - DNA, 665 bp, Homo sapiens
  misc_feature (318)..(318): n is a, c, g, or t
agcggggtgttgcagacagagccgcgtcgggtgtgcgccgctgcctgcttgttgcactctggtcttacgtcggtcaaccagcagcaggcaacgatcgaagggtccatgatcgcgagcatccggactcgccgtccatcttcaggagatgatacacgagaaaaataaaatatactctgagggaagattgtacctgccagaatgagcacagagtatttctttaacgaagacgatttgtcaagaactcaatcaaaatatgaacggttaaccaaccgtgtaacgagattgtgaagtgtagctgcacccagcaagagtagtggnaccagcagctgtcttagtagcttgagagcgaaggtactagcatggaaccgtggtgcccgagggcgccgcatccataacaggatgtcctcgctgtcacgtggcagcactaggccatgaatcacatgtccgtactatctcttgtccctaggacatccttgtccaagagatacctgttcaatagacctagttggacgcgtagtctagggaagtttccaagatgcgaagaggttgaactagggcgtctcctgcatgcgtgtgcgcaggaagactgtaccgtgttgacttgagttcatagcctgagtcatgaagtgagtttgactagtggttattgcctgaatgccgatcga

SEQ ID NO: 581672 - DNA, 152 bp, Homo sapiens
tcctatactctccatcagatgacatctaagatctgaattccgcagatatgatgccaggctggcagagaaagatgatacagttttcgccagatagcgggtttctatacattgacctttgttggttataagtatactgatgggagtaagatgcg

SEQ ID NO: 581673 - DNA, 1020 bp, Homo sapiens
  misc_feature (22)..(22): n is a, c, g, or t
  misc_feature (65)..(65): n is a, c, g, or t
  misc_feature (195)..(195): n is a, c, g, or t
  misc_feature (201)..(201): n is a, c, g, or t
  misc_feature (212)..(212): n is a, c, g, or t
  misc_feature (254)..(254): n is a, c, g, or t
  misc_feature (263)..(263): n is a, c, g, or t
  misc_feature (293)..(293): n is a, c, g, or t
  misc_feature (301)..(301): n is a, c, g, or t
  misc_feature (307)..(307): n is a, c, g, or t
  misc_feature (345)..(345): n is a, c, g, or t
  misc_feature (396)..(396): n is a, c, g, or t
  misc_feature (400)..(400): n is a, c, g, or t
  misc_feature (441)..(441): n is a, c, g, or t
  misc_feature (492)..(492): n is a, c, g, or t
  misc_feature (546)..(546): n is a, c, g, or t
  misc_feature (577)..(577): n is a, c, g, or t
  misc_feature (591)..(591): n is a, c, g, or t
  misc_feature (606)..(606): n is a, c, g, or t
  misc_feature (610)..(611): n is a, c, g, or t
  misc_feature (681)..(681): n is a, c, g, or t
  misc_feature (796)..(796): n is a, c, g, or t
  misc_feature (798)..(798): n is a, c, g, or t
  misc_feature (832)..(832): n is a, c, g, or t
  misc_feature (840)..(841): n is a, c, g, or t
  misc_feature (906)..(906): n is a, c, g, or t
  misc_feature (967)..(967): n is a, c, g, or t
ctctcaatactacatcctgctnatctgacggacgcttgtgaccgacatgccgacacacgggagcnatttgcgtcctcacgcctgcccatgtccatcatcatcgtgggcgtggcaacgccgacttcaccgacatgcaggtcctgtacggcgacgacggcgtcctgcgctccccacggggtgagcccgcgctccggnacatcntacagttcgtncccttccgggagctcaagaacgcatcccctgcggcgctggcnaagtgcgtnctggccgaggtcccgaagcaggtggttgantactacanccacanaggcctccccccaagaagcctgggcttccctgccgganatgccagcccaggctgcacaccttgatatatgtggagggcgtaggttgggngcantgaggaatggttccgtacagcctctgtctgcaacatgcttngggtcccttaagctccctccgacctcccagaagcctccagtccccaccagnccccactccctatgtcctcctgggatctctgctggcttgtggcccttctctggngcccccaaggccgaagggtgacaaaatacangcccccatgcctgnccctgcctgagccangtgnnttgatggatgtatatcatgagggacttggagttagctgggtagttcatccacgggatgacctctgccccnatgagattgtgtctgtgtatctgtgggtgtctctgctttgcgtctaactcttttgtgggggagggccagcaaggcagtcccccacgcccgagaaagcctgggggacccagacacntntccccacagtcaaagcctggggacccagacatcntttccccnnagtcagcctcctgtccctgctggtgcccccacacccacctaccctgtgctttttgccgtcgggcntctgcaccgtggttccatgggttctgcgggggtctgcgggggttctgcctggcctgtttgngtttctgccggttggggctctcaggagtaattaaagtgttcaccccttttcct

SEQ ID NO: 581674 - DNA, 692 bp, Homo sapiens
  misc_feature (323)..(323): n is a, c, g, or t
  misc_feature (346)..(346): n is a, c, g, or t
  misc_feature (358)..(359): n is a, c, g, or t
  misc_feature (368)..(368): n is a, c, g, or t
tcttaaaatattccttgattgtgctgtgtcaaagcatcagaatgggacaaagctgattctggagaaaggatgtacttgctgcccttcagagcctgagctccacccatgctggataagtcagaatgctggcactggaagggcccttaatggacagctcgtccaactccctcatcttacagatggagaaactgaggtccggagaaactgaggcccagataggagcaagacttgcatgcctagatccttcttgtgtgcctcttcctactgcaagctgagacccaggtccctggtttggctgtcgtggctgcttgtaaagtgaaggngcttctgtgactgaatgactccnacaaatgtccanntccctaatnctttcctcaccaaagaagatggcccttggggacagcagcacttgctgagcaggagcatgagtcaggtgaccacctcattccagtttgctcaggactcgccctgttttagcactgaaagtctcacagcggctgggcatggtggctcacgcctataatcccagcacttgggaaggccgaggccggtggatcacttgaggtcaggagttcaagaccagcctggccaacatggcaaacctcgtttctactaaaatacaaaaattagctgggcgtattggagatgcctgttatcccagtactcggaggcgagggcagaaaacccttgaa

SEQ ID NO: 581675 - DNA, 129 bp, Homo sapiens
gaagaagacttgatagaagacttgtaaattagtcaaaaaaggcctatcatgaccccatgctgaaactctccatgtaatgacagaacaacgagttgaatcaacattgtttggaacactggtactctctag

SEQ ID NO: 581676 - DNA, 427 bp, Homo sapiens
  misc_feature (20)..(20): n is a, c, g, or t
  misc_feature (74)..(75): n is a, c, g, or t
  misc_feature (77)..(77): n is a, c, g, or t
  misc_feature (267)..(267): n is a, c, g, or t
  misc_feature (279)..(279): n is a, c, g, or t
  misc_feature (286)..(286): n is a, c, g, or t
  misc_feature (381)..(381): n is a, c, g, or t
  misc_feature (386)..(386): n is a, c, g, or t
  misc_feature (416)..(416): n is a, c, g, or t
ccctgctcctggccccttgncggccagggatgtttctggccatgggtcgctcccgccggacagcggcaccgagnncntctctagcccggcagatgaaggcgacggcggcgccgaccttggatgagattcaccgcgagctgcgcctcagggatccgcacgaccccagcccgacccaaacgccgagttcgaccccgacctgccagggggcgacctgcaccgttgtctggcctgcgcgaggtacttcatcgattccaccaacctgaaganccacttccgatncaaagancacaagaaaaggctgaagcagctgagcttcgagccctacagtcaggaagaggcggagagggcagcgggtatgggattctatgtgccccccaggcngcttngcagtgccacgggaagtttccattgaggtnccttgagatgg

SEQ ID NO: 581677 - DNA, 102 bp, Homo sapiens
gcatcatgaactgcctcctcctccctaagctggtccagtgtgtggatgcctttgaagaaaagcgccaacatgtcatgctctgagatcggtaggaggggagtc

SEQ ID NO: 581678 - DNA, 542 bp, Homo sapiens
atgatttatcataactcttgtggctgctccatggagaatatgcaacacagtgagagaaacaaggtcatttcatgactttaatgaagagaaggacatcccagtccatggatgtccacatgatgtatgcagccctgtgatcttggacattcctatcaattacagactgtcattaactataattgtggcactgatgacattgatacccacactgcataggatttggcgcacagaaaagagcgggtgagaaaaggtgttggcctatacccatactcactcccaatggacagcaaatttagctaggtgaccttgatcctggaacattggaatggagcccaatcaacactgtttctaatggaactccatagatctggccaatgcagaatgcctggtttcaggaaatctcgatccaaaggagggaaatggaaaaaagctgaacattggtggaggaggcctaggctacagggagcggcctggccttagctctgagaacatggatcgaggaaataacaatgtaatgagcaaatataaggcctacaagcctt

SEQ ID NO: 581679 - DNA, 179 bp, Homo sapiens
ggtctcaccacatgggtcatggtgggtctcgaactctggaccttgtgatccaccctcctgggcctctcaaagggcggggattacaggtgtgagccatcgtacccggcctcgccttattttatttttcaattttttaagagacaggttctcactatgtggcccagacgggtccaactccg

SEQ ID NO: 581680 - DNA, 445 bp, Homo sapiens
agcggggggaagtctgagtggcgctcgcggcggccgcgccagtcgcgtcccccacccaaccccacccaacggctcgggggcaggagtaagccgcggacgccgactgggccccagggcggtcatctggggccaggggtcccgcagcccagcgtttcccgaccgacacccatcatccgacacagcgacccgcggcaccttattacctccacctggcccaagggatccagtcaggttcggacccagaaaaggacgggcctgtgccggacgcacgggatggggggcaaggcacatacaacgtcctgcatggacggtcatagccgggtcccggcgacggttcacaaaaaaagaccgcccattacgggcataggccaagcagaagcaaacagaggggcagcaggcaacgtgcaaccggcaagggcaagataccaacccaagtgtaccatac

SEQ ID NO: 581681 - DNA, 1272 bp, Homo sapiens
gcctgtacgctgcttcagttgtggcaagatcgtactgacaagcaagtgggaggcttacctggggctggctgcaggtccgagtacaccgagggggagtgcgctggatgccctgggtgcttgaagcgctactgcttggcggcgggcatgcgtgctggcccacgatggaccgtgatcgagaagctgctcaaattatgcgagccccatggcatgaagctgacgccacgcgtggaacctgacgtaccggcgttgtgctgagcactatgggtcccgtgagtcgatgcatggcacccggaagttacacgaggtcgtgatggacatccgggagtcgtgggcgtatatggtcctggactcgcagtagtagtgtgatattcccatagcgctccactctggcatagggaaccatccatggtaaagatggtttctgtcgagcaacccaaaataataataccatagaaagacacaagcatcggtagtgcacctcgtaaatgttatgagtgtggtctggattcccaagaggcgggtaaatttgtagctagttgtgccctcgagttggccccagttggcgtggttgcgcagtagatccctggagctgttttgcatgcgcgatatgcgagaaaggagtggagtatgaatatcttgcgcgcgggaaatgttccaggataatatagagagaacgaccttaggagtactttccagattatgttgaggcataagaaggtctccgaggggttgtataaatgccggtgggtatatttttagcgagagaactttgggggagaaaaaattgttaagagcaaggagcgccaaattcttttttatttccaagagggctacaagagatgttggtttggaaaaagccaaagccgcgccaagaagattccccatggagacagcgcgggaggttaaagttgattcccagatggggagttggaaaaacggttaaagtttaggggggagggtggggagacgcataagacgttgtcaaaaagaaggggggcgaaaaagcggttaactggcgaaaggtgatgagggtgaggacaaaggtggagcgaaaaatgggaaagtgcgattataagaggagaatgcggaagcaacaattttcaagcgtatgggagatgggatgaggggaaggaaggagggcttgggcttgtcattgtgttatagagggaacccccaggatgattgagacgagtgagggggagagtttggccgtttcagttggagcacttgggagattgacgatttggagatcgaagaaggaaagcattaaaa

SEQ ID NO: 581682 - DNA, 307 bp, Homo sapiens
ctaatatgaagcaactacttaaaaaaaaaaaattgggaccaggcacggtggctcatgcctggggggccgaggcaggaggatcacttgagcgcaggagttcgagaccagcctgagcaatataacaagacctcgcctctacagataattaaaaaaaaaaattacctgggcatagtggcacacgcctgtggtctcagttgctcgggagaccgaggtgggaggatcgcttgggtgtggacagtcgaggcttcagtgagccatgatcgtgccactgcactccagcctgggtgacagagcgaggcctcatctc

SEQ ID NO: 581683 - DNA, 228 bp, Homo sapiens
tctggtcttgagccgtcgtatataccacggcttgactgtgcctgcagctctaaaccggaaagagtgatcggcaagatcaagcagttgaccagcggcggatacttccgcgttgatcagatcgccagcttggtaatcgccgtcttcaagaggtaactccatgacagtacgaccagctgcaacgtaagcttaagcgaagtgacctgcttgagcagcagtcacgcgcgaaga

SEQ ID NO: 581684 - DNA, 244 bp, Homo sapiens
gtaacccaggctatcatccatagtagaacctttttgagccctggatacgaaccttacaaaccctgcaacagctatatcaactacatgtatgtaatattctaaatacttagctgtcattttcaaccaatgttcaccagcatcttcatccaagtaaactctaccttaaaaaaaccactatctttgctagtacataagaagcaattatacatccatcaggtttcatccatgaaattataacaattag

SEQ ID NO: 581685 - DNA, 571 bp, Homo sapiens
gaaggagactgcccattagggtccacagtaatgctctttaatgctcgttctgcggaagtttgttttccctagaaatacccacgccatggttgttcctccgtcccgacttgctttcccgtgccccctcaggatgtgccagctcgaccaatcgtcccactacaggaggggtagttcctctggaaaaactcccccatgcggtcaccccctcaagggagaaccacttgactgactttgccctctcggtgggctacgggccacgggaggagccaaaccactaatcagttcactgggttccttgaaacccgcacagtaggccagctgttgactgctctaaggcttacagtgtacaaagtctttagatttctcaaacaggtgggcaatcattattgaatactgttctgtgaaccctgactgctagttctgaggacactggtggctgcgctatgtgtggccatcctccatgtcccattcctgtagcctgctctgcgttagacagacggacagacgatcacgccaagggagtgtcctcacgctgtcgccgcgcgctaacttcgaagatgtgaaactcaga

SEQ ID NO: 581686 - DNA, 537 bp, Homo sapiens
gcggagttggacatcgggcagcactgccaggtggagcattgccggcagcgagattttcttccatttgtgtgtgatgattgttcaggattattttgccttgaccacagaggcagggagtctcatggttgtcctaaggtgactttaatcattgagagactgaggacagatcaccatacatcttacccatgctctctcagagactgtgctgagagagaccttgtggcagttatatgtccttattgtgagaggagtttgcccctgagacaccgtcatcagtaagatcatgagtgtgaaaacttggaaatccaaagcctcgaatggctcccactcagaaacttgttaaagacattattgatcccaagacaggagacacagcaagtaacgatggaaaggtgccaaaaatagtgaacagctgcaaggttgcattatgaaattaagatgcatgctgatggcgatagtcatcccacagacagagagatttactttcaggtttcttccctaagggggcaagagagagcaaccattgttctttgcacc

SEQ ID NO: 581687 - DNA, 144 bp, Homo sapiens
caaggatggtcctcagctgagggtgagaggcaagaccagccgggcaacatggtgaaaccccatctctactaaaaaaaaatcttaaaataacccaggagaggtggcacacatctgtagtcccagctactcaggcaggtaaggtag

SEQ ID NO: 581688 - DNA, 84 bp, Homo sapiens
gagaataatggccggttggcccgggacgagtggaatgattaatgatgttttgcagcagttttctacgtctgaaattttttatgt

SEQ ID NO: 581689 - DNA, 154 bp, Homo sapiens
gactggagacaaactcacagaccgcgacattattgtgttgcagcggggcggtaccggtttcgcgggctccggagtgaagctgcaagcggaaaaatcccggccggtaatgcaggcctgagtgtgtgcgggagaccaaataaaccggtttgggtgg

SEQ ID NO: 581690 - DNA, 360 bp, Homo sapiens
  misc_feature (1)..(1): n is a, c, g, or t
nagaggtcgtatgcacgaggatgattccaggttcgtcgcaggcctccatcaccactttgtcagcagcagaaccggagggaggcggaatgtacggcacaacaatccttttaggtctggctacgttaacctgggaaggggagaaggcatcagagctgatagaaacttcagtcagtttctcaacccattccttcttctctggctcagtgagtaactcagggacttcctcaaacagtgccttccactttatcaaatcttcatcctcgccaatggttccagtcacatattgatcgatggcattggagatttctgctctcttcactcctgttttaaacttcatcgaacctctgggtaccgagctcg

SEQ ID NO: 581691 - DNA, 231 bp, Homo sapiens
gctctagaggatccagtaaagccaatcccccgaccatcgacaccaaaatcagagattgctcaagtcccttatgtaaaatggcatagtatttgcatgtaacctatgcacatcctcatgtatactttaaaccatctctaggttggttataatacctaatacaatttaaatgttaaataaattgttatactgtattttaacattttatttttaattgttgtatttttttattgt

SEQ ID NO: 581692 - DNA, 780 bp, Homo sapiens
tatcatgtctcgttaaatagccccagatatagtctgtgcagtccagtctgccatgcacagaggagaaattacagcacaatcacctgaaagagatgaggactattcatgaatttgtgaacttgtcaaaaggggaacgggaaaaacatctgtctgtagtaacttacactcaatagaacatatagtaactgacagattgacccatatatgaagatttattactctgctagggattatatgaaactaacctggtttatataaaggctttagttctgagaatatatggttggaaatgctgataatttatttgttattaagagctgttgtgacgtggaggaaacgtagttgtgaataaatgtataaaatgtatgcttggattgagtaatcagggacaaaatttatagttcataagtcatgacacagtattcgctcttttctctgaatgtctacatagagattcatcactgcagattacagaaagttcagtgtatactacaaagtctaattaaagataaaactcttttccaaaaaataaaaactgggtctctataaacactgtgtggacgcctcagcagccctaagagttttctacaccattttgtggagggcgtcgacccctcaagattgcagaagcgacagactgcgcgcaaagcacgccgtgtggcacacgttgtggactcacacgaataaaacagcccggggaaccggtgttcgacacatccctagggttccaggcggccgctgggatcgccacgggacgaggagcattgataccgccgtggg

SEQ ID NO: 581693 - DNA, 880 bp, Homo sapiens
  misc_feature (343)..(343): n is a, c, g, or t
ggtgggtgcctgtagtcccagctgcttgggaggctgaggcaggagaatggcgtgaacccaggaggcagagcttgcagtgagctgagatcgcgccactgcactccagcctgggcaacagagcgagactctgtctcaaaaaaaaaaaaacaaaaattagtacctgattgccggggttaggagagacacttgatagtgtattattttaatttcagaaatagttatccggggacctattgtgagcgtttgacgtttgagcccagtcttgaaaagggcatttataaacaattgatattaaagtgatctaagttgttcattagatttacgtgagagttaaaactttaancttcccttttgacatttgacttattgcattaggattattgtttacttattaattcctcctgtgacattaatttggtccttatagtaaagacaggcacaataattgtgaggagaaatattacgcaccttatttaattaggatttggggctcctcagactcttttaacttactttacacttctcttcaaggcagggtaagattcattttcctcgtggggctttcattaattcctttgcctttgtaaagaaggggcgcttggacccaaattggaacatttttaaggaattcttcctttcgtggcttgtgacagaatttctagtgaatttcacatattttactgggtgtcttgtgattaaccagagaatttactagggttgagactcagcgcaagggttttgggaaacaattacggacaaagatttgttctttccacgattttacaaaggttggtggagtagaaggtggtatttgggaaaaaatgaatttgccccggattgtgcctctttaaagcagggaaaactttgggcgattttgacg

SEQ ID NO: 581694 - DNA, 160 bp, Homo sapiens
ttgtcccacacctgctggatgaccagccctaaaggagaagggggagctgttagcgcatgttcagcagcgtggtatcgtaggctcccactttgtctccagtcttgatcagctgcacatcactcaggattacaatggtgcccctaaagattgcttgtcgggg

SEQ ID NO: 581695 - DNA, 227 bp, Homo sapiens
  misc_feature (59)..(59): n is a, c, g, or t
accacccacttccaccccctgtagtgttcccacccttggattggtggcccccaccttgngggaggcctccccatgtgcctgcgccaaaagacagacaaagaaggctgcaggagtcttttgttgttcagcagggggctttgccctccctccttcctttttgcttttaatagccttggtacatggtacacccccccccacctcctgcaattaaacagtagcttcgccca

SEQ ID NO: 581696 - DNA, 799 bp, Homo sapiens
ggcatggctggtgtgtgctcgcctttgcggctgtgtgtgccctgtcgctgcggatgtcggcgccgccatgcagcgccggtggcccggcctgatgacggcggctgtgcctgacatgcgatgccgtgacacagaccccgaggaggagcgcatctgaggctatgcgcctggggtctgtgtggtgctggcttgtgctgctggtgcccctcgcctgcctgccccctgctgctgctctgctgcttgtgaagctgcctgccctgagctgctggtggagatcttctgctgtctgcttgcctgtggcactggacctacccagcttggcccaggtctgcacgaggctgggctgaggtgtgtctgttggccgggcagtggccccccgtgtgatgtcccatgccaatgccctgcccagcccagggcatgatgtgcggccagcaatgggcccagatgggacacctggtgagtgattggtggctgatgcctggtgtgattgcctgtagctgctgtgcctgagcaagcctgcccagtgtgtgtgcatggggcatgcctgttctgtgcttgccctgtgggcgtgagctccaggaatgaggactacccccgaacctgcagtgatgtgtttttatgtgcacaggcctcatcgctgggccacgtgcttcaccagccctgaacgcaaccccggggtcttcatccttcttctgatgaggaccgcttcgggtacgtcttggctggagctgaatccttcagcctgtacaggcgggtcaagccacttccgggacggcagatatgcgtacccaaagcctcgatg

SEQ ID NO: 581697 - DNA, 139 bp, Homo sapiens
ggaacattcatggctgaggaaacaagtgcaaaggtcctgaggtatggctggagcagagtcagcaaaggcaagagtgatagcatgatgaatgcctgcactccagtgcaagggttgtatatgaccagtggtgatggactcg

SEQ ID NO: 581698 - DNA, 308 bp, Homo sapiens
ctatgcaattaatgggccacattatgcccaaagaataagtgctgccctttgtctcaaaagatgagatgactgacctgacttcaataagctttgtatatttgattgtctggtgggacttagagcagtggtcgaagtctttttcaatgtagtgaactcatacacaggttcaaatgaaatgagataatttattccctgtagatgctgctgatatgaggtaatactaactattttaaaaggaactgacatcaagtaatgggaacttagctagtaagagaccattcactcttgacctcataacaatgaatggt

SEQ ID NO: 581699 - DNA, 101 bp, Homo sapiens
tagaggatccccctgctatgcattcttcttaagaccaacacactctccatattacaccccgtattctccatgattaataaatgtctgatggctcactgggt

SEQ ID NO: 581700 - DNA, 742 bp, Homo sapiens
gggcctgtaaaaactatgatggtgacgtgcagtcggactctgtggcccaagggtatggttctctcggcatgatgaccagtgtgctggtttgtccagatggtaagtacagtgaggaagcagaggctgcccagcgggtactgtaatcccgtcactaccgcatgtaccaggaacggacaggaggacgtccaccaatcccatggcttccatttgtgcctggagcatagggtgaagcccacagtagcagatagcttgtataacaatgaatagagcttgccttcgtttgcaacatgctttggacggatacgtctctattgagacgagtgaggcgtggcttcatgaccaagtgacttggcatgcttgctttaaaggtttacccaatgtgcaacgttcatgagctgacttgaagtacattcgaggttcatggatcaacttggagaaaaccttgaagatcaaagctagctcaggccaaactttaagttcatacctgagctaagaaggataattgtcttattggtaactaggtctacaggttgtacattctgttctgtgttgacactcaaggtagtaaagggctcacaatcagatctgtgctcaattggttgtagaacgccagagtgtatctttctctatgaagttctacagccgtttggtcttatatatacagttatggccgaccttcgctgaacattggcaaggcgactttgttacaatttcctatttgatttctagtaccaggcctagg

SEQ ID NO: 581701 - DNA, 214 bp, Homo sapiens
ctttccagcaccatccatgttaaggggcagtgagagcacccacattgtttatgcccgtgggagatgggcagggtaggctccacccatgcatccatcccataccaagggtggtttgacatcctcaaaagcatccgccagggcgtatggaacacagtgagcaaatttttcagttagttttttgaatcaccaggaaaaggagcagaaaaaaaaaaaa

SEQ ID NO: 581702 - DNA, 162 bp, Homo sapiens
acatcttacagcggaccccaggtaccgatccgtggggccccttgctctggactccagtatctgtcgtcgcaggtcgctccctatgtgcctatgtcccttgctcggggccatggagacactgcgtgccagtacggtggcgcctcttgtctgaagagagggggt

SEQ ID NO: 581703 - DNA, 406 bp, Homo sapiens
ctagaggatccacccgcatctggggcttggttgaaggagctgattaacagcgagcacgccattgtaccatttcatccagaagctgccctctgagcttcaaggcagcttactgagcgacaaggccaacaagaggctggcctatttgacttaccaggatatccgtgctgtttgcgactttaaggagcagaccgtgattgccgtccaggcccctccgtcggacgaggactgtaagtgcccgacagggatctggggcctacctgtcgatatatctcaggatctcccgatggcccatctaagtctacctctgcccagagcaggtgccggagccggtacgtccttccgaggagcctctcccctctaccttcatcctctgcccgcgccctgtctctgacatgctcagctgcgg

SEQ ID NO: 581704 - DNA, 1648 bp, Homo sapiens
taaccataaaaggggcctattttttttacaacccaaacggcccccctttgtccaatggggggcaaaaaatacccatggtggtccaacactctcagctttggcttgggttttaaaatactgggggaaaataacccaacaaaaaaagtggtgttatttttctctctctattgtggtttctctctttcttctctctactttacgcggggagtgtgagatcccccgagggcccttctcgagaattcacttcgtggggagacacaactctgtggactattattcgcgtgtgtgagagcgccaacgacacacaacgccctgtgggagagagctttacacctcagcaaaataagagggcatgtgataacagacactcctccagcggtataattctccgcgagagagacaaacgcgccccagagagtccactcttctctgtctctatataaatctctctctctctctattctccccaccacacctcgcgcgcgttatatttctgtgtctgtgtagagagagacccatatatatatatagaggggggcgcccctttctctgtcgagaaaggagcgcgcgccggcgctcctctatcttctttctcgctgtgtgtagtgtctgtagtgtgagtatcatcgtgctataatatatcatatgtgtgggcgccaaacaaacgctctttctctcccacaaagatataaaaaaagagctgtgtggggccgcccccccacgcggggggggggggcctcccccttctctcgtagagacataataaaggggcgcagtcctcacactatatattcactctccaaacccaccacacaagagcaaaacagtagtatatcactgcttctctactatgtgtggagaaaaaaatctcttctgctgcgggagagagagagagagagagagacgcgttgggcggggggaggagagcgacacctcctactccaaaagaaaaccatgtggtggggtgtctctcttacccccacacgagttgggttgtgtggcgggagcgtgagagagggagggaggggcaatcctctctgaagaaacaactgggtgcgagacacggcggcggcgctcaaaataaacaaaagagggtggccccccatcaccaaaactcacgccccgatagacatcccctaagaaagaagccgactataagttatagtcggcagacaacaactaacattacgagcaaacaaacggaggggaggggaggcaccacactataacgaggcggcacgacaccgagagaccgcgccccctcccatatttagttggtcgtgcgggcggacaactaactatatgatggtgccgaaaggaaacaggagcggagagcgacgccataacattcatcgagtggtgcgaagtaaaaacaaaccgctgtgtttgtacgcaaggacaactacactcgcttgtggacaaaaacaaaccccctttcgtggttgaactagcaggaaaactactatgagatgtagattaagcactacacacggacggaaaactatgaagtaacgacccccgcccgccgcacgaacgaaacaccagcagcgatacccgaagaggaggtacaccctactagagagagtgggctgctccgccgcacacatctagttggggggatgggctcctcctatactaaatcccccct

SEQ ID NO: 581705 - DNA, 347 bp, Homo sapiens
  misc_feature (23)..(23): n is a, c, g, or t
  misc_feature (100)..(100): n is a, c, g, or t
  misc_feature (117)..(117): n is a, c, g, or t
  misc_feature (131)..(131): n is a, c, g, or t
  misc_feature (136)..(136): n is a, c, g, or t
  misc_feature (337)..(337): n is a, c, g, or t
catcccttggaggaccatgcctncaaccatggggggcatatcctaacatggtgccaggatccagaaaccagggaggggagcccacttggaggatgctcgncgtcttctcctccactntgggtcatacaganagganggagactaagaggaagcttctattctcacttctatcctgcctcagcctccagagtagctgggactaaaggcgcccaccaccatgcctggctaatttttgtatttttggtagagacggggtttcaccatgttggccaggatggtctcgacctcctgacctcgtggatccgcccgccttcagccttcccaaagtgctgggatnacaggtgtga

SEQ ID NO: 581706 - DNA, 270 bp, Homo sapiens
gggaggaaacccccccccagggaaccctttaaacccctttcccccccaaccccggtggttttgttttaaaataaaaatggggaaaaggttgggtttttttagccccgaatttttttgtttgtttttttgccatttcccccccctcttggcccaagcttctcttttagtagttttttttgggaaattgtccccccccccttaaaacccgggggggggggattttttaattttccccccaaaaatttaattaaaaaacctaatttggtttta

SEQ ID NO: 581707 - DNA, 1872 bp, Homo sapiens
  misc_feature (462)..(462): n is a, c, g, or t
  misc_feature (505)..(505): n is a, c, g, or t
cctgggacccgaaacccagacctctcccctacccgaacaccggccccggactccaccgcaggacccgggatccggcccagtcccgatctcgaccagaccgaccatggtcgtaccctatcaattacgccgacctgttcctgcggcagttgccgagcgaatggaggccagaaatgttctatgaaaactagccgaccatatccatgaggtatgaaatctcatgacgcgtatgattcagatgccgcgaggtatgctgacatagctctcgatgtcgtgaatcacgaatccattttgtcctagagtcgctcaaatgtcttgccttaatgcaccgaacgattccacacggaagctgatgtactatgctcgcgggaaccaacacggggaccttcgtagtttgttcctccatgatttcgctcatttttggatacacataatccagaagtaagaggagcacagagtataatngaaccttcttgcgaagcatataatagaccgcatttgcttttgnagacagatgagcgtctgtgagtgcaagttagtaacagagaacgaaccatccctctctaagaacaataatataagtttatccctaagtctggcactaagctttggcaagtatgagtgcgtactctaaggaactcttgagaacaacaacatagtacacgcttttgagagagaacaaattctaacatgacgatacgataaggtagacatgagaatgttccactgcgcctcaccaaaggaaagaggaacgaaaagccttagacccctcccgttgggttggtgtagctttgcgagcattagaataccaaatgctttcaaggccgaaggcccccgctttgtcaaaggcctagggcaaaggcttttgtgattttgggcattttcgctccaacttctttgggagtaaagtaataaaaggacctttgggcttttgcttgccaccccccattatgatttggtccttaggcctataattttccaaaagttcttgttgtaaaccccggacacaccctctgagaattggaggtctgtccgcccttggggagacgttagaggagacacagaccccttgtaaacttaaccttgggtcaaaggctttaggtgaaattgtgggataaccaaaaggagcgaacacaccagagcccaaaaagagggcggggaactccacgtgggggcggaagaaaacaacaccccatccttgggtgttagctccgcaccccccaatttagtttttgcccacgtccccttggtttaaccactttacgtggacactcataaccattattcctccagagcgcgcttttatacccaaggcatcaacacgggtttcactccctcctcacaggacataggggccaaaaagctccttcgtctccacaaaccctttggaaaacaacagcgggccctggatcaaagaaagtcctgtttaagacccaccgccttgttacccgcctttggttggaatacccaccaggcagagtgctgctagcaaaaaatccccccccgattctattgtcacgcggcgctcatcacacggggagaaaccccctggcttccagcttgttgagaaaccgatggagtgacgaacagttgtgtgatctcaccccgaacgagtgtagaggtgaccccctgataaaaccactgacaacaggaactggtcgaaccaacatagacaaggcgcccgcggcaccaccaaaagtaagtctctggtcatcacgggtaatcacgataaaccaggcgccataatacgacaccttgctgaaagacagaagctcagcaacacaagcagcgcgccacacctatgaacatattaactacggcatcacacagcagctaccactcaccacacacccagcgacgacagatccaccgtac

SEQ ID NO: 581708 - DNA, 126 bp, Homo sapiens
aactattctccgcgttttcttttcttagagtttcactttcctggtcaagcttacggatggttctgaaactcttagtgatgttctttttgaggaacaccacttccaagattctgcgggactgccctt

SEQ ID NO: 581709 - DNA, 342 bp, Homo sapiens
  misc_feature (128)..(128): n is a, c, g, or t
  misc_feature (239)..(239): n is a, c, g, or t
  misc_feature (282)..(282): n is a, c, g, or t
agggggagatcatgggactagaggattaactggacgttgcagcttcaccttacacctggagactcctaagccctccatctccagcagcgaacttaaatcccgagggagaccatggacggctgtgagcnttaactctgtgaccctagagactccagaacgcaaggctacctagtggtggcatgacatggtcacgagcctcccgtatgaactcacaggcttgagagctgtccgagaaccanacagtgaaccctctttctacttggagtgtacacaaagtatacngtgcgaggaccctatgaactgtgaacatagcggaaccccagtgacgtgcccagccgcagt

SEQ ID NO: 581710 - DNA, 932 bp, Homo sapiens
  misc_feature (1)..(1): n is a, c, g, or t
  misc_feature (103)..(103): n is a, c, g, or t
  misc_feature (519)..(519): n is a, c, g, or t
ncgacgccgcgagagggtgtctctgctgtgtggttcgagtgggcatagtgtgtagttgttgctggctgtggccgtgttcctccggatgtgcggctggggcatnttcgtccgtcgggaccgttccgctcgggttagcccgcccgggtttttaacaccccttggcgtcttttccctccactgccgtcccccgtttttggcgggaccccccacatctctgttgccaacctttacgaggtttcctgtccggctccgggcaattcccggttttccctttttgccctgcggggcagaccacgcccacctgttgttgaaccgcggtcccttccgcccccgtgcccgcccgggagtctcccggatctttacgccgcacacccctcccccagtttgttcactcctgagggccgctccccaagccccgcgtctttgcggagccaacagtttcatcagccgccctgtggggacaccctcgccctccctggggaccctctcctcttccaggcgggttgcgccgcggccccncttaactgcgaagagtcccttaacggttggcgtgggatttcacggcgtctcttcattccgcacctgaggggatcacctctctcgttccccctggtcgtgtaacgccaccactccctggcgcaccgccctttcacttgtctcataaacctgcgtctggcgtaggtcctaaaacaaggaccaatctctagcgacgacggggggccccagggttttctatgaagccgcgtccctcgtgagaacgcccacgctcgccctttgttctaccctctattgggtgtgaccgggcgcgctccgcggcgtccccctcggctgggcttggcacagaacagttcttccggcgcttaatttgggaacctttaaggggggaaaaccaacaaaaaaaaggtttccttttgaacccccgaacaaaaaca

SEQ ID NO: 581711 - DNA, 221 bp, Homo sapiens
tgtatgaccatcatagagtgccctttctcgctgagggatatcatcctctttgagaactaccctcccccttccctacaccccagaggcatacacatcccagatcaacaggacaggtaatgatcagcgctgcccatgtcccagaactcagtttgatgcccgcaaaatgcatgataccgaggctgggagcggtggctcacacctgtattcccagcactttggga

SEQ ID NO: 581712 - DNA, 190 bp, Homo sapiens
tatgcttgggtcactaaaattagaatagtgctgtttctgagatgtatccaaactggatgggcatatttgtttggcaatgtacaaaggactgtgggcctcgagagagcacagggcctcctccagggagcagctcttagcctttaggccacgacaggggctgttcatgtgacatgccccacaaggcgacatg

SEQ ID NO: 581713 - DNA, 481 bp, Homo sapiens
aattccattcctagcgtacaaggaagatccaaatggtcacaagcacatgaaaagatacttaacattattggtcattagggaaatgcaaagcaaaaccataatgaaataccacttcacacccaccaagaaatcgaaaccctcatacattactggtggtagtgtaaagtggtgtaactgcttgggaaaacagtcgggcagttcctcaaaaggttaaacatagaattagcgtatgacccagcgatttcactcctaggtaaatacccaagagaaatgaaaatatatgtccactcaaaaactggcattcaagtgttcatagcagcattatttatactagccagcagtggaaacgatccaaatgtctatcaagtgtggaacagataagcgaagtgtggtgtatttatataatataacatgcttgggcaataaaaagtcgtgaagtactgagatatgctacgctggaatggaatgggggtaccgagct

SEQ ID NO: 581714 - DNA, 274 bp, Homo sapiens
  misc_feature (68)..(68): n is a, c, g, or t
ggtgaataatagctcttcaaggcttgcaataaaaaatgggcttccacaaaactacattgcaaaaaatntggagaaaaaacacggatgtggaagaggtataaaaaagtgtgaagagggcacgagccctctaaagagattttgttcgtgtgagaaaagtaactcagagtctgacgctgttagtgtaattgggaaagtgtggagttatattctctaagtgggagggggatttacagatactctcactactctggggacctctaggagaatatagagt

SEQ ID NO: 581715 - DNA, 372 bp, Homo sapiens
ttttttttgaagggacagggtctcgctgtgttgccagagttggtcttgaacttcctgggctcaactgatcctcctgcctcagccttccaaaatgctggtattacaggtgtgtggcactgcacctggccagctttattttaaggcactaataataaagggtatgaaaaaagctaggaataagtcagatctttccagaaataaaagacaattttaaaaaacatcagttaacctgtctggcctatttcaacatctaaagaggatagagaatgtaaaagttttcatgcctacctgattcagctcttttccattctcccaaacacttatttccatgtctcagatttacatttcctcaaaaggcagtagagatttgga

SEQ ID NO: 581716 - DNA, 140 bp, Homo sapiens
gccatcatacatacatccttatgcatatcttctccagacagtgaacaacaggcagtcgggggaggcatctggacaccacacacatcatcagtctgattctccttcttctgtggttaacaaacagctcggatccatgtcac

SEQ ID NO: 581717 - DNA, 177 bp, Homo sapiens
ccggagtacgggggaactgtgtcagatcaaaactgaagggtcagcctgatggtactgctatggaatttttaaataagggagggttgtccagctttgatcctttgtaagattttgtgactgtcacctgagaagaggggagtttctgcttcttccctgcctctgcctggccccgctaaa

SEQ ID NO: 581718 - DNA, 257 bp, Homo sapiens
tgtctgcggtcgactctggcaggatcccctccctgtccagcctggtcctgccctccatatcaaaagacgactggccagagagaaaagcttgggaatggctttgaggtacacgatcaaagacgtctgcagaaatgggaaacgcaaagggttgaagagagggatggatgctattgatcgacatctcagaagatcctctgactgccttatggagaatggactggaaggttctagaacagaacagggaagctggtgaggga

SEQ ID NO: 581719 - DNA, 108 bp, Homo sapiens
agcccctgtgtaagaaacatgctcattctgtgaattttttgaaagtcagcagttcaggagaagagaaggaattttaagagaaaaaggaaatttaaaattactaattac

SEQ ID NO: 581720 - DNA, 124 bp, Homo sapiens
gcttttcattaacgaacgaggcagttcattaacccagcatggttagatctaatgcttattgctggcagcgtccacctgtccggagattctgttcagatctttttgtcccttctgtcgtcttctc

SEQ ID NO: 581721 - DNA, 197 bp, Homo sapiens
cttgactgacggggctggtgcagtggaaagggctctcagtccctctgtggggggggtggggctgcctcccgaggggctcaggagttcgagaccagcctggccaatatggtgaacccccgtctctactaaaaatacaaaattagcggggagtggtttggcacacctgtaatccgggtgcttgtgggaggccagggcag

SEQ ID NO: 581722 - DNA, 266 bp, Homo sapiens
gtctcggaatgcatcatccaggttctgcagagcaagcatcccggggactttggtgcttgatgcccaggggccattgaacaaggccctggagctgttccggaggacataggcctccaactacaaggagctgggcttccagggctaggccctaccgctccaacccctaccatctgggcccgggtcaagagagacggggtctgatctcgtgtagccatatagagtttgctcttagtgtctctttgtcagtagagtcggcaggaggatct

SEQ ID NO: 581723 - DNA, 381 bp, Homo sapiens
atctatacttctccggtatttccattggccatggcaccatggatccctcttccaacatatccttaacaccactcattaaaacattatcttccaggcagatttggggtcccaccacgtgggctgctccactggccattttaaaagcaaaaggcttctcagggcaagctttggagatcccacacttatatcggggaggcttggtagaacgtgcagctgtgtccaaggctgatctggcaaatagatttcctaaactggcatccatttttatttcaaatactggagaaataacataaaaggtcagtaaaaccatggccacagttaccaccaacttggcagcaccggttaccctcaggttggactaaaggtgctgaagggtaccga

SEQ ID NO: 581724 - DNA, 343 bp, Homo sapiens
taagcttgatctatcacgacacatacaaacgaaaacaagggataaaaaaggatattccatatcaatagaaaccaaaaaaagaatagctatacttatatcagatgaaataaatttcaaacaaaaactatacaaagagacaaagaagtcactacataatgatatgtatgtgctgatatccaattcagcaagaggatataaccattttcaatatatatgcactcaatactgaagcactcagatatataaagcaaatattaatagagctaaagagagagagaccccaaaacaataacagctatagacttcaacaccctacttttagcattagacaatcttacagacc

SEQ ID NO: 581725 - DNA, 343 bp, Homo sapiens
gaggattccgtgcgggggtggtgactcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgc

SEQ ID NO: 581726 - DNA, 840 bp, Homo sapiens
tacagtgttcaggtattatttgaatggaaagacacccaaaaaaaaaaatgtgctccgactagggggaaaacagtagttccgattttttcccattattttcatttaattttctggttgccctagcttccccccctattttggtgtcttttattaactagtgcatggtcttattaaatcttcacctggtatttaatggcacggcactgtcgtgctctcacgttggactctggtgtactctccgatactttctaacttctcgaggtttcggttggctttttggacactagttgtaagttacttggttatagatggtatcctttaccccttcttaatattttacagcagtacgtatctttcggtaacgtgagactgcagagttggtattcctatatgtgaaggattacaacctcaaaaagttatcctgccattcgagtgctcagaactgaatgtttctgcagatcttgtggcattggtctctagtgtgatcatatcaaaggtgtcaattaagacagagttctgttaatctaatcaagtttgctcgtaagttgtgcattacgcagtataaaaaggctaatatatacctatatggtcttgccaacagttttaaagcctctgcatacatggatactacaatatgcttgacattctaggtcttaatagacttttaacatcataattgagagtttaacacggtagaatccttgggtacaggtggactatttgaaattagcagggcccaaaatataattttctgaatattttctactggtgtataagtgtgaacagggcattttcaccattttagtgggaataccaatatttcaaaaaaaattcatcatg

SEQ ID NO: 581727 - DNA, 404 bp, Homo sapiens
gagtgctctcattgctctcactggttttaaggaggtgcctggttcattctcctcacaggatagcaatgtcagcactgatgtggttatccccattttacagatgaggtcattgaggtgcagacattaattacttgcctcagggttactcagggacaggaggagccaagagtcaagcccagggctttctgtccttccacttgattcaaagccttatggtggtgtctcaggagattttaaggaacttttgccctaactgttaaaaaattctgttcaggccaggcatggtggctcatgtctgtaatcccagcactttgggaggcctaggcgggaggatcagttgagtccaggagtttgagaccagcatggtcaacatatcgagaccctgtttctctcttaaaaaaaaa

SEQ ID NO: 581728 - DNA, 890 bp, Homo sapiens
gaaagagaaacaggtagttgtaaccttctttgtagaatataggctagtatactacttatataactaacactgtcctagcctatgatctgtcaggtgcaaggtactctggtgagtctatgcacttcaggaactcaatctccgtgagacacgcatattctgtgtagggtcaactcagcaatctgagagcgatggagctgcttattatatagaagaataggtctacaacctactaataatgcctcaagttccatagcaggtagtggcagaaattacagtgctgtggtttcatgtcaagtgaaccgttaaatagatataactcgcggtaagtaagtcgcgcagctttaaattgtcattcgtatgagccatacatgtgacaccataatgagtgcttagccgccctaggaacgttagagtgttgaggttgactcttctttgtgatatcaactttcggaaattttgccttgagatcagcttgttccacttcccttgagaaaagaatagctaggtatatcgcgattattctctaaggaaaagagcataaagctgtgaattccgagcagagataacatgtgctaggaatgagcatagaatctccaatgtgtgtctaaaaacctatcccggtctttctgtacagcgtagtgtctcctggataatagataggatgcgtacactaattcacccggtgtcttgcggtcacccactggtatttccttcactttaaggccccatgggtaatcctaggggtctgaccgtacccactaatggcaattgggtatatcgagagcccttgatgccaatggaggtacagcttgtgggaggattggcagtgaacctggtactcatctgggaccttgaggcgtccgggttctcacttcgccagctgccccttt

SEQ ID NO: 581729 - DNA, 344 bp, Homo sapiens
cgtcagtagccatgaaccacacacagtgacgcctctagaacacgtggttagtgcaactgaggcaaggaatttttaatcttatgtgattttaatggggcttaacttaacccagcgcgcatgtggttacggtagtgggctagcacagccctagagcctgaagaaagcaaaccaaagaacaccagctgggtcccaaacagaaggcagaaagggtagaaccatccagctcaactatgccagccccatcagaaggcaccaggcacagggcacgagaaaaaggcaaaaacccacccagccacatgcaacttcactcactcaaccagccagcaacatcaaacgggaaacac

SEQ ID NO: 581730 - DNA, 760 bp, Homo sapiens
  misc_feature (721)..(721): n is a, c, g, or t
atgatttggcgtgtttgctgcccggggtctctgtttttcgccatcgggtgcctatcccgcttgtgtttgccgctccgtcctccgtgctgtgttggtcacagccggcggtgggccttctggtggcgcgcgttgccgggttgtccaaccattggggccgttttgccccacacccaggggggtccactcccccgatgccgccccgatttcccgggactcccctgtgcctcccgtcgcttctgcccgcagactcccttgcactattgcgttttctttcccgcggcttgactagctcagtttttttccccaaaccccctgttcgggcctatcccgcgattcccccacgccttatttcgggatatccctccgtggtcattcacccccactgtgaaacatctcctcctactcatccctcgtagggccaccaccactttgctctcacaccccgcccgaacatttgaataatctttcgcacacagttgtcaggaccccacttccgctctcgaacacgcctcaaatcgcctcacatagagtaagaaaaacccccctcctcataagccacgcggaggcgccgaatctggaggtgaacccccccacgcactactcccacccctcttcgtggtgaaccgccggaatcaagtaataatgctcttcgccaataagaggtgagaggtgatccggccccccgcgccgagctcggtgtgtctagagcccgcacccgccngtgcgccgctcctagacatctgtttcacaatagactgac

SEQ ID NO: 581731 - DNA, 385 bp, Homo sapiens
tgggaagttggacccagagtgaaatgactggtcaaaggtcacatgacagaggttcccaaactttcttggttcatggcaaacacagggcaaaagaaatactcaagaatttcttttaaattttttttcttttttttttggagacggggtttggttcttgtggcccaggggggggggcgggggcccgattttggttaattgcaacctcggcctccggggttcaggggtttttcttacttaagcttccggcttaagcttccaaggtggcggggtttacaggcatgccccccaacgctgggttaatttggtttttgaggtagagccggggtttaacggggttagccaggttggccctgaactcttgacctaagatgacccgcccacctgg

SEQ ID NO: 581732 - DNA, 248 bp, Homo sapiens
tgtaaggtactctcgaggattctcagactagtcaaagatactaaataatacaggtactccatgagtataaaaacacatgaacctggcaggtgcagtggtccccctgtaatcccagcactttgggaggacgcaggaggatctcctgaggccaggtgttcaagatcaacctgggcaacatagtgagcaccctgttcctactagaaaattcaaaacttagctggaaatggtcgcacatgcacctgtgtcta

SEQ ID NO: 581733 - DNA, 514 bp, Homo sapiens
  misc_feature (103)..(103): n is a, c, g, or t
gggacttgattggtggtctagaatggtacatgttgtttattgtcactagtttgccaggaaggacatgtgattccacgagttggaggcatggatgctctgggcnccgggccgcaccctgtgacttggggcaagtgtgcttcatgggaaggcgtgtgagtaagggtgctctctcgttggaagcatccttgtctcatccctaatcctgccatctaggctgataagaagttaatgccaggaaaagaaaatgtgtgtctttcgccaactccgtctgctgggtggagctcccatctgtaatccagccccaggccagatggcttccctcaccgctgtataacagaagcacacaatgtatacacaatgtatacacaatgtataatctgcataaaaaccatgcatcttcccggagcaccgatcttactccatgacaactcacggaagcattgttttctatattaaaatgaataagtatgttatacatagtgaaatattggcattaaaaaagagttaataaaaa

SEQ ID NO: 581734 - DNA, 2054 bp, Homo sapiens
gctacttctctcttggcatcaaatatgtctttaactgtacatctcagatggctggcaggccatgccatttatacagccatggtggtcacacaatttgttcacaagcacagatgaacaatcaccaccatcagctatcattattacagctcaattcatttcccttgaaacagcaaacaaccgaacattccctgcctcatcaaagctcgttggcatccttgtaccaatgcaaacgtctctcacacaattcacatggcccatgccagcccttggcacacacaaccacagacacgtttattccccgaaggcatttggctccaattctcacccgttcagcccacagaccggctggacaaataggttcatcaaggcggcaattcaaccctttggcaaccctagaacctttaaaggtaacttcattcaactttccttcccagccccaccttagcaccacagttgtatccattagatgtcgtaagttgtgtgagggcccggaggcgcttcctataccacctaccttaacaacgttaacttcataagggcaacacgttaactttaacttttgtaacagcccccggagcactagttaaacggaggccccaatttcatggaacaatggcccccaagagtcactttggcgcaggcaaacatgggggaggctggtaccacaacgttgacccgacactttgaattatcattgtgaccatagacccgggcacttatttgaccccttccagccaggaaactgcaacggcacaaccagataagcatcccccacaaagttcttatagccgccccagtaattctcgcccaacgcgcttctcccgcattcgcggctcacacggtggaacataccaacaggggcttacaccgcggcttacactttcctacagttaaaggatgtcacctacttaaccgggcaacacaaacactcacctcaggcgcccgttacaaacgcacatgccattcgcgacgggcaccttctcggctagtgccacccagatacatgacgccgtttagtcgtacaccggtttccgaaacaccaaaaaatggggggcacaacattggaggacggcccacataaatacatggactatacgaccattgggggggacatgggacacagttctcacaggggcattatgttatggggatataaacacagggcgcaccgattagtacacaattaatacggcaccttcttgatacgcaagcaaaagtgccatctaccagcgcatttacaacaagatttctccaccagccacaacggggcccgaaaccacaccggagcagaggaacaccatgagggcaaccagcaactaaccaggcagggccaatcaccacagctggagacacaccgaacccacaaagcgagatgcggacaccacaggaggcaccccaccaggcctcagagagaacaccccccaacctggcaccataaccacccagatcagacacgctcaccaactcacacggccacaccagacacacgtgagggcatccagaggcaccactcaacaccacaacgagtacgacaacacggagacacactagagcatacggcccccaccgcccaccacacagccgccccaccaccaacacagacgaaaccacagcgctaaccacacctcacgacgacaaacaagccagccgagacaaacgacctaccccgatcactccacacaggacagctagcatcaacgacagtcagacacccatgacgccacgcaacgattcagacaccaatgggagcacccatgacgcacgacaccgtccaacacagccaatctagacgagagaggcagataaacgcggcacaacagcaaaaaaccctcatgccgcagccacgaaactctcgcaccgcaaacacaaaccacccaaacacgatgacacaccgaccacacacacgcgaaaaaaacagaggaccaccaacagcacgcacaacccaaaggaccacgactacacaagctcatgacgaacaaacaagtgacacaacacatcacaaggccaccacactgcgccgagcacacacccactgtacacagggagataagcag

SEQ ID NO: 581735 - DNA, 135 bp, Homo sapiens
tttaacttaataatataccttatttaatctaataattctggtcccttatctgaaatgcttgggtcagaagtgtttttggatgttggattttttcagactttggaatatttgcatatatttaatatctttgggatc

SEQ ID NO: 581736 - DNA, 811 bp, Homo sapiens
gaagcctttagctaaatgtgtacacttgaaggtctcagattttgccctcaagtgtgccttgtttctccttgtctcttagcgacatatgcagctgctgttattagttccgaatgtctgaggacaagccacaagattacaagaaacggctttcagattgagctgacctagctctctcttcagaacagagccaatggcttggaatgaggtagggaaatgtgagctagttatttatctggtagtctccatagaagcaggtatggcagcttgtgcgttatcctcgtcaaaacacttagtacacattcattggcattgatgtttccctggcttgagtagttgcttcttatatgcgtgtctaggcaagctgcatctgaggaagaactagtcatacaagactttacaagagtcgtgtccaggaatcatgacagagataagttgtgttatttgaaagagttatatgttgcatcgagggaagaaagagtgaaaacatggttagccagtatttacaaggaaaagatgttaacataaacgggattgttagggaacagaaggacagaggataaaaagccgggttaacgaagaacgagaaattcaggtagtatgaacacacaaacacgcttgtcacttaaagacagaatatcgctacagtgagaatatacacaggcaatggaaattatgtaccttcacgaccatatggctacatacacgagacacaggggtgggatacacgtgagaaaaagttgtgtgcctaacaaaaacaagatagaaccaatgccctggaatatataaattccaacagataatagcgagaacc

SEQ ID NO: 581737 - DNA, 1055 bp, Homo sapiens
ggctgaagggatcatggtgcagtacgagactgtgtggccgcgctgcctgtgcgcctccgtgggtctgccctgtgcctgctgcttctgtggctggtgtgctgtgtgcctgcgctgtgtcctggtgctgcctggactggctgctggtgtgctgctggtggtcctggtgcgctgacacgaggcatgcgagctggtgcctggagaacattggacatgtggcggctgcagcgcttcgcggatccagcaacccagcaccttggactcagcaggcgctgcatagcccgtgccccgtgcactcagctgtgtgcagcaagttacacagtcagagagctaggcccctgcaggcccgtgctctatcacctcatgtgtggcacaggcctgggcaagtgacacaaagggaccaactgtagtgacctccgtatctaggctgactgtgagactcaggatgtctcagtgccccaacggcagggacatgctactatggcgtacccatgtgagcctcaaggagtgcttcacctacaagggccaggactccacgctgggcttgagcctgaattgacggggtgccggcggagttgcgacagaagtaatggtgcatgtgctgaagctgcagggtgccgatgccctaacgtgcaacaccaatgtaccacagtccatgttcagctatgacttgcagtaaccacctcttttggccagaccgtgaacccatgggacagtcgtccaaaagcccaggggaatcctcagggggtgacaggggcctcatcgggtctaggagctccaccatgggcataagagcacctgatatcgagcagggcagcatccggatacacctcatacatatctagaggacatctgagagccctacagacccgcagtgaaacgcgcgaccacaagagtgggcctacagggcacgggcacagagcaacgcaaggacacagagcacacggagggacccaagacccgagaggacagaccagaccggcgccggcaccacgcgagcacggaagacaccagtgacccgagaggacccggacccaccaaaagaggcacgcaagaca

SEQ ID NO: 581738 - DNA, 629 bp, Homo sapiens
gtgcccttccatacaaatgtcaagatggaggagtcagtcattcaggaaccacaaccctatatgtagtcaagtctaatatgagatgtattaactaagtatttctttactagccatgttcaagagtgtatatgtgatgaaagaatacaagagagttgggtaggatatagcatgctatgagtgataactatgctatggagcctggtgccaacttgtatccccagttcagttgaatttacaaggacctacaagatggtcatgtttgtcttggaatgtgctgaccccaattttagtgtttctttctttattctcaaatcagtaattattcagttgattgtttatactatataatgaagtacaaaaacattttggtcccgtatgtttaagtaacagtctgtgccaacttcctcttggtcgtaaggtgctccctttgaatatctggtgaactgtgtcagagcggagagcggggtggtggctaaggaacgagggtcagaaagaagctagagggaggtcacggacgaagggtaacagggagcgatgcaagccagcaatctaccctggtcccccaggatcaggatatctgtcctgttgcctttgcgctccccactggtttcccttagccttcacggtgc

SEQ ID NO: 581739 - DNA, 206 bp, Homo sapiens
  misc_feature (29)..(29): n is a, c, g, or t
  misc_feature (140)..(140): n is a, c, g, or t
  misc_feature (152)..(152): n is a, c, g, or t
ctcgtggtccgcccatcttggcctccggnagtgctgggatttacaggcatgacccaccgcgcctggcctggaaaacttaacacaatgtaaatgctatataaatagttgtgatactgtattgttttgtattacatattttnggggtattttgnctctgccagtagttggatctatgggagatggacctgtagatacagagggccact

SEQ ID NO: 581740 - DNA, 741 bp, Homo sapiens
gtatgggtttcctggaactttgggggatcattataaaaatactagggtaaaaaagcaaccttagtaatcccagcaatttgggaggccgaggcgggtggatcatgaggtcaggaatttgagaccagcctgaccaacatggtgaaaccctgtctctactaaaaatacaaaaaagtagccgggcgcggtggcgggcgcctgtagtcccagctactcgggaggctgaggcaggagaatggcgtgaacccgggaagcggagcttgcaatgaaccgagattgcgccactgcagtccgcagtccggcctgggcgacagagcgagactccgtctcaaaaaaaaaaaaaaaaaacaaacaaaaaagcaaaacaacaaagagggggtgcgggggggaggggagaagaggcaaaggaggggggcacaaatgcccacaagagggtgcaccccgacatatagaggggaacgagatacgaacagcgtgttatatacaggcgctaataacaaaagggtctcacaggagcatcacaacaaacacggtggaaaacaagccgcgtcaagagatgaaccccactgataataaagagataattatattgtgttaaagaaaaggcctcttattagtgcggggagacaaccaagtaggtggtgtatatacaacaagacagcaaaagaaacaaaagaaaaggcatttccgcccgttatactaacacaaaccgggtgatgagcagaacactcatatatataaccc

SEQ ID NO: 581741 - DNA, 273 bp, Homo sapiens
atctagacgtaacacaggcaaatggcacagatgcttctgtttgttagcctcccagagctcatctttattatcctttatgactaatctttgatctttaatattatactttcagtgagttctgtgcattgttctagcaaattattgaacatgccgggaactattgctatatctgtatttttagcttgtctgactaactactatcactggatggttcgcatcaaaattcgtattatcagtatccttcattattggtgttacaccaattgaatggtg

SEQ ID NO: 581742 - DNA, 235 bp, Homo sapiens
attcgagctcgccaccctgtcttcgtacgttcaatcaaaccagtttgttctagttcaacaagcacctttattaaatctctgaatgagtcggcactatttaaacctaacgcatcttgaaaatctgatactgacatgggttcgtagtcaggttgtttaatcatttcttcgatggattgttttaaattcattatgcccctcctttctaattatcttgtttatttttattctgaccaat

SEQ ID NO: 581743 - DNA, 463 bp, Homo sapiens
cttcggctctaccttacctctcggctctaccttgaatcacgcgcactcaccgtatgtgtctcgagctctaccttgactctcggcactacctagtctctcggctctacctatgtctctcgagatctaccttgtctctctctcaacaaggcaaatctgagacttattggactcaaagagcgaagctgcagagagacaacaaggtagaaagtttattcaacgtgctcataacagcagatattcaagataacacagagccggccttcagcattctatcagatcaatttaacaaagacgttcacattgcttaacacctcaagcagaaattctaaagttgaaaaatggaattgacaaacttgaagaatgtgtcacgtgtttcactagcagaatcaatcaagcagaagaaggcattagtgagcttgaagactggatctttagaaatgcagtcagaccaggtagagccgag

SEQ ID NO: 581744 - DNA, 161 bp, Homo sapiens
tcaggcgctgttggggaatttcacacaaacgtcaactgctggatagatttgctggaattccctcacgttcatttcccaacaagagcagagatttctcaggaaagtcactactgggttaggtctacactatatggcagtttgttccactccaaatgatggta

SEQ ID NO: 581745 - DNA, 355 bp, Homo sapiens
aagcttacgagattagcacgtacagggtggtatggccgtaaactattttggatacccattatcttgaggtattctcagtgaacccttcaaaacaggtctcacaagcctcatcttgcaccatgacgagactgaggccttgtataggctaaaattgacccaagtcacccggctgacagatggcaggcctacggttctgattcagtccattgcattccgggggcctgtgcttgttccacccggccacactgcctgtcatcactacacatgtctttcttgcaggctggtctattgcattaccgtcccgccatctgtcaaaaatgggcctggaacggagaggcctctgcctattctgccc

SEQ ID NO: 581746 - DNA, 873 bp, Homo sapiens
  misc_feature (28)..(28): n is a, c, g, or t
  misc_feature (92)..(93): n is a, c, g, or t
  misc_feature (101)..(102): n is a, c, g, or t
  misc_feature (134)..(136): n is a, c, g, or t
  misc_feature (139)..(140): n is a, c, g, or t
  misc_feature (193)..(193): n is a, c, g, or t
  misc_feature (213)..(213): n is a, c, g, or t
  misc_feature (216)..(216): n is a, c, g, or t
  misc_feature (222)..(222): n is a, c, g, or t
  misc_feature (256)..(256): n is a, c, g, or t
  misc_feature (263)..(263): n is a, c, g, or t
  misc_feature (296)..(296): n is a, c, g, or t
  misc_feature (308)..(308): n is a, c, g, or t
  misc_feature (311)..(311): n is a, c, g, or t
  misc_feature (313)..(314): n is a, c, g, or t
  misc_feature (317)..(318): n is a, c, g, or t
  misc_feature (320)..(320): n is a, c, g, or t
  misc_feature (323)..(323): n is a, c, g, or t
  misc_feature (325)..(325): n is a, c, g, or t
  misc_feature (347)..(347): n is a, c, g, or t
  misc_feature (349)..(349): n is a, c, g, or t
  misc_feature (372)..(372): n is a, c, g, or t
  misc_feature (376)..(376): n is a, c, g, or t
  misc_feature (381)..(381): n is a, c, g, or t
  misc_feature (430)..(430): n is a, c, g, or t
  misc_feature (432)..(432): n is a, c, g, or t
  misc_feature (442)..(442): n is a, c, g, or t
  misc_feature (453)..(453): n is a, c, g, or t
  misc_feature (468)..(468): n is a, c, g, or t
  misc_feature (507)..(507): n is a, c, g, or t
  misc_feature (511)..(511): n is a, c, g, or t
  misc_feature (523)..(523): n is a, c, g, or t
  misc_feature (544)..(544): n is a, c, g, or t
  misc_feature (603)..(603): n is a, c, g, or t
  misc_feature (630)..(630): n is a, c, g, or t
  misc_feature (871)..(871): n is a, c, g, or t
cccactccccaccccacctaccttttanccgctcctgactcaacgagagtttcagcagctaccaatctaagctaacccactctaattaggtnntcccctgnnctcccccctccctgctctagcagttgccatgnnnggnncccaccagggggccgcggctggggccagccctccgctgacctctctccatttntcccagggcctcccgctgcnggnctggtntccctccaacccacttcccacaagtttccagggnatgttanttcctccaccctggttttttttttccagcatcntttgttcctccnttntnntgnngnttntncactttcctccctaaaggttcntntagctccctggcccctttttttntgcncacanctcccacccctgctggggccccaggtcagcgcgcggccgcgcgcgcgtngnttcccgctgngtggcggatgnaggtcggagctcttnggagaaggccttttccgcagtcaaccgcacttgtaaggncgcncgccactgtggnaccggtgatgctgcagaagcntggaggagcggcagaagcccttgccgcacacggcgcacctgtagggccgctcgcccgtntgggagcgctggtgctggatgagagtngaggagcgattgaaggtcttgccgcagtcggggcagctgtaggtgcggcctggcaggtgggtgcgggcgtggatggccagcaccgagctctggccaaagcgcttgccgcactcagggcacttgaagggcttctcccgggcgtggctgcgggcatgggggataagggccgaccgctgggagaagctcttgccgcagatgccacagctgaagggcctctgaccggtgtgcaccctctgatggntg

SEQ ID NO: 581747 - DNA, 170 bp, Homo sapiens
gtgttatgtgctaggtacagcgtctgagctgcatgttgcgtgttgatgcttgtccgttttgatcgtggtgatttagagggtgaactcactggaacggggatgcttgattgttgtaatcttactaagagctaatagaaaggccaggaccaaacctataccacgacacagtg

SEQ ID NO: 581748 - DNA, 303 bp, Homo sapiens
  misc_feature (3)..(3): n is a, c, g, or t
  misc_feature (190)..(190): n is a, c, g, or t
  misc_feature (202)..(202): n is a, c, g, or t
tcnccacccccagttttccctgaaaaagataaaacctcctggattcaaccaggcagttttgtcagcaggggcccgggcccccaggcaggggtggggtttttttaaaggaggggcccaaagccctttgggggggaccctcccttgagcctgtttaaggggccagcccttagggatttaaggttaaggcccntgggaagggaanccccccctgttcctttggaggaggggccctcccccctcattgggccatggggttgaaattcaccccgtttgcccagtaaaagcctttttgcagcgggtgga

SEQ ID NO: 581749 - DNA, 671 bp, Homo sapiens
catggttccttctgtggcaggacagaacaacaaagcgctataatactaaggtcacgagaagtgtcagcctcaactgatatttattagtaataaggacttgcctcaactccctctttctggagtgaagcatccgaaggaatagttgaagtacccctgggcttctcttaacatttaagcaagctgtttttatagcagctcttaataataaagcccaaatctcaagcggtgcttgaaggggagggaaagggggaaagcgggcaaccacttttccctagcttatccagaagcctgttaaaagcaaggtctccccacaagcaacttctctgccacatcgccagcccgtgccttttgatctagcacagacccttcaaccctacacctcgatgcagccagtagcttggatccttgtggtcatgatccataatcggtttcaaggtaacgatggactagaggtacttggagggttgaaatatattagaaaaggccataaatttgcctgcaaattgttaactgaagggtattaaaaccacagctaatagctctattataatacttatcagtgactaaaaccaattaaccagtagtggagaataactgtcaaaactgtatgtgggttgaaatgtattgtgatggagaaatggattagtgatagaagtttggtgaatgcaatc

SEQ ID NO: 581750 - DNA, 170 bp, Homo sapiens
gagctgccccccagtagaccttgtgaaaacgcgccaggtcgtcacgggtgccaagtttcacttcgacgccaaatttggcagcttttttgatattgcgtcgccacagctgattcatgcccttgaggagctcatcctcggatttctgagtgccgtcttcgtggcgcaacgaa

SEQ ID NO: 581751 - DNA, 242 bp, Homo sapiens
gcttaggctagcaacttgcctgaagtgccttgagtcagtcacttcacttctctgggcttccgtttaaccgtggggtacagctggaggttgaattttcacgggcacattcccacatccgtgattggcacacctctggggcatcgacctgaggacgggcacaaggaaaagcacaatgaatatcctgggcaagcatatagatgacggaccaggcacagacgcggcagctctcgtcacgctgacag

SEQ ID NO: 581752 - DNA, 554 bp, Homo sapiens
  misc_feature (193)..(193): n is a, c, g, or t
  misc_feature (293)..(294): n is a, c, g, or t
  misc_feature (334)..(334): n is a, c, g, or t
agcagcttactccagagatcaagtccaaggccatggctatctcaagcactggttaccagagacagttgaagctacaaacactatgatggctcctacagcacctttggggaagccgagtatggcgaaggaacgccagggcataacaacccttgggcgtcacagagccccttggtggtttccttggacaagaccnttctgtggcgcccaaaaggccgtccgaatagcccttaacctatgtccgtgttcagaagtcggaaatgtgagaagaaggcccgaagccaagccacaggttnngtaaacaccccgccgaaaaaaggcccccgccccctttccnaaaattttaacatggggggcccatattcccgtttccgcccgcccaaaaggccaaagggcgtccccaaggggccaacaaaagagggggggaaaaacccacaaataaaccttttgggggggccccatttggggaattattgttccaacaggccggggcaaaagggggccccctttttccccctttgtgggcgggaggatccaccctgtccacttccaaagca

SEQ ID NO: 581753 - DNA, 224 bp, Homo sapiens
tcggcgtatgatggctggcggagcatggctcacatcttgtaatccccactttgagaggcagaggtgggaggatcacaaggtcaggagttcaagaccagcctgtgcaacatggtgaaaccctgtctctactaaaaatgcaaaattagtcaggcattgtgggttgtgcctgtaatcccagctacttgggaggctgtggcaggagaatcgctagaacctgtggggct

SEQ ID NO: 581754 - DNA, 327 bp, Homo sapiens
cacaaacaattacattgaacattgaagtttggaactacttcttcgacatatcagcaaacacactgtaaactctaacgacccacagatcacagtgaacagtttgaaacaaggctgtaccatggcagtcatgcaaagcatgggacagatagaaatacacggcagtgcaactgtgaggataactttccattttttccctcggagagcaacagtttacggggcagaggtgatatgttctgccttttgaagattactggcacacgttcagctttttcacctctctaatcgactggaagcagccagccgatcactagtcctccatccccctcg

SEQ ID NO: 581755 - DNA, 868 bp, Homo sapiens
  misc_feature (868)..(868): n is a, c, g, or t
tcgaactcgtgaatgacacgtctgtatgattggaaggtcaaatgtcctcaaagttgaccaggacagcgcttgagcacaaactgcatctccaggatacctcaaagagaaagaaggagctccgagcttgcatttctacttaagcttttccttcttgaagataacttgtccctttgacccaccatttgtcagggttgtgtcttccaagtccttctcctggagggtatgttctggcggcggaggggccatctcgcatggtaacttctctgccgaaaatcgagggcctggatggcgagctgcctactccatagagtcagctgatcatgctacgacttcaggtgccacactggtgaaggggaaagcacgagctgcagtttggagccaacaaatctcaatacagtctgacaagagcacagcagtcctacaagtccttggtgcaggatccacgaagaaaaacggttggtacaccgacccccaaaatgaagacggctaagcccgtggagtatcatccttcctgccctccccaggcaccactggaccaattacctttgaatgctgtatttggatctcacgctgcctctgtggttccctccctcatttttcctggacgtgatagctctgcctatgcaggacaatgatggctagttctaaacgctaaggacatagaaatgggcaaaacacagaactgtttcagtactcaagactgagcttacagaacaacaaacagctggtggaaccttgctagcaggcattcttataaagagaaaactttcgagcctccttatattgctggaaaactcagtgggcccagatagaggctccttaccttatgcatgggttttacttaatttttctattatggtccctggtn

SEQ ID NO: 581756 - DNA, 401 bp, Homo sapiens
  misc_feature (58)..(58): n is a, c, g, or t
cggctaccatttaggttggacgagctggaactgtggctgaaatctgcttagtaccagngtaggcttggacgctcaatccataggtaccatcctggagtctggggctacgggggcctgccttgcactgagtttcactgaggtgggcctggtgttgggttctgaggcaaaatcttttgcttactgccctcttcctcccctaagcaaagggtatctttctccacgtgctgcctgaggttgcaggctgggggcagtaatataggtcatgtaaaactgttctttctactctcttcaatgtgttttttctgatttctctgctacatccaggggcggtcatctctcacctggtttccttagcttttattaaagtatttttgtgcaagaatagttgttcaatttatgtt

SEQ ID NO: 581757 - DNA, 368 bp, Homo sapiens
  misc_feature (90)..(90): n is a, c, g, or t
  misc_feature (97)..(97): n is a, c, g, or t
  misc_feature (109)..(109): n is a, c, g, or t
  misc_feature (111)..(111): n is a, c, g, or t
  misc_feature (116)..(116): n is a, c, g, or t
  misc_feature (138)..(138): n is a, c, g, or t
ccgtgtgcgtcttctggctgatgtgcatgtgtcggctgaaccccgggatctacccgcagcaagtgtgacgccccgaagttcaggcaaccntcgcctntgggaccccgcntngcctntgagacaccccccaaccccgcntttgagatgcccgccccgcctccgagaccccgcctccacctccgagacccctttctccgagaccccgccccccgcctccgagaccccgcctcacctctgagaccccgcccccgccagcagctcagcccctcctgtctcttgcccctggttttgtgggtctgccctgagctgtgcctgtgtgctccagcctcttcctatgtgtgtaacttcaataaaaccaagcaaagcca

SEQ ID NO: 581758 - DNA, 305 bp, Homo sapiens
cgcctccgtggcgccgcctccacctccgagacgccgcctccacctccgagacccctttctctgagacccctgcctctgaagccccgccccccgcctccgagaccccgcctccacctccgagacccctttctccgagaccccgccccccgcctccgagaccccgcctcacctctgagaccccgcccccgccagcagctcagcccctcctgtctcttgcccctggttttgtgggtctgccctgagctgtgcctgtgtgctccagcctcttcctatgtgtgtaacttcaataaaaccaagcaaagcca

SEQ ID NO: 581759 - DNA, 124 bp, Homo sapiens
catactttcttactcatttcttttctctgcagttgtttgatgacagtaagacgtttagtaaagtcacaggcattgtgaattatgacaaattttatttgtctgcccaagatggtaaacactctta

SEQ ID NO: 581760 - DNA, 252 bp, Homo sapiens
tagcctcaacttccaaagtgctaggattacaggtttgagtcaccacacccagcctataacgtatgtataaagacaaagcacaacattaaaaaaaaaaaaaaaaaggggtgggaccctggacaacataccaaattcctgtctcaccaacaacaccaaaaatgttaaatcagctgggtgtggtggcaaaatcctgtagctctagctatccgagaggctgaggactacggatgtgtgccccaaaagtggataatt

SEQ ID NO: 581761 - DNA, 513 bp, Homo sapiens
gacgtatagaagttctgtggttagaaatagttatggtgccctacatttccggagtatctggtttactcctctcatgtttaatcagctttatgggggtaatgctacttctcaccctcctctgtgtcatatttccataagggccttgttgtgaggattaaataatataacagatataaaactttagtccccatgtaactggtatctggtcagaattccaggtggctcaatttgatagtggatttgtgacacaggcactaagcttggtagagaacttctgcaaggcagggaatcctaatccagaaagtatttagcttaaagaaaatagaaactaccgttatctctataactattcttctgccttagcatggagagataagccattcccagtaacaattttacttaactaatatcagaagaaaaagtctcgaatttttagtatggctttgcctggatcttcgcagtagcaagtaaaaacagcaataattgatgccattggaaaatgtagattaaggt

SEQ ID NO: 581762 - DNA, 370 bp, Homo sapiens
  misc_feature (47)..(47): n is a, c, g, or t
ttgggggggggcccccttgcaaaagcaggaatttttggtggttattnccgcccctccccggggtccccctatgatgcctttggcaggatcagattgggtcctgctcctttcccccttgaagtccccccgtttgggttcccccgggccgatatggtgattgttggttaaaagacttgggccccagtcataggcttttttcggtttttttgtcccccccgggggcttttttgaggggaagccttttgtccttgaagtttttttgaaatatgtaagaattgatgggggttttgccccccttaatgtgaaataaattgaatttaatgttggatcctttccggccttcccttaataaagcccctgttaagcccta

SEQ ID NO: 581763 - DNA, 203 bp, Homo sapiens
tgttggtgtttcctatttggactgttgctggccgtacgcccctttgcattccctactgtcagtggcagctaggactgttcccatccttctggaatgggggcagcttccttatcccctgccctgatcccctctccattaaagcccctgtgccctcagcactggcctgccatatgctgttagcgggctctatagctgtcgcctcg

SEQ ID NO: 581764 - DNA, 369 bp, Homo sapiens
cggggtcgactactactactaaattcgcggccgcgtcgactcctccacttaatctataaaattaactaaaatttcccaagctgcctgtcaaagcagtgttaaaatcattaagttggtaaacgagacataataaagatattacatgtaggaacttagaaacacgttaaactaaaagcaggctaaagatgaatggggactggctacagatcagtcaccatacataatctcctacagtggtctgcagagccagtccttgagcatgggcaaaagaatctcagaatacggaacagttcatgaagacctggtcaggacagaaatgcctctttcctttcacaggtgactgcctcctttctcgtcgacgcggccgcg

SEQ ID NO: 581765 - DNA, 188 bp, Homo sapiens
cacgagggttttccacccccctgcagcacctaagatggtgggggagagggggttataataaagcatctgaatacagttttcaggacctcaagcacacttcctagagacttgtttctgagacagttctttgccctcacttccctgctatctgcgaaagaatagaggagtattcattcagcctgtgcact

SEQ ID NO: 581766 - DNA, 173 bp, Homo sapiens
cacgaggacatgggaccaaataaggaaagagggacctccagaatgtcaactgggagctcttggggaaccttaataccaaaaggaggaaagttacccagtggcagggcaagatcacaaagccaacaagcactcactaacccccagccatgctcagccctcaccaatttcatttg

SEQ ID NO: 581767 - DNA, 364 bp, Homo sapiens
  misc_feature (225)..(225): n is a, c, g, or t
  misc_feature (252)..(252): n is a, c, g, or t
cctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaaaagacctgcggaggctaggagtggttcttgatgctcacctgaagcccctatgacgctagcttaagganggcgctcctgggcccccaatacccctngagttgcgcgcgtagcgcacccctgcagtccagcgtgcatccaccccgacgacgccccgtgctgtgttacctgccctgcccatggcctcaataaactctctgcttggtgtga

SEQ ID NO: 581768 - DNA, 1817 bp, Homo sapiens
  misc_feature (250)..(250): n is a, c, g, or t
  misc_feature (708)..(708): n is a, c, g, or t
  misc_feature (815)..(815): n is a, c, g, or t
cccaggctggttgctgaagtctcgttagttcaccatccgacctcggctgtccgaggggacgctaggggccagcacgagcctacgaccaccagtccgtttatccgtttcgtcccgtcgccgttaagagcaggatgacaggagagggacatgtctcggggattatgccagcgatgtcaaacctcggctgagggtggatagctccattggctgtcatgagatggcgtgtagaaccgatcgaccggtccctccntgccatcgaagttgttgactggtccgaccggaaggcagggagccaatcgaagcaccatttcatcactgcgtcgtcctagttcacgacgatcaacgcctgatggtgcgagacgtccccaaacgggggagagagcccggtccgtggttccaatcgccttccaaccataacgcgactgaatcgagtacggagtcgagtttggagagcctacccaaagagatcccatggctttatcgaaacacgcgcgcggtcttttgctaatacctaagctggaagagaacccacttagcaacgtgcacgtagttccatcttcgccaaggacgagcgtatgggggccccgttgcgttgtcgcaacctgtgtgagggaaacgcccccgcgtgggggggcccacgcccatgggaacccgtgttggcaaacgccctctcctcatatgcccgcagaccaaggaggggtaaccaantatgagtatcccaccccgttcccacaatagggtaagtcgaaggacgttggggctttgaatacacttgtcctattcccatggagggaagaatccccataataacaaancaatgcatttgttggtcggtgccaattgcacacaaagggtcgagttctcactggcgggaccattttgcgtgggaacacccaccgagggaaggccaaggtgcctgtcctggttaacaaattccaccatataaaacataccggaaatatttgtgccgttcgataaagactaaatctaccctttgtaagcaacatgcgctgaggaggaggcggcgccctatatgagtcccaatattaggtcacaaacaggttaggaaaaccaccctttgtgttggcccgcgacacaaggtgcgttggcacttgagaacaattggaggggcccccgcccatccatcaaaggaaatcctaccaaggcggaacatggtggaccccgcagaaaggcttcatggtcaccgaggaagccaacttgtggtgggcggtgggtaccaccaacccagtgtttttatggcgcgaagacgggacactcgaagagtgtgcacggcaagctaacacccgttggtagagacgtgtgggtcgcagcagaaccaataaacacggaggcgaggcaccacatattgtttcataaaatggagcaaatattaaaccacgcgcgggacaaacagtgtgacacatcaggtatgacgaactcaatcaggagcggacacataacagacgaggggggacacaaaccacgggggaaatagtagcggacacaaagtgacagagaaaacacacaacaagtaaccttgtagtaggccccgacaccctatgcggggacggaaaaaacaacacaaccaccaagaaagagaggagagaaaaagagcaaagaagaggagcccaaaaaaaaccacaaagagaagggggagtgagcagaacacaaacgacgaaaaaagaaacacaatgcagagagaagacaagaaaaaaagaaacgaagaagaaaaagaaaagaatgaagtggaagaaacaagaacaagacaagcacgaaaaggaaagacgcagacaacacaaagaagataaaaagaaaag

SEQ ID NO: 581769 - DNA, 167 bp, Homo sapiens
tcagtccccgcataactggcttattgccccaatgggccattatcgaagaattcacaaaaaacaatagcctcgtcatcccgcaccatcatagtgtaccatcatccctccttgacctctacttctacctacgcctattgttacaccagccccacggtgcgttggcccta

SEQ ID NO: 581770 - DNA, 984 bp, Homo sapiens
  misc_feature (34)..(34): n is a, c, g, or t
  misc_feature (65)..(65): n is a, c, g, or t
  misc_feature (67)..(67): n is a, c, g, or t
  misc_feature (242)..(242): n is a, c, g, or t
  misc_feature (263)..(263): n is a, c, g, or t
  misc_feature (269)..(269): n is a, c, g, or t
  misc_feature (288)..(288): n is a, c, g, or t
  misc_feature (296)..(296): n is a, c, g, or t
  misc_feature (307)..(307): n is a, c, g, or t
  misc_feature (339)..(339): n is a, c, g, or t
  misc_feature (341)..(341): n is a, c, g, or t
  misc_feature (345)..(345): n is a, c, g, or t
  misc_feature (376)..(376): n is a, c, g, or t
  misc_feature (390)..(390): n is a, c, g, or t
  misc_feature (401)..(401): n is a, c, g, or t
  misc_feature (427)..(427): n is a, c, g, or t
  misc_feature (436)..(436): n is a, c, g, or t
  misc_feature (455)..(455): n is a, c, g, or t
  misc_feature (468)..(468): n is a, c, g, or t
  misc_feature (472)..(473): n is a, c, g, or t
  misc_feature (476)..(476): n is a, c, g, or t
  misc_feature (489)..(489): n is a, c, g, or t
  misc_feature (494)..(494): n is a, c, g, or t
  misc_feature (496)..(496): n is a, c, g, or t
  misc_feature (807)..(807): n is a, c, g, or t
atccttgcatcgggcagcccacactgaggatatnaatgcttgcacgctgaccacgtccccgaggntncctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttntctatccctttgggccctggnagaagnaagccatttgcagtgctgntgtgtccngctccctcccnacattccccatgctcaaggcccagccttctgnanatgngcaagtggatgttgatggtagtacaaaaagnagggcccagccccngctgttggcgncatgagtatttagaggaagtaaggtngcaggcagnccagccctgatgtggaaanacatgggattttngaanncancttctggaggaangcatntnacaggcggcactttcttcaaagagtggtgcagccccaaacattttgcacataaggcaccaaacagcccaggactgccgaaactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctnacaaacaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgt

SEQ ID NO: 581771 - DNA, 368 bp, Homo sapiens
gcccaggtagatttcccgggttcatgcggctgaacttgggcgcatgctgcccgcggcaaacagccaaccgccgagggccaccgggccgatcagcgcggcagcaacaaggtgatcaggatcggctgcaccgccagcagcgcgattttgcccgaatgcagcaggtactggcccatggcatcggggttgagcagcacttcgcgcggcaagctgaagttgtgcttcatcatctccagcaggtccagcgccaggccaccgccgtagatcagcaaggcgccggcgccggcgatcatggtggcgaaggtgtagagctctttggagcgcgcgatctcgcccttttccctggagtcctttttacgtttctccgtggg

SEQ ID NO: 581772 - DNA, 1017 bp, Homo sapiens
  misc_feature (34)..(34): n is a, c, g, or t
  misc_feature (65)..(65): n is a, c, g, or t
  misc_feature (67)..(67): n is a, c, g, or t
  misc_feature (242)..(242): n is a, c, g, or t
  misc_feature (263)..(263): n is a, c, g, or t
  misc_feature (269)..(269): n is a, c, g, or t
  misc_feature (288)..(288): n is a, c, g, or t
  misc_feature (296)..(296): n is a, c, g, or t
  misc_feature (307)..(307): n is a, c, g, or t
  misc_feature (339)..(339): n is a, c, g, or t
  misc_feature (341)..(341): n is a, c, g, or t
  misc_feature (345)..(345): n is a, c, g, or t
  misc_feature (376)..(376): n is a, c, g, or t
  misc_feature (390)..(390): n is a, c, g, or t
  misc_feature (401)..(401): n is a, c, g, or t
  misc_feature (427)..(427): n is a, c, g, or t
  misc_feature (436)..(436): n is a, c, g, or t
  misc_feature (455)..(455): n is a, c, g, or t
  misc_feature (468)..(468): n is a, c, g, or t
  misc_feature (472)..(473): n is a, c, g, or t
  misc_feature (476)..(476): n is a, c, g, or t
  misc_feature (489)..(489): n is a, c, g, or t
  misc_feature (494)..(494): n is a, c, g, or t
  misc_feature (496)..(496): n is a, c, g, or t
  misc_feature (807)..(807): n is a, c, g, or t
atccttgcatcgggcagcccacactgaggatatnaatgcttgcacgctgaccacgtccccgaggntncctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttntctatccctttgggccctggnagaagnaagccatttgcagtgctgntgtgtccngctccctcccnacattccccatgctcaaggcccagccttctgnanatgngcaagtggatgttgatggtagtacaaaaagnagggcccagccccngctgttggcgncatgagtatttagaggaagtaaggtngcaggcagnccagccctgatgtggaaanacatgggattttngaanncancttctggaggaangcatntnacaggcggcactttcttcaaagagtggtgcagccccaaacattttgcacataaggcaccaaacagcccaggactgccgaaactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctnacaaacaagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgt

SEQ ID NO: 581773 - DNA, 347 bp, Homo sapiens
gccctgtcccatctgcggccacgctactcgctcctctcccaacaactcttttcgtgttgacaaaagtgacaattgtagggcaggcacagtggctcacgcctgtaatcccagcactttgggaggccaaggcgggtggattacctccatctgtttagtagaaatgggcaaaaccccatctctactaaaaatacaagaattagctgggcgcggtggcgtgtgcctgtaatcccagctatttgtgaggctgaggcaggagaatcgcttgagcccgggaagcagaggttgcagtgaactgagatagtgatagtgccactgcaattcagcctgggtgacatagagagactcca

SEQ ID NO: 581774 - DNA, 639 bp, Homo sapiens
  misc_feature (1)..(1): n is a, c, g, or t
  misc_feature (62)..(62): n is a, c, g, or t
  misc_feature (81)..(81): n is a, c, g, or t
  misc_feature (117)..(117): n is a, c, g, or t
  misc_feature (119)..(119): n is a, c, g, or t
  misc_feature (131)..(131): n is a, c, g, or t
  misc_feature (134)..(135): n is a, c, g, or t
  misc_feature (139)..(139): n is a, c, g, or t
  misc_feature (144)..(144): n is a, c, g, or t
  misc_feature (146)..(146): n is a, c, g, or t
  misc_feature (153)..(153): n is a, c, g, or t
  misc_feature (162)..(162): n is a, c, g, or t
  misc_feature (164)..(164): n is a, c, g, or t
  misc_feature (166)..(166): n is a, c, g, or t
  misc_feature (174)..(174): n is a, c, g, or t
  misc_feature (207)..(207): n is a, c, g, or t
  misc_feature (212)..(212): n is a, c, g, or t
  misc_feature (215)..(215): n is a, c, g, or t
  misc_feature (222)..(222): n is a, c, g, or t
  misc_feature (224)..(224): n is a, c, g, or t
  misc_feature (233)..(233): n is a, c, g, or t
  misc_feature (272)..(272): n is a, c, g, or t
  misc_feature (277)..(277): n is a, c, g, or t
  misc_feature (279)..(279): n is a, c, g, or t
  misc_feature (285)..(285): n is a, c, g, or t
  misc_feature (292)..(292): n is a, c, g, or t
  misc_feature (294)..(294): n is a, c, g, or t
  misc_feature (301)..(302): n is a, c, g, or t
  misc_feature (310)..(310): n is a, c, g, or t
  misc_feature (315)..(315): n is a, c, g, or t
  misc_feature (321)..(321): n is a, c, g, or t
  misc_feature (328)..(328): n is a, c, g, or t
  misc_feature (331)..(331): n is a, c, g, or t
  misc_feature (335)..(336): n is a, c, g, or t
  misc_feature (340)..(340): n is a, c, g, or t
  misc_feature (348)..(349): n is a, c, g, or t
  misc_feature (355)..(355): n is a, c, g, or t
  misc_feature (373)..(374): n is a, c, g, or t
  misc_feature (379)..(379): n is a, c, g, or t
  misc_feature (387)..(387): n is a, c, g, or t
  misc_feature (390)..(390): n is a, c, g, or t
  misc_feature (394)..(396): n is a, c, g, or t
  misc_feature (401)..(401): n is a, c, g, or t
  misc_feature (411)..(411): n is a, c, g, or t
  misc_feature (434)..(434): n is a, c, g, or t
nctgacttttgggactgagggactgtttttttggacgacttacttactttactacttacctnacactttactgacttgacnggactgggttactttttctcgcgcttttcttttttncntgctgttgtttnttnnttgntttgngnttgtttngtttgttgntntnttttttgntgtggctcgctttttgcgctcattgcggcccgntgggnttngttggtntngtgtttggngggtccttctggttgttttttcgtctttccgttttgttnttttngngttggnggtttgngntgttgtnntttttggntttgntttttnttttttnggnttgnnttgngtgttggnntggtgntgtgatgggtgtgatttnngagtnttggcatnatngctnnnttttntgcttccatnatctgcccctatttttcttttcntcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgt

SEQ ID NO: 581775 - DNA, 205 bp, Homo sapiens
aaaaaaaaaaaaaaattttaaaaaataatttttaggggggacccattttttttaggttttcccccgaacttagggagggggggggggttgttttttttttttggaaaaaaaccttttaattttttttttttaaggcccttccaaaatttgggaatgggggggggcccaaatttttaaagggttttgtttttccttttttttccca

SEQ ID NO: 581776 - DNA, 622 bp, Homo sapiens
  misc_feature (32)..(32): n is a, c, g, or t
  misc_feature (73)..(73): n is a, c, g, or t
  misc_feature (88)..(88): n is a, c, g, or t
  misc_feature (101)..(101): n is a, c, g, or t
  misc_feature (122)..(122): n is a, c, g, or t
  misc_feature (135)..(135): n is a, c, g, or t
  misc_feature (269)..(269): n is a, c, g, or t
  misc_feature (295)..(295): n is a, c, g, or t
  misc_feature (367)..(367): n is a, c, g, or t
  misc_feature (369)..(369): n is a, c, g, or t
  misc_feature (373)..(373): n is a, c, g, or t
  misc_feature (379)..(379): n is a, c, g, or t
  misc_feature (398)..(399): n is a, c, g, or t
  misc_feature (403)..(403): n is a, c, g, or t
  misc_feature (410)..(410): n is a, c, g, or t
  misc_feature (417)..(419): n is a, c, g, or t
gggggggagcgcgcggggggggcgcgggcgcnggggagcgcggggggaggggtgtggcggggggggggggggngcgggggggggggcngggggcgcggcgntgggcgaggcggcggggcggncgcgcgcgcgcgnggcggggggcgcggggcggggtggggggggggggtggggggggggcggggggggggggggggggcgggggcgcgcggggggcggcgggcgtgggtggggggtgggcgcggggggcgggtggggggtgggtggtngggcggggcggggcggcacgtgcggngcgcggggcgcggcgggcggcgggcgcgcggcggcgggggggcgaggtgcgttgcgcgggggggtggcgggngntgtngggcgngtgcgcgggggggcgtgcnngctngtggggngggggcnnnagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgt

SEQ ID NO: 581777 - DNA, 805 bp, Homo sapiens
catgattaaatgtctttgcttccaatagagaacaccacgagacttatgtgggacgcctaccttcttcacaggaggacacagctgagtctgaaggacgagaaacactgacacatcagctgcctctcccagcagccgccatgagaagattgctacctgcaagcagagtgtcctctcaacccgtgctgaggctggcagacagtgctgagtgacttctgggcaggcctgctctgtgggctctaagattcctgctttgccctccctctcaggcgcaccgacaactactgctcagtgccagacactgcaccatgtggcaacacgtggcagtgatgattagtcacaaaatcacgtttatgttcattctaatgaaactgccattgcaaaattgtaactgagacagtgaaagaagtctgacctaaccaccttcatcttgcttctaacctccaagctggactttgttaattcctcgggactcattgttgggaggaactcagtctatagcttccagtttaatacacagcacatcacagatctttcccaaaacaacccctttttgcctgaatccagactgtttttgtaggataacacattactcgaaaaatacaattctgggttaggagtcccccagctggaaatgactcattccgaccctcctcattggtgctgtggatccactctgtgctaggcctccatcactgttcgaatttctgcaccctgcctcggtgaccctttgacctcccaaaccgttattcggttttcttattgtgcccccccagagttgccaatgaaaacactgtcttattccttg

SEQ ID NO: 581778 - DNA, 1241 bp, Homo sapiens
  misc_feature (127)..(127): n is a, c, g, or t
atggcggtatcgcttgcgattatggctgactaagtgaggtgaagcagcagattgtagacattcacaagcaagcattattcactcattgtgaccaaagcatgcgtgcatgtgagactatcacccaacnaacgtgcacatgtgggcaacgtgatcaacgcaagcatctcgctctagcggccagcaagtccaccaccagcaccatccatgccagttgacctgtgcaccactgcattgccatggggcaggtcaccatcgctttgagttgtgtcaatagtgcgatcataattgcacgtgcaccaatgcacagtaatcctagtagccaatttgcattgcgtcacagcatgagccatagcaaatgcacgactcagtacctcgtagcacaccacatcaacacttcattcatgcacatgcacattgcccgtggtgttagatattagcataacagggcattgggcgatattagatgagtaatcatttaaggttagcgtaggcgatctacacgcatatctgtccctatatagttgcattgcaccccacaccgctctgtgcgcgcatcagatgtcgcatatcaggcattagcacaggcatatataaagcattcgcacacattgcatctccgtgcacacaggcaaggcatcatactgcatagaattgcattgtgtacctagctgacaccatacttgagactgacgattgcgtgtactcacacatgacatgtgcgctatcgacacaagcagagtggacagcgtgtgttccagaactaatgtttagtcacaacgttttggttgcttgcacttagggatcgagtgtaatctcctgactctttaaatcaattccgttaactgttacaacccttacttgttgtctcagacatggtcgatcttatcccttaacatgttataaataaacacgtactgggggtaggcatttgctacttctagcgtacactacaaatatccgcccgacgaataagcctatcatgactgtattcagaacctagtactgtacgtgcacgatatcacacgttgtcaatccatcaggatatgtaagtccagtacacactggtcgccactggtgtcattactggcgggcaatctactccacagtcgcttatgccactctaacatggtgtgaccttaacgttgtctcggtaggggacaacctgtgattcaccatcaggacaatcatattagcacgtatgtaattaccagacggtctaccctacagcacactgcatagcc

SEQ ID NO: 581779 - DNA, 397 bp, Homo sapiens
  misc_feature (283)..(283): n is a, c, g, or t
  misc_feature (302)..(302): n is a, c, g, or t
  misc_feature (322)..(322): n is a, c, g, or t
agatttcttgtgtaatacctgacaaacaggcaaccaaagcaaaagtggacaaatgggatcacatcaagttaaaaatcttctgcattgcaaaggaaataacaaagtgaagagacaacccatagaatgtgagataatatttgcaaactatccatctgtattaggccatttttgaagtactacaaagaaatacttgagactgagtaatttataaagaagaggtttaattgggctcacggttttgcaggctgtacagggaaggcatgggtgcttaacatctggatcnggcttgtagggggagggcntcagggaagtttcccaaccntgggtgggaagggggaaaaggggggattaagttttcttcacctgggccaggttgccagggggccaaaggaggagg

SEQ ID NO: 581780 - DNA, 269 bp, Homo sapiens
gacgttactcccctaactattggaatttcttgttcagaaccctgtgcagcttcagttttaatagttactgtccagattattttctgttgtggttgtggtagtggtagctctcattccctaacagctgttagtgccaagtattttctcaatctttttcaaggattctacttacacctatattagacaaactaagttgcctcgaagttcattgatgatctattctttttttgtgtgtgtggtataactaaataattcacttgttttttggt

SEQ ID NO: 581781 - DNA, 126 bp, Homo sapiens
agctgaacgaatcccaagtagaataaatccaacagaaattccacactaaaacacttgagttatacttctgagaactattaaataaaaacaaaaaaaaattaactgagcagggttaggtctacctgg

SEQ ID NO: 581782 - DNA, 217 bp, Homo sapiens
ggtacttagaggatcccaggcaaagctcctacctgtttgcagagcacctggcgaaaggattcatagctctgtcaccaggcaggagtgcagtgggcaatctcagcttactgcatgctcactttctggggctcaagcgaatcttacatttcaggcttctcgagtagctggaacacaaagcgtaatgcgccacgtctggctaattttttggcattttttg

SEQ ID NO: 581783 - DNA, 528 bp, Homo sapiens
  misc_feature (6)..(6): n is a, c, g, or t
  misc_feature (42)..(42): n is a, c, g, or t
  misc_feature (56)..(56): n is a, c, g, or t
  misc_feature (68)..(68): n is a, c, g, or t
  misc_feature (104)..(104): n is a, c, g, or t
  misc_feature (114)..(114): n is a, c, g, or t
  misc_feature (117)..(117): n is a, c, g, or t
  misc_feature (130)..(131): n is a, c, g, or t
  misc_feature (136)..(136): n is a, c, g, or t
  misc_feature (145)..(145): n is a, c, g, or t
  misc_feature (150)..(150): n is a, c, g, or t
  misc_feature (159)..(159): n is a, c, g, or t
  misc_feature (163)..(163): n is a, c, g, or t
  misc_feature (345)..(345): n is a, c, g, or t
  misc_feature (356)..(357): n is a, c, g, or t
agggcncggcaatcctcatcccactatcttgataattgaagncgggttcccatgtnccagctgtcccnaccctcactaaccaaccacctccttacctcccaatnctggattacngtntgacccctcctcnngctgnccgttctgncttgntcatccctnctanccctccagactccagtgtaacctctctttcagattttacctgcccacctctgactctttttttgcacagaatcggatttatcttcctcaattcacacagcagctcatagatacaattagttcactattcatagagatagaccaagttaaggctatatatgttctgtcatataatatcatccnatatatacatnnagagatatatacacatttattaaattgcttaagtcagttcactgtgtagattgttatattcttgagatgaaaggctaggtctcatgatttttgtgttctgactgcctagtagtacactagtaggtagtattggtaggtagatactacataaatttttaagaaaactcgtgc

SEQ ID NO: 581784 - DNA, 399 bp, Homo sapiens
  misc_feature (40)..(40): n is a, c, g, or t
ggtagggcaaccgcccaaccttaaaaccggaagtaatggnaaccccatggagagtaccaatgatgggttacccagaggccaggaaaggtagtgggggatttaggggatgggacaaggaatgacctaatgggtacaaataaatagttacaaagaatgaataagattgaatatttgatagcacaatggggtaactaaattcaataataaatttaattgtacatttttaaataatcaagagtatacttggattctttgtaacactatggataaatgcttgaggtgaaggagatcgcatttactctgaagtaattattacacattgtgtatctgtatcaaaatatctcatataacccataaacatatacatctgtccatgtacccacaaaaaataaaaaaaaa

SEQ ID NO: 581785 - DNA, 209 bp, Homo sapiens
gtcaagacagtgccatggtgcccaccaccatgcccatctctactaaaatacgaaaaaattagccaggcgtagtggtgcacacctatagtcccagctacttgggaagctgaggcaggagaatcacttggaacccaggaggtggagattgcagtgagccgagattgcgccactacattccagcctgggcgagagtgagactcgtcccatgg

SEQ ID NO: 581786 - DNA, 1405 bp, Homo sapiens
cctgacgccgcccctatccgaggctaaatcggctgcgtacctctcggaacgcgccgacagaaggggtcctggtgacgagtcccgcgattctctccttgaataccactcgccagcacactgccgccctctgaccgacgcaccctgcacaccacgcaccctctcctgtgccaggaactatgctacataccagcaacatgccctaccaatatccagcacatgaccccggagcagaagacgtgacgctgtctgacactcgctcaacacgcatcgatggcaacctggccacaggcgcatcctgtgctgcacgatgagtccacatgggacagacatatgccaaactgtgctgtatgtccactcgcgccccgccgaaccaccgaggaagaacacggaccgcacacataacacgccagcaagacagctgacacgcctgcaccgaaccgacgatgaacaccccagacaaatacagagcggagttgaacatacctacattaccacagacgaccccaacaccataccatgaccggcaacgcctgaacgcgcccagcaccacaatcacaacccacacacaaccacaagtaccaacaagacgagagatgatcgaagagccaaacaacgcaacaaagccacggcaccacagcaacacacccctgacagacgcaccacaaccgaaccacagaaccccaacacaccacaagagaaaagcacaataagagaacagaccaaagacaccagccaccgcacaccccaacgacaccaagaggacaaagacactcaacacaaccgcacgcacacgcaccaacaacacaccacaccgaagaagcctccaaaccaccacgagaggcacccacacccccaccccacacaaacacctacaaccgagaacaattggacaccacaagaccacaaattgaatcaaggaacactgatcaaatgtaccacgatcatcacgtccaatgcaaacaaagtgtaaccactgataccacaaatcttaagaactacactaagcgtaccacaccactgtaattgatgaagctcacctcacaaagcaaaacacgccaactgacaactagatacccctactataaagcgaataaatataaacaccaccgactcatcagaagtcacccactcattcagattagaactacacatatcatcataaaacatacattgtacacatataaccataaccacaatcacctaccatcaataacatataaaacataatgactacaaccccataaccacaacacaaccacacaacaatagaaaacaatacaatactattacatcaccataccataataacaatatatcgacatacataaaaaactcatactataccaacactaatctaatcacaaaaaccaattaataacaatatcctcacatgtacatccaatat

SEQ ID NO: 581787 - DNA, 937 bp, Homo sapiens
  misc_feature (45)..(45): n is a, c, g, or t
  misc_feature (110)..(110): n is a, c, g, or t
  misc_feature (112)..(112): n is a, c, g, or t
  misc_feature (121)..(122): n is a, c, g, or t
  misc_feature (124)..(125): n is a, c, g, or t
  misc_feature (128)..(129): n is a, c, g, or t
  misc_feature (132)..(133): n is a, c, g, or t
  misc_feature (143)..(143): n is a, c, g, or t
  misc_feature (146)..(147): n is a, c, g, or t
  misc_feature (167)..(167): n is a, c, g, or t
  misc_feature (181)..(181): n is a, c, g, or t
  misc_feature (185)..(185): n is a, c, g, or t
  misc_feature (187)..(187): n is a, c, g, or t
  misc_feature (222)..(222): n is a, c, g, or t
  misc_feature (229)..(229): n is a, c, g, or t
  misc_feature (236)..(236): n is a, c, g, or t
  misc_feature (247)..(247): n is a, c, g, or t
  misc_feature (257)..(257): n is a, c, g, or t
  misc_feature (261)..(261): n is a, c, g, or t
  misc_feature (326)..(326): n is a, c, g, or t
  misc_feature (332)..(333): n is a, c, g, or t
  misc_feature (346)..(346): n is a, c, g, or t
  misc_feature (356)..(356): n is a, c, g, or t
  misc_feature (365)..(365): n is a, c, g, or t
  misc_feature (404)..(404): n is a, c, g, or t
  misc_feature (407)..(407): n is a, c, g, or t
  misc_feature (455)..(455): n is a, c, g, or t
  misc_feature (681)..(681): n is a, c, g, or t
  misc_feature (843)..(843): n is a, c, g, or t
  misc_feature (932)..(932): n is a, c, g, or t
attttttttaatgatgaaaaaaaaaatatttatttcttttatttntttataatatataaattatatttgtttgaagaagttgttttatttattttgacagaaagtaagangnaacttttgnngnnttnnttnntttttctgtnggnngccttaagctttctaaattngggacatctaagcnaggngnagggaaaagggggtttcgcaaaatcactcgggggnggggggnggggggnttgttaatcangccctagggngggngattaactgcttgtacaattacgtttcacttttaattaattgtgcttaaggctttaattaaattngggggnncccttcttagagnagctcgtacngaggaaggngcatgggctgaatgatgtcacggcagtggttgaacacanggnggatgttctcagtgtccacagcgcaggtgaaatgagggtagcagtagngacgcccatctccactggcagtgctgatcctcagaaactcatctcgaatgaagtacttggcccgggtcacgcgtgggtcctctccgggctcgggagtagcatcctcaggagtagtgtagcgagcaaattctggaaagtagtcctcaatcttcgatttcccagcaaggactttctcagcgagcagatcttgcttgttgaggaacaggatcacagagatggtgcgcancattctgttgttccagatgctcttgaagaggttcagagcctcctgcaggcggttggtctggttgtcctcccggatgaccatgttgtagctgctgctggccaccacgaagatgatggcagtcacatcgttgaagcactggatccacttgcggcgttcatcgcnctggccacccacgtcaaacatgtggaagttgactttgtccacctggaacttggtctcaaagattccagaagtcaggacacggcagcganagggt

SEQ ID NO: 581788 - DNA, 389 bp, Homo sapiens
gcgtcgactcaagatggagtcttgccctgtcacccaggctggagtgcagtggtgcaatctcagctgctgcaacctccgtctcccaggttcaagcaattctctgcctcagccttcctagtagctgggattacaggtgcccaccaccacaccaggctaatatatttccttgtacttttagtagagttggggtttcaccatcttggccaggctggtcttgaactcctgacctcgtgatacacctgcctcagcctcccaaagtgctgggattacaggcatgagccaccacacctggctggtgcaaagaaactttaaaagtggcatgggctgggtgcggtggctcatgcctgtaatcccagcacattgagaggctcagacaggcagatcgtcga

SEQ ID NO: 581789 - DNA, 103 bp, Homo sapiens
ttttatactaggagatgaatgtaatggtattacatttttaatttcagtttccttatattcattgtatcctatataaaaattgactgatctttatgtgtttact

SEQ ID NO: 581790 - DNA, 377 bp, Homo sapiens
ggacttaccaatatgctgtccataggagccgctctgtgcaggggtctcttcgtgcatgttggggtggatcagcttccgtaccctcctatctaccgcatgcagtgctgtcaagcattgctgactgggcagtatattgtttagaatgaaagacatcataggtcaacacgaatcacataagacacacaagagcaggatttagcttcagttcatttaatttcctattctcttctccttcttttccctccctcttctttatggataagtgagaattcccaccccctcattttttatgcgatgataacaggaagattaattaagatggcagtatctaaaaatggtagattcttttaatgtaaaagaaaaggctatctctgatt

SEQ ID NO: 581791 - DNA, 1421 bp, Homo sapiens
  misc_feature (1421)..(1421): n is a, c, g, or t
gtcctgctgagtctcccctgaacagcagctgcagcagccaatggccccgccctgggtgccctgccatggtgcttcactgctggctgcccagcctggtggtgcttctgtggtgctccctgctttgtccactgtgctgagtggtctcctgctggtacgcctggcctgcatgaatgccctcgatggcaccctgccccactggtgtgcttggtgccctgtcttgggtgcactgctctactcatgccatgtggtgtactgtgctcctaacactggtacttggaaatgaggcttgggagtgcttcacatgatgaatgtgcttgtggttacccactggtgcctctacacttgggcagactggcccgtgaacctgtggcactggcaccaccacatactatctatataggtagcaccgaacaaatagggactggagcctatgagataggcatactccattggctggctacagatatgggagacagcgctgatgcaggaccaacataaaccatatgtgacacttggatacccgagcggttgcaggcacacaggcgtagagacactgacccagcctcattgcgtcataagccgcacatacccagtgtgcccctagtgccttaggcccattacagacaggagccgaaccactcggaggacatacaccttaggaccgggttatattatggtcctcggtggcggcacccaaaacgccgaatttggggcgcattggcgacccagattgaggcggtgcgacaccgaggaggccttgcggcccttaggacaaccaagacaagagttggcacaggtagtgcgccactaggggcccacacgaccacaacaggggacaacctttaggccacatcgaactttggaacgaaaccacaagaggacaagagaggattagcacgcgaaatgtaccacaagcggagccctatatgggatgcaggaaattatgatataagcagctttcgggatgacacacagggattatcaaagacaggacacctcttgatggccaagttaggaaaccccccgaagccattgtgagagatgaaacctcctatggagcctaaaagagttacaccgtaggaaaccacaactgaggtgggtcagcccctagttattatgcacgtcaccgcgccacaaaacggagagggtcggagagattcacaggcgaccaacaaagtcaacaaaagtgcccatcttttacgcagaaggacaaacgagcgcgactatcgagatgagcgccaccaaccataaccacccacatttgcgtgaagcaatgccccgacacataccaaagacacccacacaggatgggcagtagaggtacacgacagtgcatcgtgactaactccccaatatcggcaagtaggcaccattcatctaccacgttttgagcccaagttatgacctacttattatcaacn

SEQ ID NO: 581792 - DNA, 117 bp, Homo sapiens
tgcagtcactatttcttagaaacctttgtggctccttcccagtgactctggaattaaagcccagactctgtttttttgctcagcttatcaatttagcactgtcccttccacctttgg

SEQ ID NO: 581793 - DNA, 334 bp, Homo sapiens
agatatcggcatgtaagtggcatccagcaactggcgcaatggagctttgtcagtggacatgagcttcccagagcttcggcggactgggatgccggccaggccaggtgcagtcactgtgccagcgtcgtcaagcatgtctgcacacagcactgtggcaccagtgcacactcttccacccacccagggggcatgcagcagctgcccagctccaattcttgccccagagagttggctgacaccacaagccccagcaccccatcattgcatggcttgggtcgcagtctccttggttcgtaggcccaggttcaagcatggctccatggcccaatgcagg

SEQ ID NO: 581794 - DNA, 427 bp, Homo sapiens
gaagggccacattttaaatttattttttagtttttgttttttgacaacaaatgattgatgaaataatgcaacacccttaaattccacaaaatgggatggtttttccaacctcctgtggatatggtgcgtgatcaatctattatttaggattaatacaagttcatgctttttgggttatggggaaacaacattaaagaatccagtttacattggttgaaccacaagtataataatccttgaatgtgatcaaacctattgaagacaccggtttaaatccattattttgagacttaacggcgaactgtggcccatccatctccatcagtgtcatttttagcccgacggagagattccctatctttttcagctctccatgaggccttatttttttaaccttcagttggtcggtctcggcctctttcttggc

SEQ ID NO: 581795 - DNA, 934 bp, Homo sapiens
gcggggcaggaggcacgcgcgcgggtgatggcgaggtcgctcggtgcagctgttgcggggccatggcggggaccgcgctcaagagagctgattgggcgagtacaaacagattaacactgaagtccgtccggaaggaacttgtagcaggccccattgaactgaagagaacttttcttgaatgggaggcattgatcatgggcccgagaagacacctgcgtttgagttgaggtgtattgcctgccatcctgaggtttcccactttgattacccggttaagtcccccaaagatgagattgtacctggtgatgatgttgtcagtcccaacgatctaccctgatgggagagtctgcatttccatcctccacgcgccaggcgatgagcccatgggctacgagagctagctgcggtagcggtggagtcctgtgcagagtgtggagaagatcctgctgtgcggtgcgtcgagcatgctggcgagagccctactgcacgaatagtggagctaaggtggatgcgtccatacatgtggagcgatgagcgggagcagtgctataaggattgccaagcagatcgtccagaagtctctgggactgtgagacctggtctcgcacaggcgcgcagcagcagtcgcgagcagctcagccattctcccccgggacacttagtgacagtgatgctctgtgctaggtaccaaacgaggcagacttgcaagaagccatgggcatcttgtagtgatcgacaacctttcctaattcagaccaggccttctctccttgaaatggattgccttcaagtgtccgcaactactcggccagtttacatggcaagtttaaacaagaattcctccacaaaggggttccacggctagattattcagagctggtccagaaattaccttctccccggcgagaacccagccagttcacggttccctgcg

SEQ ID NO: 581796 - DNA, 760 bp, Homo sapiens
  misc_feature (415)..(415): n is a, c, g, or t
  misc_feature (508)..(508): n is a, c, g, or t
  misc_feature (533)..(533): n is a, c, g, or t
  misc_feature (685)..(685): n is a, c, g, or t
  misc_feature (705)..(705): n is a, c, g, or t
gtgacatttggcaatacctgaagacagttttgactgtcactgtttggggtgggcaggagtgccactgaaatgtagtgggtaaaagccaaggatgctgctcaacatcctgcaactcacaggacattcccacacagtatagaattgtctggtccacgatgtcagtatgccgagatgagaaaccctactctagcaccttcatctcggcagatgccttcttttctttacagagaaatagcagctagcttttgggaactccctcatcttttctatttcaaacacaaaacacgtttttcggcactgagcctcatatgttgatatgatagagcgatgatacccttctcctggctgaggcttactgtaccacccatgcgttggacttcaaaacctctcattttctctgtgacatcatactatntttatccattatgtggtcatgtgtattcaaatgtgccttttatattcgcccttttgactttaaaacatacaatttcttaactatgacaaacanaaccaaaagactttcttttctttangtacttgcctgttcttctcctttttacaggcacatttgttcaagtgggtggtaatgataccaggtgtctacaattcgtcaacacttaatcactggccaaacaacttccagtttgctttctggccctaccgactcattttatttaagatcttnctttggcttcacgttggagnagcattcaacaccggttatttcttcctgctttttgaacaactttcccttgtttcg

SEQ ID NO: 581797 - DNA, 362 bp, Homo sapiens
cactggtgctgactttccagccagcgatcctgggctatttgtgcgcaacgggcatggtgacgttcctgggcaacgattaggcgtagtcctcaggctagtcaccctttgcgcgttggcctccagggtttattgcaggcttttactgaccggccgcctgcaccgccagaggccgcacagcatcagccgggtgcagttccagcgagcacacattgatcaggttacgaagtttttcgccgatcacctgggcccggtgccagctcaggccatccatcacgatatcgatcgccagcaggtcgtcttcgcgctgcacgttcacctggcgaggaaccaggaactgcagggcaaaatagttgagcacccgt

SEQ ID NO: 581798 - DNA, 362 bp, Homo sapiens
tggctccaccatttcttaaactgctaagaatgcctcatagcggttgatatagaactcccgctatccttgtggggtctggaatctggatatgtggtaggcagaggatacctatacgaccagtccccagtaaaagtccagggcactgagtctctagtgagcttccctggaagcaagcatcacacacgtgtagtcacacctcctaggtagaggaataatgcacgtactgttgtgactctactagtgcctgcttacccctggacttccaccccatgtagcttataacttaacctgatattattccttgtactctatcattgcaatacatcacggccatgaataccactatcttgctgagtcccata

SEQ ID NO: 581799 - DNA, 669 bp, Homo sapiens
agcgggtttgggtccggcgtggaaatgtatgtcctccgtcggtttttccgctacgtcttctccaccgaacggcgagatatttaggggagttcattccctagagtaactgcattatatgcatcctttcatgacgaagttgctgccgtggagaagactggtaggagactcgaggaacagggagaagccgagccgagatgcgtcgcacgggctaggaagcgtgtccgtgcattagtggtgttagcgtttcgcctgccggggcagttgaggcttgacgtgatcctggcgtggcttactaagataaggacgtactggtcactgctagtacaggaatatgtcgagtaacactagggcgccccagcaatggggcacctctttgctagattatcggtatctcttgatgatgggaaaatgcgtgccacctgagtcaataacgttgcgtgcgtcatggcatctagtacagacgttcagggattacattaagacctgtgtaccatgcactgggtgactgtggggatcatgttgtccatgactgaaccagcaagacacattgcgatttatcgtggcaaacccattgggtaaccataaaagtatacctcttcgtcctacgtggtctacccagtgtggctttagacaccgtaccagtcgtgctcagcttcaccgtgagggatc

SEQ ID NO: 581800 - DNA, 901 bp, Homo sapiens
aggacgaggaggaagatgaggaagatgaagaggatgaggaggaggaggcaagatcacgaagatgacgatgaatgaagaagatgatgatgatgaataagttggttctagcgcagtccaatgagtaatctgggtctatagagagcatttaagccccccctgtacacaagcttcactccttttaaagaaggaagcatctctgagaatgtagagcgcggtgtaccgagtttgttctttaagactgtagcagtgtctctattggtactagtgaacacactaccgagatgtgtctctagaatagccctgtcctggggggtattcttcacatagccagctaactcttgctgggtacagtatggagggtcgtaacattggcatggcaatttaacagcaggttcttgttgtgtgcacatggcacatgttagttatatagtggggatggtagttcctggcatctgcagtggtctctgatgcagttatacgaagataattgtgtatctcgtaaactgaataccactctgtaatttgcaaaaaacaaagaacgtggtgccgctggtgagagaggacattcctgattgctgctagactagaatacaatgtcttcaatacgatgtggtccgccctttgcaataggtctgaagcatactcctccttgcaggggaacgcataggaccaataaggcttcttggcggccattctgggaattcgccatggaattcctgtagcacgtggtttcaacccctttcaactaatcgtccggcacatacgacaggttgtttgttctaaccacccccccgggcatatccaaagggggggggtaacagctatggcccggaaatacggcgcacaacagtaattcaaagatcgccagacttgttcgggaaaaaactcaatagtgcattac

SEQ ID NO: 581801 - DNA, 867 bp, Homo sapiens
gaaaagatcagtgcacaaggaacttgggctggttaggtcccagccgacgcacatctgcatacgtgggctcagtggtgttcggcagtagaatgacatgccgttactccctgcacattccctcatggcatcccatcaacatagcttcatgacaactggaatactgcttgaggattcctcattgtccttgagtaatggggactcatggatgtcgaaccacagtggtaaatccaatttggaccccgtgatggaagtgtcgcagttgatcaagtagtcgcgtccttgtatacggtagtccgtatgtcaggggaatgtggctcgtagaacgtgtacggtcacggtcgcctcatgaaagatgtgtagcaggtggctctcaggcaaaaatagccaaggtctggatcatccatgtggcagctttgcatagggagaggatagctccgaactggaactgaactgccttctctgcacgcttgaccaaagcagtgatgagggcggccagtacctgcggtgtgcgtggtaggtttaaagaacaagggaactgttttctgctgagtgtttcctttgtccttgggctgctcgagctggacagtaggtaaccactgttatacaaaggaccagcccaatttctctggctaggttcggagttcgttgcataccctagctgtgagtgccttatggtctggaaagttgggtgtcgtcataatagccacagctaggaccatttctctctgtcattatgacattgtcccttgtattacattaaaagagaatgtctttgatcactagagtctggacgggttggataattaccactgtgagattcttaaagattattgcttcataactactaaaaaagtcatgtaagagacc

SEQ ID NO: 581802 - DNA, 226 bp, Homo sapiens
gcatgcagattgaaatactctcgagactcaggtcgtgggctgtgagctcctccaggacacattatgacacgtcatgccttctgtactagctgccaccaaatatcaatcttgtggcctgggtccctgttccactaaactactaccaaatactactctgtccctgttagtacaaactgccgcgtatgatcatggtctttcaacgagttccccttacccgagccaggcg

SEQ ID NO: 581803 - DNA, 564 bp, Homo sapiens
gtcgtatactttgaccagcgtaagtacgacaccagtgtggtccacatgcttgaaatcccatcttctactaaaggggacaaaaattagctagggttcggtggcgtacacctattatcccagctactcaggaggctgagccgaggagaatcacttgaacctgggaggcggggttgcagtgagcaagattgcgccattcactccagcctgggcaacagtgcgggactctgtctcagatcaaacaagaaaagaaaattctctcaaagaattaaacagaaatacaaagatggaaaatatgagagacaagataacagttaaaagatctgactaatgacaattaagtagagaacatagtgacttctagctctaaaatggtggtgtagaagcacactggcttcactcactctgccctgccaccacagaaaaccaagaacatacagcactaagatgatcaccagcgacatccaagaactcagatcatagacggagacagttcccaggggcacagagaaattaaagaactccaggcatgctgtaagaatcggacttccgtatctaacacacccg

SEQ ID NO: 581804 - DNA, 292 bp, Homo sapiens
tcaacccagtcaacataaatgatctctaaaactctattatttcaaaactaataactcaaaagaacaaggcgtgtttcataccccactagaacaatcttttcttccaaatgcactttccaatacacttatcatgttatgacccatctcctctatataaatgcatatgggttttaattaaatgtcctttaaagtatacttaaggaaggtgaccgacggtgtgtactcacttcaggaccctgttcatctaatcactctactctcattttactgctaactccaccttcaaacctta

SEQ ID NO: 581805 - DNA, 427 bp, Homo sapiens
  misc_feature (68)..(68): n is a, c, g, or t
  misc_feature (257)..(257): n is a, c, g, or t
  misc_feature (328)..(328): n is a, c, g, or t
  misc_feature (361)..(361): n is a, c, g, or t
  misc_feature (385)..(385): n is a, c, g, or t
  misc_feature (411)..(411): n is a, c, g, or t
gatatggtttgtgtgcccacccaaatctcatctagaactgtagtttccataatccccacgtcgtggangggacctggtgggaggtaatcgaaccatgggggtggttacctccatgctgtccttatgatggtgagttctcatgagatctgatggttttataagggacttttcccccctttgctctgcacttttccatgctgccaccacgtgaagaaggatgtgtttgcttctccttccaccatgatttaagttttctnaggcctctccagccatgctgaactgtgagtcaattaaacctctttcctttaaaaattacccagtcccaggnatgtcttcattagcaacctcagagcagattagncacaattccacaacttggagaatnggtgttcaagtttcactctggccttnaacaacccaaaattta

SEQ ID NO: 581806 - DNA, 909 bp, Homo sapiens
tacctcgtttatttctagtggtctctagtagtgcagctacggtggtgtcatcaggtgtactatcgtccgcgtgtgctgtcacgcaaaggtgtgttgtcgacttcgtaggccttatgctgaatgagtcggtgcccttggcttccctaatatgctgcgaatccccggcatgcagcaaccatggacgccatgtcaaggatcattccgagggggagctgagtacgctgctgggtaaccgtgtggatttgttgatacctccgatctgcaggaattaggtgagatgggcttacaaggatcgggaaaagaagttgggcaaatcctgcggttagacaataccatctgaaggagaacgtggatatgcgttgactgagctgcctaaatgtttcatgaacgaggttctttagtcgctgagacagcccctgatttgggctgaggagactctctcacctatcgtgtggatcttacttcacatcagtctagtgacagtttgtgtgctcggatgtacatctgttactgagacaaggttctcaattttttatagaaaaggcggtatgcccttggatggtgtcatgcctgtatgccaggacagtatgtttaggctgaaggccggtggtatcgcaagctccagggaatggccagatgctcgaaggttgactggatgtggctgcagttgctactcactgatctgggaaaccatgtcttatttgttcctgccattgtcccataaatatcagcaatactagagaaggggaggcctatttgtttgtggctgcgccactcgggactggccaccagtgccgcagtaacggctgatatttacacaggagagaggcaagatatacgggggcccaaggacaaactattggaatcgtgagttttgaacatatttgttgtgtagaacgtgaacactct

SEQ ID NO: 581807 - DNA, 530 bp, Homo sapiens
ggattctaccttatactcctcctcccttgcttgggtgacagtatgaagaccagagaaggaaagaaaagatggaaaggtggctgggcatggtgattcccacccgtaatcccagcactttgggaggccaaggcggtcagatcacttaagatcaggagttcaagaccagcctggtcaacatggtgaaacctcgtctgtactaaaaatacaaaaattagccaggcgtggtggcgcacgcacgcctgtaatcccagctactcagaaggccgaggcacgaaaatcgcttgaacccaggatgcggaggctgcagtgagctgagatcatgccactgcactccagcctggatgacagagtgagactctatctcaaaaagaaagaaagagagagagagagagagagagacagaaagatagatagatagaaagaaggaaagacagaaagaaagaaagagagacagaaagacagaagagaggaaggaaggaaggatagagagatagaaagtggggggggaatatgcatgtcttgaggcccta

SEQ ID NO: 581808 - DNA, 205 bp, Homo sapiens
ttctctcaagactcacgtctcatctgattagcacggacaggatggcccattgggtcttggcttccctcccatcttctcaagcagtgtccttgttgagccatttggatccttggctccaggtggcccctcagtctggactctaccacttgggtctccagatatactggtacgtccttgtgggtcaggatatttctggaagttactc

SEQ ID NO: 581809 - DNA, 381 bp, Homo sapiens
  misc_feature (1)..(1): n is a, c, g, or t
nggtcggtacctgcgtactgggcgatgtatcacagctacctttgtttttttttaaaaagctacaaaacccagtgagcagtccaaccaatactgaacagttctggtttctgcaggtcatcgggtggtctaactcgattttctctttcatcatctgtatctttcttcctttttccagcttccccagcttcttcctccttttcatcctcatcctcatctacatctgtttcctgaagtccaatttcttgttccccctcatggattcactattcgttgttcctcatgccccttgtacttcttcatctgcagtcatcttctttcattcaagcctcttgttctctcagccactccttcattcgtccatgttgtccctcattcttctcc

SEQ ID NO: 581810 - DNA, 305 bp, Homo sapiens
  misc_feature (134)..(135): n is a, c, g, or t
  misc_feature (153)..(153): n is a, c, g, or t
caccccccctcccaccccccccccgagaaaaaggctcaatttttaaaacaatttgcgggcctatgtaaaaaagggatgggattttttttctttttcccttttgtcacccaccgggaagagaaaaattggccagnntgaacgcaaatgcatttncacattcaaaaataactgcaggcctcctagtggctctctacatgatcataaatgaaacaagttttaaaagaaagattaatgctgacttgtgaaggtgtcaaacaagaagcggtgagatggagatggaatgttagaaagattgcacgtcgatg

SEQ ID NO: 581811 - DNA, 271 bp, Homo sapiens
tatattggtggcatgtgaaggcagagcatactaggcagaagtattagcaagtgccaaggcctaagaagtgctaacaactctagtaggagagtgaaaggtcaaaaagtgggcgaaggacatgaacagacacttctcacaagaagacatttatgcagccaaaaaacacatgaagaaatgctcatcatcactgaccatcagagaaatgcaaatcaacaccactatgagactatcatctcacaccagttcgaagggccatcatcaaaacgtcagg

SEQ ID NO: 581812 - DNA, 418 bp, Homo sapiens
ctgtcttatgctgggtcaaaggtggccttatcgctacagccttgaattgctcactgttggcttactaagggcccatatgctggtacagatctcacttccacagcctggacctgagagggctatcactgccacaagccattgtcctgtgaccttgggattctgacgtggtagaatacttcgtaagccaatgttactctgcacttcctgtccggacactactctttcaatcaacggttattctacaaccgcacgatgtcagagttggcaagcacgcgatacctggacaacactgcgggaaactactcaggctctggggacggccggcctagctgactgaacgatagctcttaccgatgatctcagcatccagaccttgcctaccatactgaatatctttgacaatcgatgtcggctgtgc

SEQ ID NO: 581813 - DNA, 284 bp, Homo sapiens
cactacaggacgaacctgatctcttatactagtatccttcatcatttttatttgcacaactaacctcctcggactcctgtctcactcatttacaccaaacacccaaactatctataaacctcagacaatgggcatccccctttatgaagcggggcgccagctgattaatagggctattcggctcttaaggaatttaacaattgcccctaagccccacttttttacccacaaggggacaaccttacaacccccttattccccacactagtttatttattcgaaaa

SEQ ID NO: 581814 - DNA, 145 bp, Homo sapiens
cacgaggggtgatgaaccatttatcccaacggatcttataaatgcagttgtgactgtggttgctgacactgccgaatgtctggcactaatttcagcgcaggaacatgtcattggtagaggattctgctcagcatgtggcgtttct

SEQ ID NO: 581815 - DNA, 125 bp, Homo sapiens
caatgctttcgtgcggaagttgctgtgcgcataatgtttgcgcgtggcggatgtgacggctttagttaataatataatttgataccccgctttgctagggagtagcagcgcaataccaaaaggtt

SEQ ID NO: 581816 - DNA, 550 bp, Homo sapiens
  misc_feature (110)..(110): n is a, c, g, or t
  misc_feature (218)..(218): n is a, c, g, or t
gccccccccgccccaggaaaaaaaaagaatatcccccccgggggaggggggtggttttggggggccccccccgccccggggggccccaaaattcccccccgttttggggnaagagggctctcccgcgcgtttttttatattccccacaaagaaggggggaggtggtgtttgtttcccgggggtgccccccgccccccccatttggggggtttttttcnaatttcccccaggagggggggggagggggtttttttccaccccggggcccccttttgggaagggggcccccccccccaaaggggggggtctcccccgggggccccccccaaaggggggggggaggggggggccgggggggttttccccccctcccccccccggggggggcccccccggtataaggttccccctttaaaaaggggggggccccccccccccccccccccccaaccctttttttttttttttttccttttgggggggggggggttttttgggggggggtcccccccgggttttttttatgggggaaaagggttttcccccccta

SEQ ID NO: 581817 - DNA, 488 bp, Homo sapiens
  misc_feature (166)..(166): n is a, c, g, or t
  misc_feature (193)..(194): n is a, c, g, or t
  misc_feature (201)..(201): n is a, c, g, or t
  misc_feature (204)..(205): n is a, c, g, or t
  misc_feature (215)..(215): n is a, c, g, or t
  misc_feature (246)..(246): n is a, c, g, or t
  misc_feature (251)..(251): n is a, c, g, or t
  misc_feature (262)..(263): n is a, c, g, or t
  misc_feature (271)..(271): n is a, c, g, or t
  misc_feature (282)..(282): n is a, c, g, or t
  misc_feature (284)..(284): n is a, c, g, or t
agaaagaggaggaggagctcgtttctctcaaagacaggatcgagagacgtcgggcagagcgggccgagcagcagcgcattccggaatgagcgggagaaggagcggcagaaccgcctggctgaagagagggctcgacgagaggaggaggagaacaggaggaaggctnaggataggcccgaagaagaaggctttnncaacatnatnnattttggggntacatcagaagcaggccagacagagcggaangtggnagaggcagacnnagcggganagagaagagantntgctagaggaggaaggctctccaattccaccgtaaatagaactaccttaggagaagccaagggctttgcagacaactatatctttgggcggaaaagcttcccctatgaaaggcatcacggaagatatgcaatcctcttgaaagggcactgacctaagccccttccccggggcgaaatacccggccaaaaatccccccccttaaa

SEQ ID NO: 581818 - DNA, 481 bp, Homo sapiens
attccgacagtttttaacacaaatcatcatatacatacaactctctctttcagattcagagaatgtgagttacaaatcagccaaaaaagaaagcaaaaaacaatgaagataagggaggagggagtgtatatggcagcaaaaggaggaagccagctggttagctggccttttaacaaggtatcagggaattaggcccaaggccattaatcctacagttttcactcctctgccaactctcacggcttacattaccgagccattatccagaggatgtacggctgcgaagagggagcggaacgggcgccttctccgcgagtatgaacaggaacgcctacgacgggaaggataacatcgccctgaacgaggacctgagctccttggaccgcgggggacaaccgcgggtcagatcacccagcgcaagtaggaggcggcccgtgtggcggaccaactgagagcctacctggaggggcctgtgcagaga

SEQ ID NO: 581819 - DNA, 540 bp, Homo sapiens
caacagtcatcaacagacattaattgaactcctgatgtgtgccaggccaggcaccaaggaggagcacacagaggtattaaataaagtcctggcccttgaggaacttctggatgatctgaggaaaaaaaagtaggtgggcaaaagcatctgtcaaacccaggcttctcccctatctctgtggtctcaggaaatgggaaagccaaaaagggggacccatgaacaagggtccaagacatacatgcacaggctacacatgtacaaaacatgtgcaaagtccacgcaactacaggacacgtgtacagacacaaggtgcatatgtgtcacatgtgggtgggattcaagtgcaaagcccatatgtgcataagccatgtgactatggcacaagaactccaatctcccaagtcaggctggagaaaaagggggaaaaaccccaagggccccttaaagccccttcaaaggctgaaggcagggaacctggccactcttggggcccgagaaaaaaaattccttccaaaaaaaactggcgaaagggaaagacaa

SEQ ID NO: 581820 - DNA, 359 bp, Homo sapiens
  misc_feature (1)..(3): n is a, c, g, or t
  misc_feature (44)..(44): n is a, c, g, or t
  misc_feature (59)..(59): n is a, c, g, or t
  misc_feature (61)..(61): n is a, c, g, or t
  misc_feature (72)..(72): n is a, c, g, or t
  misc_feature (89)..(89): n is a, c, g, or t
  misc_feature (104)..(104): n is a, c, g, or t
  misc_feature (126)..(126): n is a, c, g, or t
  misc_feature (152)..(152): n is a, c, g, or t
  misc_feature (178)..(178): n is a, c, g, or t
  misc_feature (194)..(194): n is a, c, g, or t
  misc_feature (197)..(197): n is a, c, g, or t
  misc_feature (199)..(199): n is a, c, g, or t
  misc_feature (221)..(221): n is a, c, g, or t
  misc_feature (234)..(235): n is a, c, g, or t
  misc_feature (251)..(251): n is a, c, g, or t
  misc_feature (323)..(323): n is a, c, g, or t
  misc_feature (343)..(344): n is a, c, g, or t
nnngagaggaatgacgatgatgaagaggaggcagcccgggaaangcgccgccgagcccnanaggaacggctncggcagaagcaggaggnagaatccttgggaanaggtgaaccgaccaggtggagntgaaatgccccagaacagtgtgcctnaacgaggaggcccaagaccaaccacncatctaaacactcaantgngnaaggggaatgtatgaggaccgncattcctggaagnnacctggactacggcgntgaggaaagacgccaaaaacgcccttcaggaggtctactggagcggcagaaggagttcgacccaacaataancagatgcaagtctgtcgctnncaagcagaagaatgc

SEQ ID NO: 581821 - DNA, 817 bp, Homo sapiens
  misc_feature (2)..(2): n is a, c, g, or t
  misc_feature (123)..(123): n is a, c, g, or t
  misc_feature (126)..(127): n is a, c, g, or t
  misc_feature (154)..(154): n is a, c, g, or t
  misc_feature (232)..(232): n is a, c, g, or t
  misc_feature (267)..(267): n is a, c, g, or t
  misc_feature (307)..(307): n is a, c, g, or t
  misc_feature (341)..(341): n is a, c, g, or t
  misc_feature (345)..(345): n is a, c, g, or t
  misc_feature (356)..(356): n is a, c, g, or t
  misc_feature (376)..(376): n is a, c, g, or t
  misc_feature (399)..(399): n is a, c, g, or t
  misc_feature (411)..(411): n is a, c, g, or t
  misc_feature (429)..(429): n is a, c, g, or t
  misc_feature (440)..(440): n is a, c, g, or t
  misc_feature (445)..(445): n is a, c, g, or t
  misc_feature (450)..(450): n is a, c, g, or t
  misc_feature (457)..(457): n is a, c, g, or t
  misc_feature (469)..(469): n is a, c, g, or t
  misc_feature (485)..(485): n is a, c, g, or t
  misc_feature (490)..(490): n is a, c, g, or t
  misc_feature (494)..(494): n is a, c, g, or t
  misc_feature (541)..(541): n is a, c, g, or t
  misc_feature (544)..(544): n is a, c, g, or t
tngattgcgagaaatcctccagaatttgcctttgtggaattcgaagatcctagagatgcagaagatgcagtacgagaactggatggaaaggtgatttgtggctcccgagtgagggttgaactntcnncaggcatgcctcggagatcacgttttnatagaccacctgcccgacgtccctttgatccaaatgatagatgctatgagtgtggcgaaaagggacattatgcttatnattgtcatcgtgacagccggcgaagaagaagcagntcacggtctagatcacattctcgatccagaggaaggcganattcttgtcacgcagcaggagcaggggacgaagncagntcagctctccncgacgatcagatctatctcnctcgtagatcaagatcagccacncagagatctagntctggttctataaaggancgaggtaccancccgncgggncagatcnagatccggtctntttcacgaccagagcngccgnccanagcccagccctccatctccaaaaagaagtcgttccccatcaggaagnccncgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagc

SEQ ID NO: 581822 - DNA, 589 bp, Homo sapiens
tcagactctcctcgttcgcgcagtcagctcggctccttccagcaaccatgtctgacaaacccgatatggctgagatcgagaaattcgataagtcgaagttgaagaaaacagaaacgcaagagaaaaatcctctgccttcaaaagaaacaattgaacaagagaagcaagctggcgaatcgtaatgaggcgagcgcgccaatatgcactgtacattccacgagcattgccttcttattttacttcttttagctgtttaactttgtaagatgcaaagaggttggatcaagtttaaatgactgtgctgcccctttcacatcaaagaatcagaactactgagcaggaaggcctcccctgcctctcccacccatctgatggtctggctagcagagagggaaaagaacttgcatgttggtgaaggaaaaagctgggtgggagatgatgaaatagagaggaaaattcaagatggtcaaagatgtcctgcaggatgtaaaatgcagtttaatcagagtgccatttttttttgttcaaacaattttaattattggaatgcacaatttttttaatatgcaaataaagttttaaaacctga

SEQ ID NO: 581823 - DNA, 780 bp, Homo sapiens
  misc_feature (2)..(2): n is a, c, g, or t
  misc_feature (123)..(123): n is a, c, g, or t
  misc_feature (126)..(127): n is a, c, g, or t
  misc_feature (154)..(154): n is a, c, g, or t
  misc_feature (232)..(232): n is a, c, g, or t
  misc_feature (267)..(267): n is a, c, g, or t
  misc_feature (307)..(307): n is a, c, g, or t
  misc_feature (341)..(341): n is a, c, g, or t
  misc_feature (345)..(345): n is a, c, g, or t
  misc_feature (356)..(356): n is a, c, g, or t
  misc_feature (376)..(376): n is a, c, g, or t
  misc_feature (399)..(399): n is a, c, g, or t
  misc_feature (411)..(411): n is a, c, g, or t
  misc_feature (429)..(429): n is a, c, g, or t
  misc_feature (440)..(440): n is a, c, g, or t
  misc_feature (445)..(445): n is a, c, g, or t
  misc_feature (450)..(450): n is a, c, g, or t
  misc_feature (457)..(457): n is a, c, g, or t
  misc_feature (469)..(469): n is a, c, g, or t
  misc_feature (504)..(504): n is a, c, g, or t
  misc_feature (507)..(507): n is a, c, g, or t
tngattgcgagaaatcctccagaatttgcctttgtggaattcgaagatcctagagatgcagaagatgcagtacgagaactggatggaaaggtgatttgtggctcccgagtgagggttgaactntcnncaggcatgcctcggagatcacgttttnatagaccacctgcccgacgtccctttgatccaaatgatagatgctatgagtgtggcgaaaagggacattatgcttatnattgtcatcgtgacagccggcgaagaagaagcagntcacggtctagatcacattctcgatccagaggaaggcganattcttgtcacgcagcaggagcaggggacgaagncagntcagctctccncgacgatcagatctatctcnctcgtagatcaagatcagccacncagagatctagntctggttctataaaggancgaggtaccancccgncgggncagatcnagatccggtctntttcacgaccagagcgtcgttccccatcaggaagnccncgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagc

SEQ ID NO: 581824 - DNA, 427 bp, Homo sapiens
  misc_feature (23)..(23): n is a, c, g, or t
  misc_feature (137)..(137): n is a, c, g, or t
  misc_feature (251)..(251): n is a, c, g, or t
caaagattgttaggcaggcaagngctttccccgccagggttagagagattatctagcagtgcaaaaagaccatggactaaaaaggaatgagataatgccccttgcagagacatggatgaagctggaagccatcatcntcagcaaactaacacaggaacagaaaaccaagtaccgcatgttctcattcataagtgggaactgaactatgagaacatagggacacagagagagtaacagcacacatcggggcntattggggtgggggtgagggtgaggggaggggaagtatcaggacaaatagctaatgcatgcagggcttaacactagggtgacgagttgataggtgaagcaaaccaccatgccacacatacagttatgtaacaaacctgtaagttctgcacatgtatcccggaatttaaagtaaaat

SEQ ID NO: 581825 - DNA, 568 bp, Homo sapiens
  misc_feature (12)..(12): n is a, c, g, or t
  misc_feature (117)..(117): n is a, c, g, or t
  misc_feature (122)..(122): n is a, c, g, or t
  misc_feature (130)..(130): n is a, c, g, or t
  misc_feature (133)..(133): n is a, c, g, or t
  misc_feature (135)..(135): n is a, c, g, or t
  misc_feature (137)..(138): n is a, c, g, or t
  misc_feature (149)..(149): n is a, c, g, or t
  misc_feature (166)..(166): n is a, c, g, or t
  misc_feature (188)..(188): n is a, c, g, or t
  misc_feature (196)..(196): n is a, c, g, or t
  misc_feature (205)..(205): n is a, c, g, or t
  misc_feature (215)..(217): n is a, c, g, or t
  misc_feature (229)..(230): n is a, c, g, or t
  misc_feature (233)..(233): n is a, c, g, or t
  misc_feature (237)..(237): n is a, c, g, or t
  misc_feature (240)..(240): n is a, c, g, or t
  misc_feature (259)..(259): n is a, c, g, or t
  misc_feature (292)..(292): n is a, c, g, or t
  misc_feature (295)..(295): n is a, c, g, or t
ccccctcccgcncccccccccccccccccccccccccccccccccccccccccccccgccccgggccccccccccccccccccccccccccccccccccccgccccctccccccccntaganccagaccngcntncnnccgggggtctngggcgggggcggggagnggggcggggggtggcccacccncaacgagnacaagaccnagaccccggnnnatttcccgaccnngangccnccnaccaaagccccgacccccncccccaaaaagaagtcgttccccatcaggaagnccncgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagc

SEQ ID NO: 581826 - DNA, 313 bp, Homo sapiens
ctaagtatcagtattgtgtctcaattctctaacaactattcttttaatgacagcttaaatcttcatcctaatagtgatttttaattaaaatataactataatgaactaacataataaatatttctttgaatcaggtagctagcacctttgacgttttccaaaataagcacgtctccccagtgtgttcattgtgatgtggtgtaaaagatccacatttaacatacttgaactacttggacttagatgacatcactctgaagtatattaccaaaatgttaattgagataagctgaaaatagttttagtttactca

SEQ ID NO: 581827 - DNA, 414 bp, Homo sapiens
aatatttacgagggagttacaacttttttttgctaagcctttgaatttcttccaatgaagaagttaccataatgtgacccagtgtctcaacgaaattagtaggatctgaaatagcagaggagagaccagttctctttaagcggtgtgttgactttacaccagctttacatttgattctatatgccctgaattggggggcatcttcaatgtatttggaatttttaaatctggcaggccagaaatccaatggcccatttaaggaaaattgtaacctagaaaactgaaattcgtataaaccataatcaagccaaataacagagatcttctgattcaacctttaaaagatatccctatcttatctatctatctatcatctatccagtggtaagaaatttcttcactggagtaaataaa

SEQ ID NO: 581828 - DNA, 85 bp, Homo sapiens
tagaaataatcacgagggttgggtttgctttggaaaatgcctgtctctctacttgaatgataaagaattaaattagaaaaaaaaa

SEQ ID NO: 581829 - DNA, 341 bp, Homo sapiens
cgttctgagatggagtctagcccttgtcgcccaggctggagtgcaatggtgcgatctcagctcactgcaacctccacctcccaggttcaagcgattctcctgcttcagcctcccaagtagctggaattacaggcatgtgcaccatgccggctaatttttgtatttttagtagagacaggttttcaccatgttggccaggatggtcccaatctcttgaccttgtgatccgcccgccttggctcccaaagtgctggattacaggtgtgagccaccgaggcaagcctgcaagaatgtcttttttatcatgggggggctattctctctacgactacctcagggcc

SEQ ID NO: 581830 - DNA, 343 bp, Homo sapiens
  misc_feature (54)..(54): n is a, c, g, or t
ttcccagcccccacggcagtgtcccaggggcaggatcccgtgattcccgggaanccaaatgggcgtgtgttacagtgtgctcttttagccttaccatcagctgacggcttaagtgttaaccagctcaatagaccctctgcctttttgcaagcgcagagggtcagtgtgacagtttctgtatctcagctcttgtctcacctcccagaagaatcaggtcacacatggacttgaaggatgcctggtgtctggagtttatacgggtacaggatagggggtcatggagggccaaaagacgggcctgtctaattgcaggaaaacaaactcagggctcccactgattcta

SEQ ID NO: 581831 - DNA, 1232 bp, Homo sapiens
  misc_feature (575)..(575): n is a, c, g, or t
  misc_feature (685)..(685): n is a, c, g, or t
tggtggctcacgcctataatcccagcactttgggaggccaagtctgacagattgcttgagtccaggaattccaagaccagcctgggcaacatggtgaaaccccatctctactaaaacacaaaagaaattagctgggagtggtggatcgcgccactgtactccagcactccagcctgggtgacagagcaagactccatctctccaaaaaataaataaataaataaataaataaataaaatttaaaaacatacaaacaaacaaaaaaaacagctacttaagaggctgaggtggggggatcacctgagactggaaggtagaggctgcagtgagccaagattgcaccactgcactacagcctgggtgaccaagtgagaccctgtctcaaaaaatgcatagcatcagccatatcccagtacagacattatgataaactacggggcttttcttttcttgagacaggctctccctctgtggcccagactggagtgcaatggtgcgatgtgggctcactgcaatctccaccttccagggtcaagcgatttcccaccccagccttctcagtagctgggactaanggcacaagccatcacaggccaacttaattttggatttttagtagagactggtttcaccaatgtggtcaggatggtccaaactcctgacccaagtgatccgcccaactggnctcccacagaggctgggatgcagtgttgaaccgcgaacccgttgggcgtttcttttcttggtggtttttcttcggttaagaggtgcatctgctacaataaacaggtttttaaaatctgtttccaataaacttctgggagaccctaacttcacccatttaatctccttggctctgaaaaggattttatcttcaactctcggtttttttaagacgggatcaatttttcatacatccacctggttatacttctcacactcttcactgaacatgtgctctttgtttaataccgcttcaacatacctacaactctttctcccggagggcccttctgtactggcctctttgcgtctcatacatctcctcctgatttctacatataattgtttcataatactcgtgtggcttgcctccagaacctttctcatctctcttaacataatgttactttttctctcaacttctatatcacagcctctcacgtcgtaactgtctcttgctcatctttgtggtcctccttgtccattatcggtctcctgttctgtctccg

SEQ ID NO: 581832 - DNA, 769 bp, Homo sapiens
  misc_feature (295)..(295): n is a, c, g, or t
  misc_feature (305)..(305): n is a, c, g, or t
  misc_feature (320)..(320): n is a, c, g, or t
  misc_feature (348)..(348): n is a, c, g, or t
  misc_feature (363)..(363): n is a, c, g, or t
  misc_feature (366)..(366): n is a, c, g, or t
  misc_feature (415)..(416): n is a, c, g, or t
  misc_feature (454)..(454): n is a, c, g, or t
  misc_feature (480)..(480): n is a, c, g, or t
  misc_feature (485)..(485): n is a, c, g, or t
  misc_feature (494)..(494): n is a, c, g, or t
  misc_feature (505)..(506): n is a, c, g, or t
  misc_feature (525)..(526): n is a, c, g, or t
  misc_feature (556)..(556): n is a, c, g, or t
  misc_feature (568)..(568): n is a, c, g, or t
  misc_feature (593)..(593): n is a, c, g, or t
agcggggatgggaactggaaatctgagctcacagtgacgtggcccttaggagacccagagccaatgcgtggattagtccctcatcctagttgcagtctggtagttgtcgctggccgtgtgacggctcgctgttgccctgaaggcaggcgagccagctgcccaggaaaggtggaaagtggtagaagctgacccctgagccctggcaggtctttaagtgcgtttgtgcagccgatttcaaggctaagagagaaagactgcctctgatccctgaaggaagaaaaaaaaaaaaaaaacnggaaaaaaantcaacattggaaaantgtccccaaggaaaacaaagttgtgganaaggccccagtgcanaantgaagcccccgtttaggagggtggtgaataccaggagccgggaggaaanngttaagggggttggggctccaccttgccccggggtttngggagaggatgtgcccaatagggctngtcgnataacatgnatatgatagannggagatggagatgatatgnnacgggttcagggaggagatgagagagctanggaggaaaattngggaacttcagtggaggtacagtcngcgcattcttataggggaccctcctcaccatgatcatcatgatgagtttggccttatgccttgaatctggaggttaactactcataaaatcccgggtttctaaatttcgcattttttccgggtgtacctttaatgtgaacccttgtggcattcttctgcaattttctgatgggaga

SEQ ID NO: 581833 - DNA, 879 bp, Homo sapiens
ggcggactgcggcgcacttccgtagaggtggacatggcgtgcggattcgccgcgctatagttgcaagctttccagaagtgtgaatcttccaccagaaaaacttgatcacatcaatatctgcagttccaatttcccaaaaagaagaagtagctgatttacagcttctgtggattcttttatgggaaaaagacaatgaccattcaagaccagatattcacgttcaggccaagagatagcagagaagctaagatgtgatccagtgttgagtgacaatccagtactggtcaacaggcctgtaaatttcaaaaataaacagagagctcttaacaaagacagtgctacaacacgtacttgaagatgggtcaacacatctggcattacacagagtgaacttttctctggaacttccccagaagacgatgtggttgaacttcagttcacctatgttgccaaaaaattccatgtgggacatttgcgttctaccatcatagggaaaattttatagcaaatctcaaaagaagcttaggacatcaagtaataagaataaattaccttggcgatgcggcatgcagtttgggtcttctgggaacctgttccagatgtttgctataagaaaaaagtgagttcaaatcctctaaagcatctcttagacgtttatgtacaagttaataaagaagaggcgatgataaagtgaggcaaagcagcaaggagtcttcaagattggactgggatgtggcacacttactgggaaattcggattgccttaaaggattcggttaacggtggggttttgcgaaccggaacatttcgggaatcagcgtaatgggaggaggctagaaaaagagggtggtctggggccccattgaagagagagtgtac

SEQ ID NO: 581834 - DNA, 245 bp, Homo sapiens
  misc_feature (36)..(36): n is a, c, g, or t
  misc_feature (52)..(52): n is a, c, g, or t
  misc_feature (74)..(74): n is a, c, g, or t
  misc_feature (90)..(90): n is a, c, g, or t
  misc_feature (95)..(97): n is a, c, g, or t
  misc_feature (99)..(100): n is a, c, g, or t
  misc_feature (104)..(104): n is a, c, g, or t
  misc_feature (130)..(130): n is a, c, g, or t
  misc_feature (143)..(143): n is a, c, g, or t
  misc_feature (190)..(190): n is a, c, g, or t
  misc_feature (198)..(198): n is a, c, g, or t
  misc_feature (202)..(202): n is a, c, g, or t
  misc_feature (204)..(204): n is a, c, g, or t
  misc_feature (243)..(243): n is a, c, g, or t
gggaggtggagcttttgagtgagcggagattgcgcnactgcactccaggccngggcaacagagtgagactctgntctcaaaaaaaaaatnaggcnnngnngtgnatggcgccacacctgttaatcccagnctacttgggagtnctgtaggcaggagaatcgcttgaactcgggaggcggaggttgcagtnagccaggntcgntncactgcactccagcctgggtgacagagtgagactccatntc

SEQ ID NO: 581835 - DNA, 329 bp, Homo sapiens
  misc_feature (61)..(61): n is a, c, g, or t
  misc_feature (64)..(64): n is a, c, g, or t
  misc_feature (167)..(167): n is a, c, g, or t
  misc_feature (175)..(175): n is a, c, g, or t
  misc_feature (178)..(178): n is a, c, g, or t
  misc_feature (199)..(199): n is a, c, g, or t
  misc_feature (205)..(205): n is a, c, g, or t
  misc_feature (279)..(279): n is a, c, g, or t
  misc_feature (292)..(292): n is a, c, g, or t
  misc_feature (312)..(312): n is a, c, g, or t
  misc_feature (328)..(328): n is a, c, g, or t
ggagaagatgctgctgtccctggtgctccacacgtactccatgcgctacctgctgcccagngtngtgctcctgggcacggtgcctacctacgtgttggcctggggggtctggaggatgctctccgactttctgcccgaccgattataccaagcgctggacgaccggntgtactgngtntaccagagcatggtgctcttnttcttngagaattacaccggggtccagatattgctatatggagatttgccaaaaaataaagaaaatataatatatttagnaaataattaaagnacggttgaatggattgttgntgacatcttggccatna

SEQ ID NO: 581836 - DNA, 87 bp, Homo sapiens
ctgggagcaaacacgtttatgagtgtgtcggaatcccgtgcttaaaaaacgctcctaaattatttttctagtcttaaaaaaaaaaaa

SEQ ID NO: 581837 - DNA, 306 bp, Homo sapiens
  misc_feature (5)..(5): n is a, c, g, or t
ggtantagctcaagtgaagaagtgatgtgggcgggcaccgtgctcacatctgggttccagcactttgggaggccaagttgggcggatcatctgaggtcaggagttcaagaccatgcctggccaacatggtgaagccctgtctctactgaaaatacaaaaattggccaggcatggtggcgcacacctgtggtcccagctgctcgggaggctgaggcgggagaatcgcttgaacccgggaggcggaggttgccgtgggctaggatggcgccattgcactccagcctgggcaagaaaagcgagactccg

SEQ ID NO: 581838 - DNA, 133 bp, Homo sapiens
tacccgttggcgaatttggtgctaataaagcaataaggtttttcaaaagaaattgtaacatctttggaaacactgtctggttctaagttcccgactgcctttatttcccacatggaagttcatgcacgatgga

SEQ ID NO: 581839 - DNA, 244 bp, Homo sapiens
tacaagagcttgaagacagataaaaagaaaatgtcccatctgagggagagagagagaagaatttgaaaaatgaactgagcttcacctcagatctgtgggacaagaccaaaggtttctcatacatgagaactggagtctcagatggagaagaggaggagaatgaggaagaaagaatacttcaatactggctgaaaagtttctgttgtagtgcaaaacataagctgaaacaagcagttcagtaaac

SEQ ID NO: 581840 - DNA, 750 bp, Homo sapiens
ggaactaagtaataggtgcgagaccgggttttatttccgtcatgggccctgggtatggctgtctaaagcatccggcgcagtgatcctgaagctcacgaagggcaagttcccattccactttgtgggggtcgtcgcgtgtgctggaggatgcttaaatggcagaggcaagcccagactccagacggacatgcggataaggccctgcttgcggaagatggaaggcatttacgctgacatcccatgtgcggcgtccggagtccagtgcacacgtgcagtgagctgtaccaggagtggctggaggggatcaactcccccaaggcccgagaggtgctgcataccacgtaccagagccaggagctgtggcacacaacagcctggacatcaagtggtgaagtcagggccagggccttccagcttgctcttgggggccatgagccaaatgagcctctcagtagagggaggggcttgcctgagttggagtattaaagacacttaagagaaaaagcataaaaaactaaaaaacattcgagaggaaatcaaaatgtagaggagtgaggggaaacaaaagagggaaacttgaacaaggggaacaaggtggaaatataggtgtgttcacatgagacacaaggattctgttagtaccaaaagggtggatcaaatattggacgggagaaacccaaatatagagaaggaagactataaatgcggaaaagacaggtataacccgtgattaatgaactgggaaaaggg

SEQ ID NO: 581841 - DNA, 174 bp, Homo sapiens
ccaggcaggacgcagggccaatgaatttacgctgtgaaggtctgtccatgtgcagcgggaagcaacggggcaggggtgaataaaggtctccattcctcaagcaagagagacggacatctggtcctgatgtccccaacactgttcatcagtgtttctcctgggcccactaggatg

SEQ ID NO: 581842 - DNA, 133 bp, Homo sapiens
ccagaacttctcagactgtggcatgccatagcatttgggaaaagtgcaattgaatttctagagaatgcatattagaagtatggagcccctatttagggtttaccatggtaggcaagacatttactttaccttc

SEQ ID NO: 581843 - DNA, 142 bp, Homo sapiens
ctcggcgcagcagtgtggcagcgggactcaacccagaactgagcagaatcggaagagccagacggaggcttaggacgctgtatgcagagctgcgcgggagaacgagcggcttcgggagcgcctgacctgagaccacgctgcg

SEQ ID NO: 581844 - DNA, 580 bp, Homo sapiens
ggatgtaataaccacacaaatagggttataatacattcttcagggaaaaaaatttttggtccatattttctaaaaaaaaacacacacacttccctctttggcaaaagaggttaaatctcccatagttaactcacaaaagaaactcaaataaaaactactgagcatgaggtacagctgatgtctggactgttctggaattacagacgcctccttgaggggaaaatcatttcttataaaatgagatcagtttccaacagtttcatgtcagtagaaaagctcgaattagacttggtcagaatcacttttgcatgaacaagttccaaataactttgtttttcagaagacagcggaaagtcccaaaaatgtgctactttctgagaaagtcatggaaaatgtgggcgtttgaacttagcaataattttaaatctgaggtacgaaaacattttacacaggcatttacacctgtatttctgtgcccaccttatggtcaccggagcttgggccgacctcttttgattcccccttgaaatggagaccaaaggaaacgggcccccgcttgagggggggggtcctttgccgg

SEQ ID NO: 581845 - DNA, 790 bp, Homo sapiens
  misc_feature (71)..(71): n is a, c, g, or t
  misc_feature (95)..(95): n is a, c, g, or t
  misc_feature (100)..(100): n is a, c, g, or t
  misc_feature (109)..(109): n is a, c, g, or t
  misc_feature (116)..(116): n is a, c, g, or t
  misc_feature (122)..(122): n is a, c, g, or t
  misc_feature (270)..(270): n is a, c, g, or t
actggggatgagatgggagggtgctattcgggatgaaactgttctgcctcagatcatcaggcattggattntcataaggagtgcacaaccctganccctntcatgcacngttcacnataggnttcacactcttgtgagaatctaatgctgtagctgatctgacaggaggcagagctcaggtggtaatgcttgctcactcactgctcgcctcctgctgtgtggcctggttcctagcaggccatggagtggtactggtccatggcccagggnttggggacccctgccttacaccacatggcgtgctccataatacacaaaccatcctaataacatagactgactctatacttacttgcctcaataacattaagacacaccttagaccacataaaaatgttagataacatacagaaaaaaacacataaataacagacatgccctataacacttacactcgcctcatagcactcagtctcctgtgacagctggatttacccccaaaatacctagacctaccccaaagcacccagacatgccccacataaccagaaacatcacatatcactcaaacaccttccaacaatcagacttgcctggcaacccagactgtcctacaatacacagtaatggcccacagccaagagacttctcacaacttacagactggccacaaaaagcatctttttgctttcacaacatcaagactttccacacagcacatagaaacaatggacattcattcagtcttacagcctagaaacctgtacacgcacaatgctgctgaagggac

SEQ ID NO: 581846 - DNA, 330 bp, Homo sapiens
  misc_feature (297)..(297): n is a, c, g, or t
cccgcctcagcctccggagtagctgggattacccccaaaatacctagacctaccccaaagcacccagacatgccccacataaccagaaacatcacatatcactcaaacaccttccaacaatcagacttgcctggcaacccagactgtcctacaatacacagtaatggcccacagccaagagacttctcacaacttacagactggccacaaaaagcatctttttgctttcacaacatcaagactttccacacagcacatagaaacaatggacagagttcagaccccagagtgtagtgntatgcctcatacatccggtcgcctatcgtcgca

SEQ ID NO: 581847 - DNA, 225 bp, Homo sapiens
ctgttaactggatgtgccacgcggagcagaacggacgagtcactctttgactccttggaatcaagtatggacactggctcacagcaaacgtgcttgggaggtggggtagcaacctgaccagctcgggcctgaacaccattgaacggtattcggaagggcttggcacaggatatgacgacgtgtgcatagggcatggcgctgggatgccagaaatggcgcaacatg

SEQ ID NO: 581848 - DNA, 117 bp, Homo sapiens
ggtttttttcccccccccccccccccaaaaggggaaaaagggtttttttttcccccccccctttttttttcccccccctttttttgcccggggccatttaaaaaggggggcccggga

SEQ ID NO: 581849 - DNA, 330 bp, Homo sapiens
  misc_feature (5)..(5): n is a, c, g, or t
gcaangacctcctctcacaaaaatcatagatatgtagagagatagataccataatcagcgtcgtgactatacctacgaccctgcagtcccattcagaagtcgctcgtattagggcccggagtgatggatcaccgtaatggacttagtcaactcgcggtgagccatctctagccatctgtctctgccaatgtggacccttctagatgaccattgaggctgtgtgctcctaaagatgtgcgagtcatcacaacgtgactcaggggtgagaaatcgtgtgcgtatgtacggagagacaaaggtgctgagcctgatggctcatcggctttgact

SEQ ID NO: 581850 - DNA, 128 bp, Homo sapiens
aactgctctggatgcgcggtaacaagagtaacaataaaccagacagtcagaacttactgtgcactgcctctgtgccaggtgctttgaaacctaaatgcgctctccactccgcagcctgacgtaacatg

SEQ ID NO: 581851 - DNA, 1270 bp, Homo sapiens
ccacgcgtccggtttacaaccaatgttttacaaaaaggaaaggggtaaagaaaggggcaaagccagaatcctattgacgaaacaaatggcaaaacaatgggataaatcttggcatgtccgtgcccaccgtcaagagcgtgccaccaagtatatgtgccatctaagtatcagcacttttataaacaatggccctctcatatcttcctctactcattagttctcttcatagtttttaggttccaagaattccccgttttattaaccacacttactatttgctcaaattttccagtatgaaaaattctatagaagaaaatgtgtgccggaaagattatttggtatatgaagcttaattcgcattcttacgcattaaacccacggtaaattacacgcgagagagatttggacgtagtgagtgatcgggaggtggtaaataatagtcttaagattagaaaatgtcttagagggaccacattattagaagcgttcatcttggagatccattgtatcaggtgtacacacttgtggcttgcttaaacacttgttgaacatctattactgtcgcggagcacaggtgaaaatcccctgatgctgagtacaataccgcgggggggaagacaaactgtgggggagatcaacacataacctccaagtgaacagaaagccaagggtttacaactcccacagtttggtagaactaacacacgatggccgagcacaaacatcaacaacaatctataaacaggctactacaattcggtgcaccaacaaccacgcagggaagaacgccaccctgcaatacccctagacaccaagccggaccacacgcaacgagcacggcacaccaggtacgcgcacggaccccacctcaagaaagatcggaccatatctacaacgacagcacaaaaaaacaaaaaaacagaaacgcggacaacacaactcgacgaaaccaccgcccccaaagagagatccccaaaacaatgaggcgccaccacgcgcaaaacacgtgcagcccaacacaaaccgtgccgaacaaaaaaggcgcacccccaaaaatactagcgagcggacgtcatcaaaagcgacacggcgctctacagcaccgtggtctaaaacgaccgcacacccacttgcaactggaaaaaacataatatacagagagagacacccctgcagagacagagaaagcaggagacatccatagggaggagaacacaaattggagacaaacaccaccacacgcagcacagacgaaaaacaatgacaagct

SEQ ID NO: 581852 - DNA, 1080 bp, Homo sapiens
aaaaaagagaatagtgtagagacccagtgccttggattggggaaaacaggaatgtgtttggaaagtgggaatgttacagagatccagacaccaaggtgggcagcacagcatgcatccaaggtggcaagtaagcacacagctcacagacataccccaagccatctagggggagcagcaacccagaacaccaattacagtccatgcaaattcaccagtggggtggggcaaatcaagggccatgagcacagcagcatgcacagcatgcttcacaggcacacaacccagacatagcttcacccaaggcacagcacagcctccagtggcagcatcacagcagcagcacaggcatttgtggtgtgttgcatcccagtgcactccattgtgttggtgtgcacaaacctggatagacaccacaagtcagccacaagttgcacaatatattcatcagcagcacatttacgcagcatcactaaatgtattgcggcagcacatccaagacacacctgggcatttgggcagagctgcacaccatcaggaagccagcacacattccatggccatcacagacaagcacagcagacaggcaagccagaagcacaaggcatcggccactgctgcaggccatggccaccacaatcatccctagggccaaccctgcagaggctgcagcatccccaggcacaccaaattcaacaacaggggtggcaaacctagcataggtagggcaagaaccttcacagcacgccacattgcacgccccaactctcagccagccacagcagtgcaataggtccaccatggaaccattctccaggttccgactcagcgcgccaggccagccagcaagggtctcacacagagttggcaagggattgaaattaacacaggaaacagaccccccaggggacaaccctacggcgagacagcggacgaccaacctcccacgagggctcccaggatacaagcggaacacactaggcaactctacagccggggacaccacgactcccaccattaccccaccacggccgggcacacgcacatccacgggacacccactcaacacagcaggggccgaac

SEQ ID NO: 581853 - DNA, 574 bp, Homo sapiens
atgcattgtcttccccatgatgttacctttcattggatggtgactccctgcacatacccccaaaggtgtccatgtcctaatcttggaacctgtggatatgttacattatgtggcaaaggagattttgcatgtgtgattaagggaaagatcttgagatggggagattctcctgcatgacccaggtaggcccaatgtaattacaaggatctttaaaagaggaaggtaggaggtcacagtcagggagagagagcaggattctggctttgaaggtggaggaaggggccacaagccaagaaatgcaggtggcctctagagctgggaaaggcaatgggtggattcccccttggagcctccagaaggaacacagccctgctgactccttggtcttagcccagcgagacccgttttggaaatcagacctgcataattgcaagatggtaaatttgtgttgttgtaagccactaggtttgtggggccatcctggcctcagtgatgcttatttgggagtgtgtttttttcctattactgctctaatcttttaaattagatctgaagagatgctctaatttttttt

SEQ ID NO: 581854 - DNA, 194 bp, Homo sapiens
atccttctttttaaggactgaatgatataccatatgtgtatatatgccacattttctattatctagttcatccactgattgaaactgaggtagattccataactatgactagttgcaacataatgctagcaataaaacatggagattgtagcatatctaccttggacatcactaatttacagataccttatgga

SEQ ID NO: 581855 - DNA, 946 bp, Homo sapiens
  misc_feature (44)..(44): n is a, c, g, or t
atccctgaagctgacagcattcgggcgagatgtctcgctccgtngccttagctgtgctcgcgcaactctctctttctggcctggaggctatcccaggtactccaaagattcaggttctactcacgtcatccagcagcagaatggaaagtccaaatttcctgaatgcgctatgtgtctgggtttcatcccatcccgactattgcatgttgacttcactgcaccgacatgcagcagagactcggaccaccaggtggcgcatccagacttgtccttccagcaaaggactgtccttctatctctggtacttacacttgatattcacccccaattgaacaacacgatgagtcatgcctggccgttgtgaacccatgtgactttgtgtcaacagcccaaagaatagtacaaggtgggatcgagaaatgtaggcagcatcatggaggttgtgaaagatgccgattttggattgggatggaatccaaattctgtgtgtgggtttaacggttggatatgctgatcacactttacattttatgccacaaaatgtcagggtcataataatgtaaccattgacatgaatcttcttaataattctacttggagtgtggtctccatgttgatgtatcttgagcaggtggctccaccagttagctctagggagggtggcacttagaggtggcagcagagacttctctcttccaatcacattttggtcagattgacttttcattcttgatcaaagtgtaagataggtagggggctagtcacttcattcaatacttgctaaatgtgggacattaacatcatggcggtcatggactggtcatgtgacttgcatcaggccttaattacatgaagaggggggacggtttggcacgttacaatggaaaaaaaatggggcgcgaaaaatgcgggaaaagtcaagaggacacgagacgtcataatatat

SEQ ID NO: 581856 - DNA, 271 bp, Homo sapiens
  misc_feature (261)..(261): n is a, c, g, or t
gagtacagtctacatggaagtcttttttggctttttgttttggtttgtttttttgagacgagatctggccctgttgctcaggctggagtgcagtggcgcagtcatagctcactgcagcctcaaactcctgacttcaaggcatcctcccacctcagcttctcaaagttctgggattacaggcatgagctaccatgctcacgtctggaagttcttttttgaaaaagcacaaggtctctacttagatttctatccacacagccnatttagtgta

SEQ ID NO: 581857 - DNA, 511 bp, Homo sapiens
  misc_feature (20)..(20): n is a, c, g, or t
  misc_feature (136)..(136): n is a, c, g, or t
cggagccccacgtggtgganggagattctgcggggagcttgtcagagctccagcagctgcctctgggggcccagcctgctgtgtccccagtggagtgaagtagctgtgagaaaggcagttctggcaaatttcaggngaaattaaaaggccgttgactgtaggcgagcacattcactttagatgtgttccagaaggggactgctttattcgtcggtctgcctattcacacagccatgcgttccaagtaaggaaaaataccaaacatgttgattttttagcttattcaaatatttatattttctctagttacttttctgaagtattttggctcatttattttctgataaacagctgctgcacagatttgctttggggtggggggcagggtaaggctggggtgcactttctaaatagatctctttcttccaaggtgattgacaaacggcattccttacagatcagtacacaccaaagtagagacaattgtattccagtgattggcactttcttc

SEQ ID NO: 581858 - DNA, 197 bp, Homo sapiens
ctagagtatcccacggtcgcgcagagagaatgctggcggtcctcacctggctagaggagataccgaagcctactgtggtactgaagactttctgggttctttccattctgcataatccagagtagggtcctaaggaggaaggtgacttcttctcctgtttgtcgttgacctggaactgttttggcactctggcggta

SEQ ID NO: 581859 - DNA, 345 bp, Homo sapiens
cattgaatacacctggttcttaagagtccgataggttggaatacacataatgtccggaccaacccattccagcctcaaagacagccgattcttttttaccatccctttcagtggtacacatcccagtggccagtagttgcaaatctcagaatgttatattcacactgaatacaaatgtcttaaatgtgtatgtacttcagaaggttcttttctttggcaaatccaatgatatattctgtggctcttgctgtgtgtgcataaagttgggaaagtcctcgggaaatggaaagtctgggacacacatcatctctgtgaaagagttgaaaaagtctgatgtgtaaacgc

SEQ ID NO: 581860 - DNA, 1065 bp, Homo sapiens
ggagaagatggaggacggcaaggttgaaggtcacccttcatgttagcccacattacttccccctcctgtaagaaatgccatcggtgccgtgagcaccaggaggaagagtggaggaggccgttcagactgtccgtgctgtcaaggcgaggaggaatcgtgcggctagtccgtcaagggagctggtgacgctgcgggtcgccagaagtccgcgcctggctgggggttccacacggcacgcgcgactatggtcctggcatgatggaacatggccaaggagcagacgagagcggggccactcttcctaggatgagcgtggcgctggaagcgtgtaagcccctgggggagcaggagcgtgcggtgattctggagctgaagcgtgcggagtgcgagcgccggggccgtgcccttcgacgggcctgcagtccggtgcctgggacatgcgctactacagtgaaccaggtggaggagacgcgctactgcgtggaccagaacctggtcaaggagtacttccccgtgcaggtggtcacgcacgggctgctgggcatctaccaggagctcctggggctggccttccaccacgaggagggcgccagtgcctggcatgaggacgtgcggctctacaccgagagggacgcggcctcgggggaggtggtcggcaagttctacctggacctgtacccgcgggacaggaaagtacgggcacagcggactggatttggctgcagcccggctgactgcggcaggatgggagccaggcagatcggcatcgcggacatggtggcaaatttcacaagcccaagcgaggcgcctcgctggtggcagatgagaggtggagactaattcctgagttgggcacgtgatgaaccaggtcttggtcacggggggaggttcgcaagtttagaggggagaccagtaggagcggagcatgtagagaggcaggaaaatgctgagacacgtgggtggagactaagacatgtatgaagatgatgaaatcacgcaagagaaagaccagagacttggaagatatatagggagaggaacaaaggtataataagagaactacag

SEQ ID NO: 581861 - DNA, 759 bp, Homo sapiens
  misc_feature (759)..(759): n is a, c, g, or t
cctggagtctgcgaaggcgggaccggttccccggccacagtgggggtgtgcaaacccgagagaactgggttgcaaattcgtgaagaatcagcatcatgttggcagctgagtattggagccaggagcctgccatgaggtttgagaacagagtgctgttttagagctggcagcagcatctcagcccaagagaaggttatattcccagaggatgtcagtcccaaggaccagtagctgccatcagttggattctgaaaactaactggcatcaacactgggtgtagaaacatgcttgccttatgtatcagaggacatgctcagcagatccaagagatatattggcaactttttctagaaaaggcacatgggtatcattcattacatttttgagttttttgggtttgatatttatttttttggaaacagtctggcggtatggcccaggtgggaggggggggggcccaatcacagtcatggatcctcaataacccgaggccttaagaatccttcccaccttggtagttgggactacaggctcacagcaccacctgggctggaaaattttttttgggtggacgcacggattctctatgtggcccagggggtctcaggctcgtgggctcagatgggtccttctggcctcagttccaagaggacaggccatttgtactttgtgtcctttgccataattgccaacaagaggtctatacctttaatgattgcttcataaattggatgggggggacacgtcttaaacggggn

SEQ ID NO: 581862 - DNA, 166 bp, Homo sapiens
gcccaaacccacggtcctacactaccagacctgcattaaaaatttcggttggggcgacctcggtaacgataacccacaccgtccgagctcgtacatgcgaagacttcaccagtcaacagcgaactactatactcgacttgatccaatacacttgaccaacagcaac

SEQ ID NO: 581863 - DNA, 866 bp, Homo sapiens
  misc_feature (3)..(3): n is a, c, g, or t
  misc_feature (65)..(66): n is a, c, g, or t
  misc_feature (69)..(69): n is a, c, g, or t
  misc_feature (74)..(74): n is a, c, g, or t
  misc_feature (96)..(96): n is a, c, g, or t
  misc_feature (116)..(116): n is a, c, g, or t
  misc_feature (122)..(122): n is a, c, g, or t
  misc_feature (149)..(149): n is a, c, g, or t
  misc_feature (158)..(158): n is a, c, g, or t
  misc_feature (170)..(170): n is a, c, g, or t
  misc_feature (175)..(175): n is a, c, g, or t
  misc_feature (208)..(208): n is a, c, g, or t
  misc_feature (226)..(226): n is a, c, g, or t
  misc_feature (232)..(232): n is a, c, g, or t
  misc_feature (287)..(287): n is a, c, g, or t
  misc_feature (296)..(296): n is a, c, g, or t
  misc_feature (298)..(298): n is a, c, g, or t
  misc_feature (364)..(364): n is a, c, g, or t
  misc_feature (375)..(375): n is a, c, g, or t
  misc_feature (381)..(381): n is a, c, g, or t
  misc_feature (422)..(422): n is a, c, g, or t
  misc_feature (429)..(430): n is a, c, g, or t
  misc_feature (434)..(434): n is a, c, g, or t
  misc_feature (450)..(450): n is a, c, g, or t
  misc_feature (452)..(452): n is a, c, g, or t
  misc_feature (488)..(488): n is a, c, g, or t
  misc_feature (547)..(547): n is a, c, g, or t
  misc_feature (551)..(551): n is a, c, g, or t
  misc_feature (573)..(573): n is a, c, g, or t
  misc_feature (575)..(575): n is a, c, g, or t
  misc_feature (628)..(628): n is a, c, g, or t
  misc_feature (669)..(669): n is a, c, g, or t
  misc_feature (688)..(688): n is a, c, g, or t
  misc_feature (779)..(779): n is a, c, g, or t
  misc_feature (847)..(847): n is a, c, g, or t
aangtgctgggtgctaggtccaggtacaaaacgggaaaggcagagaggatgagcaggaaaaaaanncanggatntcgccccaacccatcacccacncctccggccatactgcccancagcancttccccagcagctccagcgtggccanaaagctgtngtgtgtggcctncaaanccctgggggccagctggctgcagcgcattcatncccagtgaaagtgaactntggtgnaccgggcctcccaaaaatgctgcaaacatagctcagcaaggctgaccctctcaanattgtgcancnctccatgctggcccccagggtgtccaggtggaagaccaaggcagtctgacaggctaggcccccgangcggaacgcanaccganctcaacagaggcagcatttccagttgcttgtgccagcaagntcccacnnagtngaggagccagcgatgnancagaccacagcacccacaccattccacagtcccaantcgggagcagaaacgccgtggtccagcaggatattatgaaacaggctgctgtgcacccntgcntacccagccttgtaggtgagtnanaaatgcctgccgtccacacgggtccccggcacggctagcacgtcccgcagaangtgcgcggtgtggggacgctgctcggaagggggctgctgtnggagccgccgcagggctgngtgcagccaggccagggccgcggccagccagtaggtggcagccaggagcagaaagagttgcggccacgagaaggtgggcagcagcgccacngcgcgcccccagctagcgcggcccccagcttgtacgcgaccacctgcacggtattgcccggcccagtncggccggctcagcagctga

SEQ ID NO: 581864 - DNA, 356 bp, Homo sapiens
  misc_feature (356)..(356): n is a, c, g, or t
tgcgccagagcgtggagtgcgacatcaacggctgggcggtgctggatgagctcactctgtctaagactgactggagaatgagatcgaggagcctgaaatgaagagctagctaacatgaaggaggaacaggaggagggatgagggattaggcaccagggggcggccaggtcacgtgggattgtgcaccccaggttggctggaccgggctggagataagggcgtaagccggaaaggaaccgggtgtggatggccccgagtggcgcggggttacacgggtaccacaaagaagtgcgcgcccggatagccacaaggagggggatagtcaaagagagaggcgaagagttcccgcctcgtgn

SEQ ID NO: 581865 - DNA, 222 bp, Homo sapiens
cccttggggcaaaaggtttttttgaacttaaaaccttattccccccattggatggaggccaaataaaaggccccctagttttcttaatccccttccctggccgggttgggcaggcccgggggtgagccccctccaacccaccccccgctttcctcccggcttcaaaattttatggtaatttttttgggtttttcccggtttttaaaaaggggttggggggga

SEQ ID NO: 581866 - DNA, 672 bp, Homo sapiens
ggccttagaaaccggccccggatcgcgagccggagccggagccggggccggccgggctgctgaggcccgagcggcaggagcgcagcgcggagcgctgagccaggcgcccagtcgcgagaagctgccgccgcctctgcccgcccggcgccgcagccccgggcggtccatggggcgggcacgggtcgctgcaggcgccggcagccctggagggcagccgcttaggcgctgcgctcttgtccccgcaggtcgcagccaggcggggggcgcgcccagcccggaccctggagcgcccgcgggtccccactccatggacgccttcaaggggggcatgagcctggagcggtgccggaggggctccggcgcgccgcagcacccatgacatggggccgcttccacctggccgggccgcgaccccggaagccgtcgaagaatccgccagcgagtcgtcgtgacaccggagctgccagagaaggagcgcggcggggaacctcaacaacatcaacaaactcaccgggtcctcgctcaactcggccagcccaggattcgggcacccaggtggagccggaccggccccggcgcgccgtgattagagccctcggtggcacgcgccccgagccctatatcaggccacggtcgcgactgggggtcgtgtgggcctgaggaaggtggggc

SEQ ID NO: 581867 - DNA, 121 bp, Homo sapiens
acacctctatccctgtgtctacgaatagcttagtctttacatacattaggggaattttttcaaaagtctgtaatgttggacaacagatatattacttgctattgaaacttctaaaactagg

SEQ ID NO: 581868 - DNA, 212 bp, Homo sapiens
ggtacgtacggatgtgggggctccctgggggtgaggggggctgctgcagaccttctgtagccctgagtcttcgtgggtggtcatggctctccagccccatgcctggaaacactgcccttgttatcagaaggagatgctctgccctttcctttgagatggagtcctgtcaccctagagtcgggaagttgctattcagcaaggtctagacctga

SEQ ID NO: 581869 - DNA, 614 bp, Homo sapiens
gtccttctgtagaccacggtgcttctgggcctgctgggccttctgtccctataggtcctcctgtgcccgtcggtccctctgtcaaagatggtgctaatggaatccctgtgcccattgggcctcctggtccccgtggacgatcaggcgaaaccggccctgctgtgcctcctggaaatcctggaccccctgtgcctctcaggtccccctggccctggcatcgacatgtccgcctttgctggcttaagcccgagagagaagggccccgaccccctgcagtacatgcgggccgaccaggcagccgcgggcctgagacagcatgacgcccaggtggatgcgcacacttaagtgccttaacaaccagattgagagcattcgcagacccgagggcttccgcaagaaccctgtttgcacctgtagagacctgctctgtcaccctgagtggaagagtggagactactggattgacctcaaccaaggctgtaccttggacgccatgaaggttttctgcaacatggagactggcgagacttgcgtgtaccccaatccagcacacgtgttccagaagaactggtggagccaccagagccaggcaatttggtccaacactgcacgtc

SEQ ID NO: 581870 - DNA, 295 bp, Homo sapiens
tccccaaatgggggggggggggggcggggggggggttttttataacagcgctcttttttttacccccccatttcccggggggcccccccccccgttttttttccccctttaagaacccggggggggttcccccccccggttttttttttggggcggggggggggttccttttttccccggggaaccgtttttccccttgggccttttttgggggcccttttgacccgtttttttccaaaaacggggggggggcggggcggggttttccggggtttttttcccccccgggccccca

SEQ ID NO: 581871 - DNA, 429 bp, Homo sapiens
  misc_feature (25)..(25): n is a, c, g, or t
  misc_feature (49)..(49): n is a, c, g, or t
  misc_feature (74)..(74): n is a, c, g, or t
  misc_feature (96)..(96): n is a, c, g, or t
  misc_feature (124)..(124): n is a, c, g, or t
  misc_feature (131)..(132): n is a, c, g, or t
  misc_feature (135)..(135): n is a, c, g, or t
  misc_feature (145)..(146): n is a, c, g, or t
  misc_feature (149)..(149): n is a, c, g, or t
  misc_feature (169)..(169): n is a, c, g, or t
  misc_feature (175)..(175): n is a, c, g, or t
  misc_feature (216)..(217): n is a, c, g, or t
  misc_feature (228)..(228): n is a, c, g, or t
  misc_feature (233)..(233): n is a, c, g, or t
  misc_feature (237)..(237): n is a, c, g, or t
  misc_feature (253)..(253): n is a, c, g, or t
  misc_feature (260)..(260): n is a, c, g, or t
  misc_feature (283)..(283): n is a, c, g, or t
  misc_feature (296)..(296): n is a, c, g, or t
  misc_feature (300)..(300): n is a, c, g, or t
  misc_feature (322)..(322): n is a, c, g, or t
  misc_feature (329)..(329): n is a, c, g, or t
  misc_feature (352)..(352): n is a, c, g, or t
  misc_feature (360)..(360): n is a, c, g, or t
  misc_feature (364)..(364): n is a, c, g, or t
  misc_feature (396)..(396): n is a, c, g, or t
ggagtagaaggtatgattgacacanccttctgacttgaaatagagcagngggtaactcatccaaaggggatacnccttaatatcatggattgaatncattcatttaactttttctcttctgaanccccacnnccngtatagtaannganttttattttaaaagcatganctaaangttggaggcctctattacagtgatctaccatgggaaataannatccttaaaangcttnaaangatagtccagtacaangggcagncagtgcctcactctcaagatgtncagatgtgtgaanggcncatggagaatagtcttccaacncaggagncaatagccacaaagctcaagaanctgaaacncaangggatgagtggtaactgacaatagccctgaangaagctaaccatcacttgtcagtggacaaggct

SEQ ID NO: 581872 - DNA, 152 bp, Homo sapiens
  misc_feature (1)..(1): n is a, c, g, or t
ntcgatccgttactcctgttagtccattattgacattacagtagttaacgggatctgactgctttttctgaggtcactggtaaccttggagaaaaaaagtagattcaaaggggtggtgtggatgtgcactgggggattggtgggaaaatcag

SEQ ID NO: 581873 - DNA, 290 bp, Homo sapiens
actgttgcgagcttagctttgttacagaacacactgaggtagggtgcggtggtcacatctgtaatctcagcagtttgggagggcaaggcaggcgcatcagctgcaggtcaagacgcttgagaccagcctggtcgaaatgatgaaaccccatctatactatacatacaagaattagctgggcgtggtggcacacgcccgtaatcgcagctactcaggagtctgaggcactagaatcacttgaacccaggaggcggaggctgcagtgatgctgagattacgccactgcattc

SEQ ID NO: 581874 - DNA, 202 bp, Homo sapiens
tgtcagacgtgactatgtggcatgggtggtatccagcagcagggttctaggcaattgggagagtagcaggcgtgtcagctacttaacatcacatttcgatattatacaagtgttagaactgcactgctgtatattgtggtgctgagttatcattcctgtttctagtgttttctgtccacctatttagagggattgggggcta

SEQ ID NO: 581875 - DNA, 154 bp, Homo sapiens
ccgatacaatagtgataaagtgaaatagtacaatcgataacttactgttatctaaccaacagaaatgtagtgggaacttactaccattcacccattaaagactttagaaagtaataactgcccccagatagagtaaccagtctaattgtatgca

SEQ ID NO: 581876 - DNA, 415 bp, Homo sapiens
  misc_feature (63)..(63): n is a, c, g, or t
  misc_feature (86)..(86): n is a, c, g, or t
  misc_feature (91)..(91): n is a, c, g, or t
  misc_feature (144)..(144): n is a, c, g, or t
  misc_feature (230)..(230): n is a, c, g, or t
  misc_feature (350)..(350): n is a, c, g, or t
  misc_feature (366)..(366): n is a, c, g, or t
  misc_feature (396)..(396): n is a, c, g, or t
  misc_feature (409)..(409): n is a, c, g, or t
gtcatcatcctgctgcagcatgccctagcaacagccaacctgcaccatcatgggcacttcaantgcattttagtccccttcctttnctatnaagctgctgtgtgctgtgggatatgtgtgcctagatgttccttgcctgtgttnagggaggtgataaacatttgttccatgttatataggtgggaaaggggtcagcactactaaattgtgcaagacatcatctgttctgncatttattgaggaatgtgaatatgaaacaaggctgcaagtattctataaatgttcactgttattaggatattgtatgtctttgtgtccttttatttatgaatttttggaaattatgaagnaagagttcatgtggtnagtgtttaaccggtgtaggggaaatggaantgataggaataanttaagg

SEQ ID NO: 581877 - DNA, 442 bp, Homo sapiens
  misc_feature (167)..(167): n is a, c, g, or t
  misc_feature (360)..(360): n is a, c, g, or t
  misc_feature (380)..(380): n is a, c, g, or t
  misc_feature (437)..(437): n is a, c, g, or t
actttggcagggtgataagttcattcccgtgaaatagatagctgtgcagatggataacgacaatgcctttacgacggttctccccaggactgaaagcccagtttgccttcggcatggtctttttgttcgttcagcccgatgccagcgctgctgacataagtgcgcanaaataggtggggtgattattccgcagccttcagtcaggcgcttcaggacggcatgagcgtcccgctctatattcatctcgccggtagccagggtcgccaggacgatcagcgaatcggcagcgcttttatctggctggacgatggacagctacgcatccggaaaatacagctggagagagtaagataacgccanttcagcgaacaactcgacancagctgatggctctggccaacgcccgttcaatgaggccttaccatcccctgacttanaacgg

SEQ ID NO: 581878 - DNA, 1350 bp, Homo sapiens
  misc_feature (957)..(957): n is a, c, g, or t
gggatgctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaacaaaagttgaagaggcagagcctgaagaatttgtcgtggaacaaagtactagatcgacgtgtagtgaatgggaaagtggaatatttcctgaagtggaagggatttacagatgctgacaatacttgggaacctgaagaaaatttagattgtccagaattgacttgaagcgtttcttaactctcagaaagctggcaaagacacaagatggtaccaaaaacgaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattggtcttttatatatatttatatatatatataaaaattgggtcttagattttgatttactagtgtgacaaaataactacatcctaatgaaaatcaagtttgatatgtgtgtttggaaagtagcgttggaagagatgttgggggttttgtgcatccatagcactggttactttgaacaaataaataaaagctttctgtagtagcttcctttatcagaaaagaacatttgataccatggtatatcatttcctcttcattaacagaacagcttttctacaatgttgggggaaantgtccatagtcattactcagtcaaaactttgtgttctcataagcctaaggaccattctagatttatacgtgtcgtgtgtgtgtgtgtgtctccataaaatgcatatgtaacattttttgtgtttaagcattcacccaaaaaaaaaatcacaggtaaacccatgtttcctgaagatgccatttattccaaggcaacaatacgagataatcccttcaagttaaactgtgcacaatttcccctgaaacccatactatctcaagtgacatcacgttactcctaggataggacaactcttacattggcttctccaaccgtgcctactactcgccggggctcattgtgcaaatcctaacaggaaacttttccgggcatcaccgggggtccccaatcagg

SEQ ID NO: 581879 - DNA, 420 bp, Homo sapiens
catctctacagaagacttttttttaatcaggatcccttgagcccaagagatcaaggccacagtgagctatgatcacatcactgcattccaacgtgggcaatagagactctctcaaaaaatagggcctggcgcagtggttcatgcctgtgatcccagcactttgggaggccgaggtgggtgaatcacctgaggttgggagttcgagaccagcctgaccaacatggagaaaccccctctctgctaaaaatgcaaaattagccaggcgtggtggcacatgcctgtaatcccagctactcgggaggctggggtgggagggttgcttgaacccaggaggcagaggttgtggtgagctgaggtcgcaccactgcactccagcatgggcaacaagagtgaaactccatctcaaataaataaataaat

SEQ ID NO: 581880 - DNA, 971 bp, Homo sapiens
agcggatcggtccgtcctgcttccagctgctgcagagcggccttcgccgccaaagcatccagcagccccctgctcaggcccagcatggcgagcgccgagccagatccccacggaaggctcctgcagcgaacctgacccatttcatctatgactacaacacggatgcatactgtgggcatgactctggctaccgtcttgttcctgctgggtatcctcactcgtcatctactcaagaaggtgaagtgcaggcaaggcggactccagtgtctgagagcccagacctggcggaagtcctgtacagtctgagcttccctcttcagcccctggtggcggcggcgtgttgcaccttcccgaggtaatctccgcttgccgcacctgtcctgagctgctgggcagcctgcacgtgaccgtggtgcgacggctggttgggtgaccctagccgacagcgcctggtggacgcgctccccgcgtagatggaggccagtcaccatgcaccccaaggttggaggccgttgcaagctgctgtacctctccaggccttgtcccgtgacgattctgcggagagccctgtttgcatccggatacccaaggggctcaagggcttgagctccggggatcgcggaagatcgatccgcggacccctgtcaatcacgaagcattcccttgctcctcggtccttccatggagacgggggcgaatggataaccccaaacattagccaacttaggtaaccctgggtgcctaacccccctttactgttgcgcgtgtggtgctgcgtggtgcagcacgcccgtgtggctggtcggcctattatgtcctaggctcattctactgtccatctatctgacgggggaatgcgggtcagggggccacgggaacggggcttgagttcccccatttagggactaagttgagcattagtcatatgcaagtaaagtcggacctgcgttccaaatgcctttcgtcaatcc

SEQ ID NO: 581881 - DNA, 147 bp, Homo sapiens
cgaatttcggcaatatgttcagcatggctggggcggccctctttcttcccttcctacccctgctaccggctcagttactgctcaataccttgctatatgatttgtctcaacttgcaattcctaaggactatgtcggggtaccgagct

SEQ ID NO: 581882 - DNA, 1667 bp, Homo sapiens
ggccaaggccggccttcgcgggcgactgatacacgccctcgagtgccagtctataccacttctcatcgtggggcgcctccacggacaccgatgggcgctgatgtgatgggcatggagttcagaaggattcctatgtgggcgcacgaggacccagagcaagagaggcactcctcaccctgtaagtacacccagtcgaagcacggcatcgatcagccaacatggtacgacatggagaaaatctggcaccaggagccattctaccaatgacgctgcgctgtggattcccagcaggtagcaccactcgtgcatgcatgaaccagaggcaccctctctgatatgcctcaaggtgccaatccagcagactgaaggatgacctcacggatcagtagtactagaggaatcttgacaagcagcgccctagggacaatagttacctgttagcttactaccaagaggcatagtagcatatacacccttgttagccgtcactactagagaccacgttaaccaaactagggaccactacgatcgcattggaactaccggtgtagaacggggatcaactccaaaccacataggttagcccacaatcttacatacgacacgagaggtaatagccacttaccacactacaatggcccagtacacattagcggttcttaggagcactcctagggactatggagccagaggggtaacttcgcacctgggcacttaaacactacaattgatacgatttcctaccagcccgaatccatggcgctgacttaaaacgtgcctttgaagccccagcactaccgctgaccggaagtccgggtgaatacatctccatggtacgtgtgaacaatttacgcgtgacgcacaacgcttggtggcttagtcggttcggccaccgttgtgaaatctcggagccgcaggaaggcagtgggcccaacgggcagtgcttatccaaggcctatcgcatcccagtggaaggagaagaaaggcctacactgaaaggccattgacccatagcacctagccacaagggggtacaaataccacaccaagatatgggggacactgagcagcctagtgggtacccagccttggccccccattgcagcgtctagactgctattaccacgagcgccattactcccattaccagattggagacaactatggaacgagctacctagtgattggcacaacgtccagagcgcaccagcattcaccgtatatacgtaatccacaatcaacttcagcagctcgtgaaccggttgtagccatatacaataacagacagagccttggacgagccacaacaacgtcggccagtgaatagcgcggtgacccaaccgcattgatcccgcgtcgacatgtgacgcaacggacatgcacacgtgagaacacagttcgcggggccgcgacgattcaaaactagactcacaaatagtgcccatcttgtctgcatgttgttcggttgttgttagggtggtaccctacggaagtcatgcaccattccgagaatatgtcgactagcaagatgatcacacggtccacacaacagcaaatggtgcggaaatcagaatgacgaactcacgtcgccacgaggtcggtcgaatgtcagctatgcaacagacgggactgccggtcttactgcttacactcgagagcagaggcag

SEQ ID NO: 581883 - DNA, 360 bp, Homo sapiens
  misc_feature (89)..(89): n is a, c, g, or t
  misc_feature (97)..(97): n is a, c, g, or t
tgagtctagaggaccccctgggtactcataatgcatgtggacttaggtccaaggtctccagagggtgaaagctgggagtctggtcaatngtcctacngagacagcacagccaacctagctagcaacattggtataagtctgaacaatatatactcatagaatacagtcaaagatacacaatctgaacacagcttcatggggtgtgcactctaaacagtagttgcaatgtataagaatgagcacttacttctctgctatctagatctgaactccttggcttctttacttcagtacaagccccagcctaggcaaagccagttacataaaagttggctcaggagtctaagagcttaacctaaa

SEQ ID NO: 581884 - DNA, 759 bp, Homo sapiens
  misc_feature (25)..(25): n is a, c, g, or t
  misc_feature (28)..(28): n is a, c, g, or t
  misc_feature (31)..(32): n is a, c, g, or t
  misc_feature (35)..(37): n is a, c, g, or t
  misc_feature (40)..(41): n is a, c, g, or t
  misc_feature (43)..(43): n is a, c, g, or t
  misc_feature (51)..(51): n is a, c, g, or t
  misc_feature (55)..(55): n is a, c, g, or t
  misc_feature (81)..(81): n is a, c, g, or t
  misc_feature (95)..(95): n is a, c, g, or t
  misc_feature (108)..(108): n is a, c, g, or t
  misc_feature (130)..(131): n is a, c, g, or t
  misc_feature (133)..(133): n is a, c, g, or t
  misc_feature (156)..(156): n is a, c, g, or t
  misc_feature (164)..(164): n is a, c, g, or t
  misc_feature (191)..(191): n is a, c, g, or t
  misc_feature (195)..(195): n is a, c, g, or t
  misc_feature (240)..(240): n is a, c, g, or t
  misc_feature (284)..(284): n is a, c, g, or t
  misc_feature (456)..(456): n is a, c, g, or t
  misc_feature (530)..(530): n is a, c, g, or t
  misc_feature (536)..(536): n is a, c, g, or t
  misc_feature (539)..(539): n is a, c, g, or t
gagctcggtaccctccgacgtggcntcnatnngcnnnganngnaccactgnacancagcctggacaacagagcgaggcccngtctcttaaaaagnaaagaaaaaaacntgtttttctaagttctgtgagnngntctagtaaataattaaactcaanaagagggncatgggaaaccctgatttctaactggntggncaaaatacaggtgacaacctaggacttgcaactggcatctgaagngagagtggtcttgtgggactgagcccctaacctgtgggttctgngctaactctaggtagtgtcagaatggaattgtgggatacgcggttggtatccagagagttggagaactggtgtagaaactctgcacacacatttggtcagaagtctgtgagtagagagaaacgtgttgcgggaagtcagggaccccaaacggagggaccggctgaagccacngcagaagaacataaattgtgaagatttcatggacatttattagttccccaaattaatacttctataatttcttnggcctntcnttactgcaatctctgaacataaattgtgaagatttcatggacacttatcacttccctaatcaatacccttgtgatttcctatgcctgtctttactttaatctcttaatccggtcatcttcgtaagctgaggatgaatgtccctgcaggaccctgtgataattgcgttaactgcacaagttgtttaaacagtatgaaacctgggcaccttaaaaaaaaaaa

SEQ ID NO: 581885 - DNA, 577 bp, Homo sapiens
  misc_feature (102)..(102): n is a, c, g, or t
  misc_feature (274)..(274): n is a, c, g, or t
  misc_feature (348)..(348): n is a, c, g, or t
  misc_feature (354)..(354): n is a, c, g, or t
  misc_feature (357)..(357): n is a, c, g, or t
attttgtgtcgtaataatgatgacataactagtcactagcttggtgattctttgtcgtgactgtggtcttgtgggactgagcccctaacctgtgggttctgngctaactctaggtagtgtcagaatggaattgtgggatacgcggttggtatccagagagttggagaactggtgtagaaactctgcacacacatttggtcagaagtctgtgagtagagagaaacgtgttgcgggaagtcagggaccccaaacggagggaccggctgaagccacngcagaagaacataaattgtgaagatttcatggacatttattagttccccaaattaatacttctataatttcttnggcctntcnttactgcaatctctgaacataaattgtgaagatttcatggacacttatcacttccctaatcaatacccttgtgatttcctatgcctgtctttactttaatctcttaatccggtcatcttcgtaagctgaggatgaatgtccctgcaggaccctgtgataattgcgttaactgcacaagttgtttaaacagtatgaaacctgggcaccttaaaaaaaaaaa

SEQ ID NO: 581886 - DNA, 179 bp, Homo sapiens
atttggggggggggggccgggttttaaaccccgggaacccccccctttcccgttttttttggtagggtgggggggccccccgggggccctttaaggcggggtttttttttggggggggggtttccttttttttttggaaaaaattttttcttttttgggaataaaatgttaaaccctga

SEQ ID NO: 581887 - DNA, 126 bp, Homo sapiens
cctagggatccttattagaaatttgtatatacaatgtgtgtatttatgtgtgtgtgtctcatattggggttccagctatataaagcagatactaacaaacactgaataaacacaaagagagcaata

SEQ ID NO: 581888 - DNA, 224 bp, Homo sapiens
tctccagtgttggccatggctcaatcatccgtacccaatgaggtctccgtaaaagccccaagaagacagatttagagagcgttcggagaacagaactcgtggctttgcaaagtgtcacgaatggagagaacttggaagctccacgccccttatatacctcaccttatgcatctcgtcagctgtatcttgtgtgatatccatgttaataacccagtatacggaga

SEQ ID NO: 581889 - DNA, 387 bp, Homo sapiens
cggagcccggtcaccggggccgcggggtggaggggagcttaaaatgcaggtctgggcggggcccgctggctcacgcctgtaattccagcacttcaacactttgggaggccgaggcgggcggatcacccgaggtcaggagttcgaaaccggcctggccaacatggcgaaaccccatcactggtaaaaatacaaaaatcatttagccgtgctggcgcgtgcctgtagtcccagctactcaagaggctgaggcaggagaatcgcttgaacccgggaggcggaggttgcagtgagccgagatcgtgccactgcactccagcgtgggtgacagagcgagacaacgtcaaagaaagaaagaaaagaaagaaaatataaagagctgacagccta

SEQ ID NO: 581890 - DNA, 504 bp, Homo sapiens
ccgtgggatatgcgtcgatacctgtcactgagtttagggagaggtctttaaacagaagaagtttgagtaatttaaatgatgatgggaaggagctaaaagtgggggataggttaaagatacaggaaagtgggaggaagaactgacaagtgaggttccagagagggcaggagaagaggagattcccatagggggattaacactttcttttcttttttctttctaagacagggtctcactctgtcgcccaggctggagtacagtggcacaatcttggctcactgtagtgtagacttcccaggctcaagggatttctcccaccccagactcccaagtagctggaactacgggtgtgcaccaccaccacacctggctaatgtttctttttttggtagacacagagtctcactatttagcactgattggtctccaactcctgacctcaagcgatcctcctgcctaggcttcccaaattgctgggattacaggcatgagccacaatgcctg

SEQ ID NO: 581891 - DNA, 245 bp, Homo sapiens
accagcctgaccaggttagagaaacgtcgtctctactgaaaatacaacattagccaggcgtggtggcgcaggcctgtgatcccagctaatctctacccgggaggcggaggttgcagtgagccgagatcgggccattgcactccagcctgggcaacaagagtgaaactcagtctcaaaaaaaaaaacacaagaacaaaaccagagtctgtggtcccagcactgtgtccaagtgcgtgtgaggggat

SEQ ID NO: 581892 - DNA, 401 bp, Homo sapiens
attatgatgaaaccctgtctctactaaaaatacaaaaattagctggcctatggtggcgggtgcctgtagtcccagctacttgggaggctgagacaggagaattgcttgaacccaggaggcagaggttgcagtgagctgagatcgtgccactgcactccagcctgggctacagagcgagactccatctcaaaaaaaaaaaaaaaaaaagagaaagaaatagaattaaaccaaattgacagtttaactgtgttgagtacgaaaaacttgtgtttggaaaggaaatagtgataggggtaaaggtagaatcttagagactttcctagaagacatgggatacttaccttggaatctggcaacagttggtgaagaatcaggcgtagcccgggagcaaggtaaccgag

SEQ ID NO: 581893 - DNA, 1450 bp, Homo sapiens
  misc_feature (474)..(474): n is a, c, g, or t
  misc_feature (574)..(574): n is a, c, g, or t
  misc_feature (898)..(898): n is a, c, g, or t
  misc_feature (1134)..(1134): n is a, c, g, or t
  misc_feature (1136)..(1136): n is a, c, g, or t
aggaggtgtgttttttagtgaggtcccccctttttatgtgggcccgccccgccgcggcgcgggggggacgcacccgcgcgcggaaggttttattttgtactcccccgcagccgtagttggttgtttgtctgagccgtacggccgtccccccgctacgccagggtgggtgtgttgtgtactcgcctcgcccctgcgccgtgtgttgtatatgtgtgggtcccccccccctctcttcggtttgtggggcgccgcctctcctcatttgttgttttagttgagggggggggtgggcgaccgaccgccgcggctgtgtattatagtggggaccacaagccaccgagcttgttgttgggtgtgacggcccaccccggccagaatatatgccccccccccggcggcggtccttcggcgggtgtatgacccccccgccggcgtttctcctccggccgcgggatgagttttttcttccccccngcccggcggtatgtattattatgctctgtgcttctgccggagtggcctcccccacccacggcggccgtcttctcccgccccgtcgttcgttatgatcagnggtgtgcgccacacgacgatcgttggttcttacaaaaagaggcgggtcttcccagccgcggcgcggcccccaccacccagctgctggtggtgtggtaagagaacagcgcggcgtcgtagatgatatggttggtttaagataaacacccgcggtcgtgtttgtagaataaagcaggagaggctttcctgttagcacaacccaccccgccgcgtgagattccccatggtggaaagacactcgtaagaaatcccccccctgttggtgagaatacccgcgccccaccatatatgtagaagagagagagagagagagtgtgagaatatntatatgtgggacacacacagcactgtgtgaaaagagagggcgtctacatatagatgtgttctcctctatagcgcacgcctctcttgagcgccccgcgctctttctctcaacaaagatgtatatatgttagagatatttaagagatatgttctctcgagagagatatatattgtgatgatatttttagtaatatatctctctatagaggtgtatagagatagtttgtgagagatatnanaatgtgcgcccacagatccctgctgtgtgtgaccacacccttgtgtgtgtttataatttgtgagacatccctcttctcacactttaattcttgagaggagaaaatatcaccaccacacgcgggttttctctcttgcgccctctaaaaaaatatatatacaccactttcccttatataacacccaccatcataatatttaggaccctcataacatcttttatataaagaaaaaggtgtttttcccaaaatttttttgaaatatcttgggtgtaatatcccaagcctagcccttttcccccctttggagccccaca

SEQ ID NO: 581894 - DNA, 869 bp, Homo sapiens
cgtgtggggggcgggggcgggggggggcgggggggggtggcggcgggggggtgtgtggtggtggttggtgcgtcgcgtgtggagttggttgtgtggggtccgcgcggcgtgtgtggtggtgcgtcgtggggccgggctggggggcgcgggtgcgggcgtggctctggtgtgtcggggttcggctgtggcgggggtggctgtgggggtctgcctccgctcgtggtgggctctctgcgacggctgcgggtggggccgcaccccgtgtgtggtgatgtggcggtcaatcgttgctgcgggtggtcgtctcccgtggggttacgtggggggggggcgggggtgtgtggtggggcggcgttgaggcgtggggttgcgccgccggtggttgctgcgcgaggtgtgccgctgggcgggccgcgtgggcgagggtcggcccgggtggcgtgcgtgtgccgccgtgcgggggtgggtatggtgcgccgcggatggggtaggcccgcccgctctttgggttatgtaggtaggtggtgtcgcagtgtccaccagccggctgttttggtgtgcacgcagctcgcgggcggggcggggtgccccacccggttgtgtggtgccggtgatcaccgcggtggcgcctgtgcccgcgggcgtgggtgtgccggcggcgcagctggtgacgcgggtgtcgccgcgccgcggggtggtgtgtggccggcggaacgtggctttggagccatctgctgggccgcacgaccgccgtgttggaggccccctgtgtcggaggagggttggatcccgccgagaatttttgggtgagggtggggccgaggttgtgctcgccccccccccccctttgccccccctgtggggcccca

SEQ ID NO: 581895 - DNA, 826 bp, Homo sapiens
gggtgcaccggtgcgtctgcaaggcataatcgaggcatgggaggagctgcggttgtaacactctacaagatgggttgtcactggaagccgcagttcttttataactcatcagattgaagcgagttgcatgcagcgtctggtcagtgagggattataaggtagaatcttgtatgtaatggagattgagaagaatagttgaatgagataagaagggtgacgtgtacaattcacaatgggtgactcagactgttctggatataatgactggtaaaatgtatcctcagtcggtcttctttaaaggctaaatggaaagtcactggcaagatgggtctcgctatgaagtttagagaatcttcaggttcaggaaggcaaggctaagctctgaagaattcccttgggtacttgttgaagatcaagatgagatttttagatatgtatccatacattttatggtcggaatttatgactgatagagtacatattggcataatagcgtgggaagagatggtggcttaatgggtgtgaccgatcctgttttgctatgtctgggtgaatagagcctgagggtatactagcggatttgtggaatgtgcattctgatgtgcattacgaagtcatgatggtgatatggtctggggtaacaagattgcagataattcggaagagtaaatcaaagactatgtaagacaaaagtttgttgttcaaagggtattaggatactgggaagatcaaggtacagttcctggagagattgaacagcaaaaggggcgaatgggggccccgaaacaggtaaggttaaggaaaattatggggtaaaagttcccaa

SEQ ID NO: 581896 - DNA, 281 bp, Homo sapiens
gagctagtatgagaggagtaacactaaattgaaaaggacacttttataccaaccagcgaaagcagatgtcaaaggggatatggccaggtgcggtcgctcacgcctttaatcccagcactttgggggcagacgcggggagatagcgtgattctaggagttcaaccccagcctgggcaacatgcggagaccccgtaccgtctctacaaaaacattaaacggaaaaattagctgggcatggtggtgtacccctgtagttgcagctacactagaggctgaggtgg

SEQ ID NO: 581897 - DNA, 871 bp, Homo sapiens
cgggtgcagtagtaccgtagactattctctacaatccacaaagacttcgtaacattatacctcatgattcggcgctatgagcggtggagtcctaggcacagttcataccgcctccttatgcgagccgagcggggccagccaggcaaccttctaggtaacgacgatatctatcaacgttctctgtcatcagctccattgctactttcgttaccataagtcttctccatagataatacgccagtcataagtcgagaggacttggtcacacctggactagatccgcccgtaactaatctggtgggcccccgactatgggctgtttccccgtaatgacatatcatagcactaatgcattctgcattcctttacctacctctctgttcctatttccgtgcatcagctgtcatggctatagtggagagaccggatgtcaggagctagtgggatcgcatccagttcataccaccgtcacctaagtcaggagaatgtaatccctacgccaggaaggctcatccgattagtaccttaattcaatcttctccattagatccttagtcaggttgttcatcgggctaatcttaggggggccatcaaatttcaattcacagactaattgatccactgtaagtaaccccatgtacaataaaccgcaattacctaaagtgccggacttctgtcgtgaatgatccagtccctaattcacaggtagtactaacttctacgtaattaactctcccaaggtcctaaggctagttggggagtcaacttataactgaattaaataggagcgcaaggcttctatataacactctttcttgcgggaccccgacggcggaggggaaaccccaattttattatcgaggacttatgg

SEQ ID NO: 581898 - DNA, 271 bp, Homo sapiens
ataggaatctatatccaggtataggagggatctcttcgggacggacagtagaacgggggtggtgcttcaagattctcagcttcactctcactagatgcactcttctggctttcctttcgctttttcttttctttctggtgtttccgggaatttttccggatgtttcttttttcttttcttggatttctcttcagtagcactttcggaatcagaggaatcagaagaggacggaggaaaagagtgctaggctgaaggggtccggagctcgatt

SEQ ID NO: 581899 - DNA, 307 bp, Homo sapiens
ctcgaatcgacggtttctcattattatccttgaaaggattttaatctgccctggtgatacaaaatttctctcttttttttttgggttcagaaagtgtttaatagtgcaaattcccaagacttttctctatcatgtttttttttggtttatttgtttcattggtttctattccctttctatttttcttttctcattattatccttgtaagggtattttaatctgcccgggtgatacaaaatttctctctttttttttgggtccaaaaggtgtctattattgcaattccccaaaatttttctctatctc

SEQ ID NO: 581900 - DNA, 781 bp, Homo sapiens
  misc_feature (204)..(204): n is a, c, g, or t
ggactgtgagacctggcctcgcacaggacgcacacacaccgtccaatcagctcagcattctcccccgtgcacacttagatgagcagtgatgctctgtgctggtaccagaacaaggcagacgttgcaatgaagccacgggcatcctttattcttttcttgtccaaacctttctcccatacttgtccagaagcatggctgtcctcntgtcagtgaaatgtgtatgacgttaagtggtcagatgtatgtgcactcagacctatacgtgcaggcttattactaggtatgccctcgagcaagagggccctctcgagaggtagcattgagtcgagaggcgtgtctagccagctactcttctcctccgactgtacacgccgagcagtgtcagtggtcttccgtggtggtttatccctgccctcctcgtgggagctgattgcagggcgcgtttagtaacctgtcgcagagcttccgaggggtacgatgtggaatacccatgaagcggctctttctgcaagaactggggccctgtagtctgcagcacgggggatacgggcccggtcacccttttcggggtccctcctggtcccctgttgggcccctatgatggagtcgcccttacttgcctttctgcctctcattattttacaggcagatgcttggcttataatctaattacgtctttcccatttgttatattttaccaagccatcacactttgaaaatactctcccgggaatggtttcgggggggggaattacgtacgccctgggggacttcggaaggg

SEQ ID NO: 581901 - DNA, 992 bp, Homo sapiens
cttccatgtcatccttcaggtgctctatcttcccggaaggcttaccggaagcagttctgggtccggtacgcgtgcatgacagaagaggtggacagaaacgagcggggaaccgatgggaaagcctagataagaaggaacgagaagctacagtgtagagagaggcgctacggtggagcgcccgcagcgcggatcctgccacgaagacgaccgcgcacgtctataagtagtgcataccgagattgagtaacatagcaatagacaattctgcggcaacaatccatcgatagtaacacacaaccacgcaagtatgttcccactcgctaagcaccacaaataacacagcgaaaagcaggaacctacgcaagtggacagccatatagcgcacaaagccctgccacatcgatcgacaaagacaggacgccagacacgagttggcgccccacgtgaggtcaaccgctactgctcccatatcacaaaaacgcaacacgacccagacacagacagctatagagctcacgaacagacacaatgagctccaaaggtccgttaaacaaatacgtggctgcacaaaacataatgataacagcgatcaattggactgacacagcacatcatgtcgacaaagactaactcaataggagctggccaacacgagccgcgcacggacgctgcacccatcaattcctcacaaacgcaaactcatctgtccagctcagataaacaaccgcgctatactaacacctcacgacagttccaagccacaccctacggcgcgtacagcgcaatcaaacaagactacttacaatccgaagtacaatcaatgcatatcacggcaaacccgcaacgcaacgactagtcccagaccacgtcaacaatcgaacgaaaccaaagagtaccaatacatatctgtactccaacactacacagaagatcatccgacctgccagcctcccacccaccctacaatctcaccaccatcaccagcagctcac

SEQ ID NO: 581902 - DNA, 1046 bp, Homo sapiens
  misc_feature (519)..(519): n is a, c, g, or t
gtcctcccctcagcctgcaccagaggtctcatatgttaccccaggagttctcagaggattgggttggcctctaacatgttccttgttaattcttgttctgtaacatgcaattcaagaagctaggggaaaaatatctcatgcacttaaataatggtcttcaatttaatttaaaaatattttgacaatatttaatttgtgcttatgtggtgtttggtgtgagtgcagatattgcactgtgtcacctctggatctctgctcagaagcagaacaagtgatgacctaaatgtcaaaatcactgctcgttttcatttggtgaacttcaaactctgttctttttggtcacctgtggaatgaatgcaagcatgattttggcaggaacatttgtacatattctgccgtagataatgtggttctgatggttgttgtgtattttcagtatcactggatccctcagtcttcaccgttttataaacgtataagattaggatgaacttttgaatttacttggtaggaaaaaangtaggacattattgccatattgtatgtcttaatatttaacttattcggaaatatattccacactgttacatacattttccatggtagaaaggaagttcagtcagtcctgtggaatgaaaccatctcctaaaattcagcatttgcagcattctaaaagcctgtgtaggtacaaggacattgattttgtattcagaattcaagttaactatcttttaaattcgtggttgatgtaagtaataaaaaacattcttaaagttgagggttataagagagattatttctgtggtctaaaggttaaaaagccaacaacctgttaccaattatttcagctttttttgttttaataagtgtgacaacttaaaacttgtttctatttaaagtgaaatgtatctttcaactgtttagttacccagctgtttaatattccagtcttcccaaagtgaaaagatttgtatacaaatgttttctatgatttaataaaaatatatggcacaccttttgtttaaaaaggcaaacatttgtaaaaa

SEQ ID NO: 581903 - DNA, 385 bp, Homo sapiens
gaggctagacatatgacacgtgaaagttcagaaagggtttaaaagaaaaaaaaaaaaaaaaaccttgccccaagacttccccacaataaggaggaaagagggttggaccccaggtgcctactaccaatcccagcgggttaaacgggcgctccccctgaaatgaataatttttacaaatatgcctgtgtttgtgacaaacgaattggcaagatagggtttggaattgtgatctgcttgatttacgagcaaggccataattacactccgtgtatcccccctgtgtcattggggtacatgaccagttaaaaaccattggccctgtggtgttactctttcccaacacaaggtgaggacgtgctttcctgcaagagtataacgaggcctg

SEQ ID NO: 581904 - DNA, 124 bp, Homo sapiens
ttagtttttttaaaaaatattttaaacatatgtaaaaaattaagtggcaaagaactgggaaaggttaagacctgcttccaaagcctgaataatggggaaataaaattgttttccgatttctcca

SEQ ID NO: 581905 - DNA, 308 bp, Homo sapiens
gatgaggtattagctagtcagagaggctgaggcaggagaatggtgtgtggggtgaacccgggtgtaggcggagcattgcagttgagcagagatgatgccgatgaggtcgagcctgggtgacagagcaagactccatctcaaaaaaaaaagaggctgctgaaatcgggcagcgctttaaaaattccgggcccaggtaatttcggtaactccgggggcacccgtgggctacgtggcccttcctaggggcccggcaattaacccttcgttcctcagattaacgcattgggcccagggtctcttacattctc

SEQ ID NO: 581906 - DNA, 195 bp, Homo sapiens
tatccattatggctaacaaggatgatcatcttaacatgtgcttataggtcatagtatactataccatatggagaaatgtctatttaagtcctatgcccattttacaattgggttgtctctttcgttgttgagttgtaagagttctgtatatattctgggtattaatcctgtatgtgattagcaagtatttcctcc

SEQ ID NO: 581907 - DNA, 123 bp, Homo sapiens
gttgagggacaagcagcgggggaggaaagtagggccagctgtcagcccaatgagaggatgatgcaggctgcagtatcccctgccctgtctatcctggtgtgcataggagatcacgagctggct

SEQ ID NO: 581908 - DNA, 178 bp, Homo sapiens
  misc_feature (14)..(14): n is a, c, g, or t
  misc_feature (75)..(75): n is a, c, g, or t
  misc_feature (104)..(104): n is a, c, g, or t
ccggatcctcccgntcagctggcggtctgggctgctctggggcagtcattcggtccactgctctgcatcgcgggngccgggaattttccgagtccgagcgggtntgctgcttttgctcagaggacatccatgaccctaatgggtctttttgttcaagataaagtgattttttgccttt

SEQ ID NO: 581909 - DNA, 828 bp, Homo sapiens
cctgtgagtggttaacccgaacttcagccgctgtgatagcggctcccagtatacagggtaaagtgtggccagtgcgcgctcctcccccaattggggggctgcccaccccccgccccccttttgcaacccgcggttcccccgaattataatggagggccccgttgtctattgagacggtctttatgataagacggaaagctctctgcttggtagcaaaagtgctgaattccgtcgacacagataacatgtgagcaacgcccgccgggagacaaaccccccatggctgcagccaagcttgtcgttgacacaattcttctgccaagctgtccaaccgcacaagaggcggtccgctcagaagacacacccgccctggcgggccccattcttgtatgcgtattataaagttctcttgttccgcctcgcgttgcgcgagtggcgccaaccacactctcggttggcggagcagatcagcgcaggagtattactgccccatgttctctgggcgggactcactaagaataaagttgttttggtctccctaaatgttcacgcgagagtaacaaaaaaagacaaagtggataagggaacagtacataagagcaaaattcacagatggctcgtcgcgccatatgtgcaacgacgccgccaacaaccgggcgcgcagacaccgcggtggtgtgcatccacgactggacggccgccacgccccttggggcggtcggagcagcgcggcaaacagcctcctcgcgcggcccacgggctgaacaagccgcccccgcgccgaccttggggaaccccccattcggggaaaaaaaccacatagaacga

SEQ ID NO: 581910 - DNA, 175 bp, Homo sapiens
ggggaaaaaaaaaaatgggccaacccccccaacttacctttcttctaaaaaggtggggttgggcaaatttttaatttttgtaaaggaagattttttaactggcctactttaaaaaaaaaattggaatttatgggccctaatttggataaattaaaaaaggatgtcccttttgtta

SEQ ID NO: 581911 - DNA, 764 bp, Homo sapiens
  misc_feature (131)..(131): n is a, c, g, or t
  misc_feature (330)..(330): n is a, c, g, or t
  misc_feature (423)..(423): n is a, c, g, or t
  misc_feature (510)..(510): n is a, c, g, or t
  misc_feature (512)..(512): n is a, c, g, or t
  misc_feature (648)..(649): n is a, c, g, or t
ggtgaataggcccccttcactcctggtgcccatgagtccgcggtccacagtgctggcatgtaggagggctaacggagaggagggaagtccatcaagattgaatggcttctattactcccgaggtcgttagncccaggccacacaggtaggcactggagaggaagtgagttcccatgttgaatcgcacgacatacggctacgcttttagtgcaagaaaacatttaacgacgccagtagacaagtgctcatctaaacacatgcctgcccactaacgtgcacacctccgaacaagcactgacgcggcatagagaacgtggatggtatgcccanacggagaggcctaggcatggatacacgcagaagagttatgcagaatccaaggtctagtatacatttggactattcatgcgtgtgcatccttcnagacccatttgccgtgtttcgacgctccttctgggcacgcgactcgagaaccggggatacacgcgtcaaagtgtacgtcttgtgccntngcgcatgcattcgtgcgcgttgcgaacgccgtcaacacttgcgtagggcacgttaagcctgtggttcacgcgcatgcgcttggcatcgcagggacggcgtgccacacggggccaaggtggacttgcacgcgggggnncccgcaagtgcatgttggttcaggcaggaatgcgtgggagaccggccctgatgtgttggcagcaggaggggaaagcgcaggccagggaaaaggtaagcacaccataggcctcggt

SEQ ID NO: 581912 - DNA, 163 bp, Homo sapiens
  misc_feature (127)..(127): n is a, c, g, or t
  misc_feature (138)..(138): n is a, c, g, or t
  misc_feature (157)..(157): n is a, c, g, or t
agcaagtgcaattaacagtatcgtgtatatcatatcagctcccatgtctccattatttggactcttggtggataaaacaggcaagaacatcatctgggtcctgtatgcggtggccgccaccctcgtntcccacatgangctggccttcacctttagnaaccca

SEQ ID NO: 581913 - DNA, 143 bp, Homo sapiens
cgggtggtaaaatgcctctttattggtgctggaggtgttcatgagggagctggccatgggaccctcgtcgggacccttgccgtcagctactttcgcctgcgggggatagtttgtcccaagggcaccccttctgtcgtcttctc

SEQ ID NO: 581914 - DNA, 352 bp, Homo sapiens
actgacagcttcatgaaactgtccaccaagatcaagcagagaaaataattaatttcatgggaataaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaaaaaaa

SEQ ID NO: 581915 - DNA, 373 bp, Homo sapiens
aggcgatctagaggatcccgaggtagcccaactggcccctcctccacacggggattacaattaaatgtaagattggggcagggacacaaacacaaaccatatcagagtatgtgaaccatccttgcatccctgggatgaatcccacttgattacaatgaatgatcttttaaatatgtagttgaattgggtttaaggatttggcatctctgttcaaagatactggcctgtagttttcttttttggtggcgtcttggtctggtttgggtaccagggaaatactggcccttgggaatgaattgggaagtattctcttcttagctttggtgatataattcttctttaaatgttgggtagagttcagcagtgaagccat

SEQ ID NO: 581916 - DNA, 606 bp, Homo sapiens
tttcgataaactgtgatggaaatttgcggatgttatccattgtctcttgaaatgtacttaaacctgggttataaaagaacaggaataagaaaaatgctaggccaccgatcggtaaattaacatagaagcaccatctccatgtgacgctggaggtgaaaactcctccaaggaaaggcccaacaacagatgcaatagcaaacgaacaactcaaaacagcaattagtatgcctctctgcgactcctctaccagggttgaaccaatgacgaacgataaactttgaataccacaaccgccgactccagcaataactctaccaccaatgagcatactcattgaatttgctaaagcagagatcagcgacccgatttcaaaaatgacaatagcaaatagcatggtctccttgaatccgataggtgtggcaattcttccccatatcaacgccaacagagcgtttggtaagctatacccggtaaataaccacccgatctcagagtacgatccaaactgtttagctacttcttcaatgattgtagaaactatcatgatatccaaggctgccagaaacagcgacaaagccaatgctatcaaagatgcgtacaagataa

SEQ ID NO: 581917 - DNA, 114 bp, Homo sapiens
ccggggtactcactgcaggctgccggtgccatatcctgcttggcccgctgcaggcgggttccagctcctcctgcttggcccgagcatccttgagcgccagttccccgcgctcct

SEQ ID NO: 581918 - DNA, 167 bp, Homo sapiens
tacaaaaagtacaaaaaattagccagacgtggtggtgcgtgcttgcattcccagctacgtgggaggttgacgtgggaagatcgcttaagcccagaaggtcaaggttgcagtgagctgaaatcgcaccactgcactccagcctgggttacaaagtgagaccctgtctc

SEQ ID NO: 581919 - DNA, 121 bp, Homo sapiens
tccattccaccaacatttatcatgtccctgtcacatgcagccacagttgcggcatctgggctcaggtgtgagcaagacaggaaaggtcctgccttgtggggcctgtctgctgccagccgac

SEQ ID NO: 581920 - DNA, 315 bp, Homo sapiens
  misc_feature (2)..(2): n is a, c, g, or t
gngaacggaagtgaattgtagatgtctttagtggcttttcctgagttggcggcacaacttcatagcggagtgtgtcagccaactctaaagaacgctccccacatgttaagaatggtaagctggtccatatgtgcctacatacagagttccacaagacacatggctaaggaaaaaggcaactcgcaaaacaatacatatagtctgacctgtgtatgtagtaaacacacatatatgctaataagtagtaaaaaggctgagaagaggagccgcatcttgggtaacagcggctaactggaaaggggacagacggtattt

SEQ ID NO: 581921 - DNA, 389 bp, Homo sapiens
taacagtgaggcaagggtaggccagcttctgcatgctggatgaaaatcatggcttctcacatcaattacaaggcctgcatttccccagatcgttccaagtttggcgattgctgtcggtgcctcagacacatatgcacaatggttacaactcagggctccagcactcagctaacaagagacgacgctgacctcctgggcacgaacgtttagcacatgctcaactcctctattgtgcacacaggaaggtggcctgaagatgcaccgcaagacagctgggaggtgcatgctgtactgtcagcctctctgtggaggcattcgtgcagtgccagctcacagggaggtgaagggggatatcggacccagcgagggagtcgctggttagggatgtc

SEQ ID NO: 581922 - DNA, 238 bp, Homo sapiens
gctgaggtgcgtctttgcgatcgcacctcgaaacgctcctagacgttgactccgttggagcggctcattggcgacgcacgatgcggggacctctagcggtgctcttgtgtgtgtgctcgatgtgcgtggtcctttgacgtcgcttcgtcactgactaaaacccatgccgccgtgggaggctgatttctcacacactggctggccctctcattctcactcctccttgggccccgaggtg

SEQ ID NO: 581923 - DNA, 193 bp, Homo sapiens
gatctttatccccaagtgcaggttccaaaaatatgctcagtgctagcagaaatcattcaggaagcttcttgaagagccctctctttattatcttagtctagactttcagcttgtcccagctactgtcaggcagcttcggcttcccaaggtcactagcaaattctgcttaatgctaatatccttggttttccat

SEQ ID NO: 581924 - DNA, 328 bp, Homo sapiens
gaaactctttacgtatgataaggtcttctcattgcttatgtgttctagttcaatgatgatccagtagtttctcactcgctcagagcaggttatctcagtgtccttgtctagacttctgaccccagcagtgtcacacaccagcacgtggaggtgctgttcactcgttggccttaaagagcccgctctcatcgcagtcaggatcataaagcccatcattgttctggagggccccttcaggttttgctcttctcccaagttttgagccattcatttctgccttcatcaccaaacatttggcagccagctttgagcaaatgacagtattttg

SEQ ID NO: 581925 - DNA, 419 bp, Homo sapiens
  misc_feature (330)..(330): n is a, c, g, or t
  misc_feature (335)..(335): n is a, c, g, or t
  misc_feature (382)..(382): n is a, c, g, or t
  misc_feature (411)..(411): n is a, c, g, or t
aataatcaaaccatcaaggcagatgcattggttgagttgctgttcatggacttcctggttgaacaaaatggtcttgccattcttagcaaagaaatacctcagcatgtggcaactcatggatgtggccagtaagtgctgtgagaagtgaacaaagaatagaaaattaagcactgtgcccagcctattttagtacttcatcatattatgttaaagagcttgtctcctacactgggactgtgatttccctattcattaaggaacttcgggtatgggtttttgtggcatcttaacagcttaatactttgataatgttttgtgtggcccaactcntgtgnttaaacactattctaggggactccaggtaaatgttttggcattgganttggagttttgtgtttaggggagttgttnttagggga

SEQ ID NO: 581926 - DNA, 513 bp, Homo sapiens
ttctcataatcgagaagtccagagtggtaaaatcacatcatggagccattgggccaatgttacttctgtacttttgcccaatcatccttaccctgtgggtatcatcctcattcttgtcacctcagggtcataagatggctgttacctcctctatcacatccgcatttcagacagggtagaagggaagagaaaatggcaaaccatacttgccagctcagtcagcccttgtttttatgaacttttcaggaagccccacccagtagcttctgcctacacttcattacctagaaccatattatattacttggccacttctccctccaaggaacactgagaaatgaagttctttatctgggcacattgttgtcctgaacaaatcagggttctgttagaagaacaaattggagagtagataggtgaacgatacagtaaaatttcattaaacaacattattcacgtttcctaactgcaggtgatttgcctgcctcggccttccaaagtgctgggattaca

SEQ ID NO: 581927 - DNA, 546 bp, Homo sapiens
  misc_feature (526)..(526): n is a, c, g, or t
tctataactggagattgccctaaacacaaccacaacaatctgatttagtttgagacactttatgcctgtaattgcgactgcttactaatgctgacaatactcaaaaactaaaaactacaaggaatatccttacaagaaatcttgtattttacagaagagatatagtaagagtgtgattattctcaatgccttatcagagctatgcagtactgcatggacatttacctacttgacaaactttcttatagatcattaacaccgagaagatagatgtaaaaaggcaaaattatagagcaatgcttggctagaagcaactgtcaatcaaagattactcaagcggccgggcgcggtggctcacacctgtaatcccagcattttgggagactgaggctggtgaacattgtcaccctaaagaagtgataaatgttgaaagtgatggatatggtaattaccccagtttcatcattatactatgtatacatgcattgaaacatcacattgtaccccataaatatgtacaattatnatgtgtcaattataaataaa

SEQ ID NO: 581928 - DNA, 164 bp, Homo sapiens
tacccgactagccgacggggagggaggaaggagaaggcatgtaatgtacaaagaattcgggtgtttccaggcaagacacaaaggtttcggtggggtgatgaggtgagtggggccatgagcaccgtcctgggaggggacaggctccactgtcgggctagtcgggg

SEQ ID NO: 581929 - DNA, 1256 bp, Homo sapiens
  misc_feature (4)..(4): n is a, c, g, or t
tatnctctcccccatggagcgcgcgcccacgacaggcaggggggagggagctaggcctttctcatcgctgtgtctgttgtgtcgtgcttgtgtttggttcgagctgctttggttgctgccccctgttttgtagtctgctgtgtctgggtgcttgctctttactcgttatgctgtgcacctttttttttatgagtggtgttgttcactactgcgtgttggtgtgtagtggtgtgcgtgcacgaaccttgtttgttccacctcgtgttttggtcgtggtgtggcttccttcgtttgtgttgtctcgctcggggtcgttttgttttctgggcctttctttgcgtgtccgactatgtgcgtgctttcttctcttcctcgtgtttgtggtccccacgcagtcacgttctcgcggcgccgttgtgtggccctcttcggtggcacgcgcctccccctctgtgtgtgttctcgcggcgcggggctgctttcttcttttggtgtttctctccccgcctcgcgactggtttagtcggctcgcccctggtgtgatttgttgtgttttcgccgccctgggtgtcttgcctttgtgtgcgatggtcgcctttgcccgcgggtcttgtgtgttgcctggttggtattttctccgtcttgtatgaggtgtggttctttttggctcggtatttccctccctcgccttgtttggttttttggtgtagtgccagttttccaccgtccgttacgttgtgatgataactttgtcggtggacccgcccccccctcttttatccatccggcaggtggggttttacgctctctcactttgtgcttatgccctccgtgtctcttatctctgtgttccgccaagacttcccttctctgtctcccgctgccgggggtctctcctctcactctcgtttttccgtccccgccccgcccctaatgaccgcgctcctcgctcacttttgcgcccccccccaccccggcgtgggacgcgcgccctccgcctcctctccaccggtatcaccgccgcagtctagcctcctctctctgcacccgcgcggagtagcacaccccctcgcccggtgctttgtggcccctacgcttttggcccccactcttattgtctctctctcttgtctctctcactcactcacctccctcactctctcttcatccccgtggattttctctctctctcttcttaatatcaatatttaaataaaaataaaaagacaaacacaccccacaatatcaaacaaaca

SEQ ID NO: 581930 - DNA, 116 bp, Homo sapiens
gacagtgaatacgctactacgcactgaaccgcatcgagttgacctcatcatgaagacctgctttagcccaccagagtgattggactctcagtgactcgcagcacgtaggagggcat

SEQ ID NO: 581931 - DNA, 319 bp, Homo sapiens
tccgtcgtggcttcactgggtatggtgttgcacacctgtacccaacttcttggaaggcagtagaatcgcttgagcccaggatcggagactgtagtgagctgagatcacgccactgcactctctctcaaatatatatatatatgtatgtatgcatatatatatatgacttttaagtgtacaattcagtgatttttagtgcaaccaaattcacaaagttgtgcagctatcatcactattgaatttgaaaacattttcttcaacccctgaaggaaaccccacactcactagcagccactccccattcttcctcccccgaccc

SEQ ID NO: 581932 - DNA, 695 bp, Homo sapiens
  misc_feature (346)..(346): n is a, c, g, or t
  misc_feature (428)..(428): n is a, c, g, or t
gggccgggtttccttttaacaaggaagtcccccaagggggattgctgttgtaatactcgagtgtctcatcggctttgtgctcattgaccctgggggcgtcaatggggtttgacatcgttcgcgccgcatcacctgcccgggttacttggggggaaccaccggaaaggggggaaaaaggcctcctatttgaggcccgtcggatttagtgcatggtagactgcccgtggagtgcgccctggacatgcgtcacttcggggtcctggccgccaggcgctgtagccgtggaagtattccaggccattggcggtggtgagctgctcgccgggcgaaatgtggtcttctttgngcgactagtcccggctcaggcacaggggaggatatgtcgaagggaagccaggggaggatcgacgagggaagccaaggggaangagaattcgctcgagggaagccaggggaggatcgcgagggaagccaggggaggatcagcgagcggaaagtccaagaggaggattcgcgaggggagccaggggaggatcgcgagggaagccaggggcagagctggggctcgggaagaggcgacgtaggggcttcagcttcactaggaatggacacagggtcgggggcctcgactccccacccgaggcaggaggacagggtggtgtcctgagtgggtcagatacacaggccagggacaa

SEQ ID NO: 581933 - DNA, 1018 bp, Homo sapiens
  misc_feature (167)..(167): n is a, c, g, or t
  misc_feature (357)..(357): n is a, c, g, or t
  misc_feature (376)..(376): n is a, c, g, or t
  misc_feature (378)..(378): n is a, c, g, or t
  misc_feature (387)..(387): n is a, c, g, or t
  misc_feature (469)..(469): n is a, c, g, or t
  misc_feature (472)..(473): n is a, c, g, or t
  misc_feature (514)..(514): n is a, c, g, or t
  misc_feature (517)..(517): n is a, c, g, or t
  misc_feature (531)..(532): n is a, c, g, or t
  misc_feature (538)..(538): n is a, c, g, or t
  misc_feature (571)..(571): n is a, c, g, or t
  misc_feature (613)..(613): n is a, c, g, or t
  misc_feature (626)..(626): n is a, c, g, or t
  misc_feature (726)..(726): n is a, c, g, or t
  misc_feature (737)..(737): n is a, c, g, or t
  misc_feature (827)..(827): n is a, c, g, or t
  misc_feature (833)..(833): n is a, c, g, or t
  misc_feature (888)..(888): n is a, c, g, or t
  misc_feature (899)..(899): n is a, c, g, or t
  misc_feature (926)..(926): n is a, c, g, or t
  misc_feature (1003)..(1003): n is a, c, g, or t
ggcggggagaatggtccagccctgcgttcggatctgacggcgcggatgcgtcggggcgccccgaggagctgtgggaggcctgtggtgggggccgctgagcgcttccgggcccggactggcacggagctggtgctgctgacctgcggccccgcctgccaccaccccgncccgggcccctgtgcctatgctgcccatggtcgaggagccctggcggaggcagccgcgccgttgcctccacgacatcggcactggcccacagggcttgccactgctgctcggcctcctgcgcccccaccagcaccacagccacccagtcccacacccagcccaccccggcctaccctggccagagagganaacgaggaggacgaggatnancccacaganacagagacctccgggtgagcagctgggcattagtgataatggagggctctttgtgatggatgaggacgccaccctccagganctnncccccttctgtgagtcagaccccgagagtacagattattgnagnctgagcgaggaganncccgcnggcccccccaccttttcagtgcccccatctctnagccctacccacacagcagtacgccaagtccctgcctgtgtntgttcccgtctgnggcttcaaggagaataggacataggtcgcggtcatcagatgaggagaatgggccgccctcttcgcccgacctggaccgcatcgcgtcgagcatgcgcgcnctggtgctgcnagaggccgaggacacccaggtcttcgggggacctgccacggccgcggcttaacaccagcgacttccagaagctgaagcggaaatattgangtccanggagggagcgcccgggccgcgtccgccccgtccacactacgccccgcccactccngggcctgctantctgaggcgatcgggaccggctcttgngtctccattccaagattgtccgctctgcaatcccgcgtcttcagccagactgcgggcgagagggattgtccgttccnattggttttgttttt

SEQ ID NO: 581934 - DNA, 500 bp, Homo sapiens
aggccggactctcacacggtatcctaggctagagtgtagtggcttagtcaagctgatgcagcttgaactcctgggctcaagcagtactcccatttcagcctcccaagttgcggggaccacaagcacatgccatgccatcatgtgtggctaattttcaaaaatttgttttctgtagagatggggtctcactgtgttgctcaggctggaagtgtaactgttatgtacttctctcaaaacgagtctggactgctgtcgggaggaacagaaggcttgggtgcttcggatggtggcctgaaaatcttctaagaagataacttcgcagtacgggactcggaacgaaggcctatgggggtatagagctagtatgcaaagtgcagtgattcactcgctgataattatcttctagtgagcttaaacctcttacatcttcaaaaatttcgcctgataccggaactaattcaaaattcacctctacatcattgtctgcatagaagccttag

SEQ ID NO: 581935 - DNA, 356 bp, Homo sapiens
gcattctgcaggtcgacctgagcatccccattacgctcctagactggcaagactagtaaagcgtgtgtctctgccaggttcttgatgcagcgtcatcactaccagatcccgtggcgctgcttctccacccagcacaagctgtatgatcgtgcaccaggattcccatcccagctccccaggccagagctactgtcatgacttctgaacgccgggtgatctctcacttgccaaggcatcaacgaccactgtgacccaaatatcagccaggggtatagtccagtgggaaaagtttgaaggatttcctcaggtgtatcgagttcgcattctaaatgagtaaccgacacccaagaatgagt

SEQ ID NO: 581936 - DNA, 231 bp, Homo sapiens
taaaaagggaaaaattttccccaagggggccattttttggggtttccccccccccccaaaaagggggttttgttttttcccccccccccccccgggtttaaaaaaagggggggggggttctttttggccctctctttttttttggggggtttttttttggggggggggccttttttttaaaaaacccccccctgggggggggtttaaaaaaaaagggctttttccccccca

SEQ ID NO: 581937 - DNA, 269 bp, Homo sapiens
ccgaggctgcggaccggcagtcactgttggagaaacatatgcgcaagccctgcccggatcctgcaccagttcaacttatagttcaggttgtggaacaggctgccaaaccttcagttaatgaacaaaaccaagttcaacctgcgcctgataacaagagaaatcttattttaaaactacttgctcttaaagtggctgcacatttgaagtgggacttacacatattatagaaaagtttgtctgttccagtattgaatatgctactaaatgaa

SEQ ID NO: 581938 - DNA, 391 bp, Homo sapiens
gaagtttggaaaaatatgctatttaattataatgttccctaggctgctgtaaacagaagtgaatcagacttttctccagctccctttcaaaataataaattatttgtcccaaatatcccctgatgggggacttttttattcttatggaaatagtgaattcccccaactatgatgaactatgttctttgctatttcttcccaatattttttaaggttttttttaaaaagccttagaaagttccatattggtttaggggctaaaattgggttgatgctgtttccccccctaattacatagttttaatcctttggccataattttaaaaacttcctttgttttgattttgaatccagtgaaaatctttttgcaataaactattttagttaaata

SEQ ID NO: 581939 - DNA, 726 bp, Homo sapiens
tatggagaagggggaattttttttttaatgagagattaatgtgtagcagagggtgttaacaactgtgcatggatgagctagatcgtggacatgcggtcaagatgatatatgaggccgcattaacggctgattttagaaaacgttgtattacttaagctttggctcgagaagggactaattttcataaggggaagggtgcgagattatgctagctacttggtgctgactttgctgatggttacatgcccggatgtaatagagaaaaatatactattattctggatagatctagaatcctctgggccttaagtgggttgcctgccttatccgtggagtaggaagatatgggggttatttttgtattaaagagggccaagaagaacacgggttttttggccttggagggagaatcaaaacattaaaggagtggttttaggaggtaagtaggcacaagcttactggtgggactctcatgaaggggggtcgatgttgttgttgttgcaatgatggtatgttttgtggagccgggatgatgtggtggtataccgaacatttggtatgggttttatagtgtggagtatgagtgtgatgttgttgtatcgaggtttattaaagcgtatcttattatgtatttctgccagtaataatggaatatgataactttgcgcagcacagtttacctgatttggagaggtctccggatatataggattggttgatctcagc

SEQ ID NO: 581940 - DNA, 243 bp, Homo sapiens
tcaaactgcgcccggacgacacagtccgtgtctccattttcgcataacattcctttcccgtctcgctctccaatagggtctttgatgtctgccactttcattcgcctccagatctgccaggcgaggcaggggacaataacagatggcgtacaccatggggcccagcacggggcccctgcccgcctcatcgacgcccaggacgcaatgctccttgcggcacaccgcggtcgcactctgtgaggc

SEQ ID NO: 581941 - DNA, 847 bp, Homo sapiens
taggtgcttgccctgtcctgtggtgatcactctgtcgctctttcgccctgctgtgcttcgttgcgccgctttgtttccacgctcctcggcgcgtatcgctttcccccgctgtcagtatatccgttccgcgcgggtcctccccgcgatttcttccgtgcgtcttctcgtactcgcggtcctccctcgtatttcggggacttggcacggaacatggggccccttctttccggaagcccccggccgcccctttcattggcacctcctcgccgcaacttcctgtgctctgttggtcttccaccctttctttcgtcccccagagggtcccgctgtgatgatatatagcgggggtccctcagggatgcaccctctgtgcttcccctccgaacttccattctgttcagttattcccctttctgggccttccctttgagaggcggccactctccccctcgcatcgactacccttattccctggctctcgtctgccccgtggttacgcccctctttgctagcgttatttcggagtttccgtgaatttataccctataaatactctttccccgtgccacatccacgcatttcttagttccccctttcgggaaaatgaccacgcgccaacttttttatctctctattatgaccacttagttccttcctttattccccaccccctttcctattacaacccggagcagtatccctccactccccttttaccaagtatatgattgtttgctgttgttcttataaataacacctcccttctgttatcgacaatgatagaatttgggggtcaccccatcttcccttctttcgacctagaaaaccccccccctcacatagtcaa

SEQ ID NO: 581942 - DNA, 300 bp, Homo sapiens
aaaaaaaaaacaaaaaaaaaaaaaaaaaaaaaaaaaaaaaaaaaaaaaaattttaaaaaaattcttaggcccgcagccgtgccgggggctcttaagaatgtccttaatcccgggggccgaggattccgacttccccatccacaacctgccctacggggtcttctcgaccagaggcgacccaagaccgaggatagggggggccattggcgaccagatcctggacctaagcatcatcaagcacctttttactggccctgccctttccaaacaccaggatgtcttcaatcagcctacactaaa

SEQ ID NO: 581943 - DNA, 151 bp, Homo sapiens
accaggaagtcccgacgtggtgaccttcgtgcgcgcagtggggcaacgaaggcgcggggtcagcgcgtcggacgtggccaaggtccgcaaggacgtgggcgcggccaaggcgccggtcaggtaggcggccttgccggcaggcggcaagcct

SEQ ID NO: 581944 - DNA, 369 bp, Homo sapiens
tatggcatcttctccaatagaaggctgtttgcctacactgaaaatctgatcttaggaaggccttctggagaacttgctgcagcttccacatcagcagttgctgcttcatcctgcacttttgttatggagatggcttccttccttcaatctcaggatttaacctctgctagcttccaacttttcttctgcagcttcctcacctctatcagaatttgctgaggccttgttctggattaggctttgtctaaagggaatgctgtggctggctagatcttctatccagaccactaaaactttctgcatgtcagctttgcagctctgccaagctctgtggtgcacactggggtaaagtcccgaggaggagaagca

SEQ ID NO: 581945 - DNA, 475 bp, Homo sapiens
  misc_feature (234)..(234): n is a, c, g, or t
acaaaccacatccataactctcctcatccttgtagtagtttcgtgagaggtgagaaaacaagtagacacaaagaactgtttcctccagaggccacaatgtgattaaagaaaacatattagatatatgcatacaccttcctatgtttagagtccttaatgaccttgttttaagacaattattttcataaaattactaaaaataatttgatgttacattataaatggataaaatcnctgaaaaaaaaatcaaatctagtttcatcttgatttcctactttgtccatccatgaagacatataaaatgagtccaataggaacaagcaaacaacttctttcttggactctaatttgaggcattgttaacacagtgatgttcatttattctatacatggaaaaggtgatgtctaaaaaattcacatgtccatattttactactgacttgtacattaaaaaatatttttttaaaaaacaaaa

SEQ ID NO: 581946 - DNA, 194 bp, Homo sapiens
tgacatttaagctttacctggtccccatgtgatgtgatcaaatgcttgaaatttaacccttttcccttgggttttaaactgaaagccgactctgctctgtgttaaaaatatgaaatggggtttgatactgttttagaccttatggagagatttaattatttgtaataaaaaatttgctgccgtctgaaaactga

SEQ ID NO: 581947 - DNA, 368 bp, Homo sapiens
  misc_feature (21)..(21): n is a, c, g, or t
  misc_feature (68)..(68): n is a, c, g, or t
  misc_feature (152)..(152): n is a, c, g, or t
ggttatttatttgatgtgaancctttttaaaatatagacatttacagcctgtatgtttctctttgagnccctgctttaggtacatccccataaattttgatttttaaaattcactcactttcggaggccgaggcgggcggatcacgaggtcnggagatcgagacccatccctggctaacacagtgaaaccccgtctctactaaaaatacaaaaaattagccgggcgtggtggcaggcgcctgtattcccagttacttgggaggctgaggcaggagaattgtgtgaacccgggaggcggagcttgcagtgagccgagattgcgccactgccctccagcctgggtgagagagcgagactccatctcaaag

SEQ ID NO: 581948 - DNA, 243 bp, Homo sapiens
cgaggacttgcggaatcgtcgtcgtggctgtgcgatttgtgtcaacttggcttgtaggtctgcttgaggatctgccagtccggcggctgccgcttccagcctccccatcagcgtttggatgcttcctctaggtccttaggaggtgatagtcatcgctgtccgaggttgtcatacaccaggttgtttggcgaacatactcctgaggaaccgcacggtctccagccaggaccacgacgaatccgg

SEQ ID NO: 581949 - DNA, 179 bp, Homo sapiens
gctttgtttttggacaaaaaagtctaacattttttgcccaacagaatatatatttaatgaaaagaaaagatacataaatgggtgaatttccagtttttttttaattattttaatccccaacattttcctgaaaaaaacattcccttaaacatgctgtggaataaaatggattgtgatga

SEQ ID NO: 581950 - DNA, 237 bp, Homo sapiens
cctctaccccctcctcatacccatccctcaaaacgtaacagcctaaaaaaaggaagccatcaaagaggactcctaaaatttgtgataaggatactgaagaggcaggtgtgtggatgaagggctcaattttctttagcaggtggggcactggtagtttgaccatgctccagtaaatatatggaaaacacaaattggacttttgttgtcgaggtcgacgcggccgcgaatttagtagta

SEQ ID NO: 581951 - DNA, 344 bp, Homo sapiens
ggaacatgttaaaaaaaaaaaaagccaggccgaggtgtggctcacgcttgtaatcccagcatttggaggccgaggggggtggatcaccgaggtcggagatcgagaccatcctgtctaccatggtgaaacgccgtctaaaagttaaaaataactgggacggtgatggcgaaaagacttgttttgttcccagctactccgggaagagatgaggctgggaagacatcgctttgagccgggggagaacacgacatttgctagttggagcccggaagaatttatgccaggtgtacctcaagacctggggttgaccagaagttgaactactgtctgtgtgttcacaccac

SEQ ID NO: 581952 - DNA, 257 bp, Homo sapiens
  misc_feature (38)..(38): n is a, c, g, or t
  misc_feature (88)..(88): n is a, c, g, or t
aggcccaaagttagtttccaaaactagttaataaatcnatttttcttcctttcctttttttgcacagaagctggtaatttagggcccncgtggtgaaccactttatatgaaaattttttggacttggtttacttgggttggtataaaacattaaatttaagttccttgaaccctgtggatcccctaatgggtatgaatgactgaggctttgtaaattaagggacgtttgtgtgaataaagttatttgatggggtcca

SEQ ID NO: 581953 - DNA, 400 bp, Homo sapiens
cgccaattacaaaccacagctcgaacgtctacaactacacatgtccaatgagccactagcggagatgaggctctttaagtaaatttagtataccatccagtattcgaattacattagccacattgtcaagtgtacaaatcacaggtggtaagtggctactgtactgggcaacatacataatagaacatatacataaataggaagtagtcttgggcagtgctgctctatcaatcctaccttccactcaactcccatacaacttactatggtccattatggatacttactacctaatggcagctcttccaaaatagctagcttatacacactctggtttcatgcacaatattcggattcatatatacaacaggccaagaggccttcaggctaatgccagtgc

SEQ ID NO: 581954 - DNA, 734 bp, Homo sapiens
  misc_feature (696)..(696): n is a, c, g, or t
gtaagccgagatcatgccactgcactccagccttgggtgacagagagagacaccatcttaagaagtaatagattgaatgtgtgctcacttcagcagcacataaactgaaattggaataatactgagaagatgagcatggctcctgtgcaaggatgacatgcaaattcatgaagtgttccatatttctccagaagagactggggacctatattcaacatccttaaagaaaaaaaagtcttcaaccaagaatttcatatctagtcaaactaagcttccgaagtgaagaagaaataagatcctttttagataaaccaatgttgagggagtttgccttacaagaggtcttgaagggagtagtaaatattgaatggaaagatcactaccacctaatataaaaacacacttaaatatacacagaccagtaacactataaagcaaccacacaagccagcatagtaaccagctaacaacataataacacaatcagatccacacatgtcagtgctaaccttgaatgtaaacaggcttaatgccccacgtaaaaggtatagagtggcacactggatttaaaaaaacaatggtatgtggtcttcaagagacccctctcacatgtaatgacacccataggctcaaaataaagggatggagaaaaatctaccaagtaaatggaaatcagaaagaagccgggttgccatnctgatttcagacaaagcagactctgaaccaacaaagat

SEQ ID NO: 581955 - DNA, 552 bp, Homo sapiens
tcactttgatacctgtgaagaaaatcagctatggttcctttcaattctacagttctaaaacatccagataaaaacataaaacaagtcagtttttcattataatagaatgtgaacaattacacccttttagactctaaacataaactacattcacagcctcttcaaagttgaggcttagtataataaatacaatcataccttaaattgttcatccagtttctttcttcctttctttttctttctctctttttctctttcttttagacagtatcttttttttttttttgagatggagtcttcccgtcacccaggctggagtgcaatggtatgatcttgactcaccgccatctctgccttctgggttcaaacgattctcctgcctcagcctttgagtagctgggattacaggtgcccaccatcgtgcccggctaatttttgtatttttagtagagacggggttccaccatgttggccaggctggttttgaactctcaacctcaggtgatccgcctgcctcggcctcccaaagtgctgggattacaggctgatcca

SEQ ID NO: 581956 - DNA, 172 bp, Homo sapiens
accagattcctcaggctgtgtcagacgccgcgaaatccagcgcagacacctgctcaatcaccgacaaactcgcgagtacgagcccaaccaatcatccgcggacatatacggcgcaatctgcgccagccgccccggtagtgcgggttcagccgccaacacccgatacacctgc

SEQ ID NO: 581957 - DNA, 201 bp, Homo sapiens
agtagtggctaatgtgatgtgtaggaggaagagctcaggtggaaaaggagggagctgctctcaggctgcgtccagtgcaagtgaccccagggaccgtgatgtgtctctcacagcttgagaagcctgagacagctgtcttgtgacagggacgtgagatgcaggatatcttcacgcctccccatttgtgacttcaaggagcct

SEQ ID NO: 581958 - DNA, 644 bp, Homo sapiens
tagggccccgaccactggggccccttgtcatgttgaggatgacatgcctcccggcccggggatggacaatgtctgctgccacctttggcttgctgacgtgattccctgtgtgacggtcctgtttcctgccgtcatgctgcctggcctgagttgggtctcctgtggttcaggcctggctcccccttcctggtctcccttctcccgctgggcctggtttatctgggaggagattgtcttccagtggctagcaattggacttattgatgatgtttgacccagcggcaggaatagcaggcaacgtgatttcaaatgctgggctcagcctctgtttcttctctcgtgtaatcgcaaaacccatttttgtgagctggaattccaatcatgtcttgtgatggtggtgatgaaacgaacggtgacactggaacatgggagaaactcccaggcatgtgaacacctttttgctgtgatggccgcgtcatgatggcccggcaaaagggcatttctacctgacccttttcctcatcctggtggacatgtacactcttcttcgcctttgagtgccgctacctggctgttcagctgtctcctgccatccctgtaatttgcttgccatgctcttcctttttctccatggctaccctgta

SEQ ID NO: 581959 - DNA, 92 bp, Homo sapiens
tggggtggcatctccgggcccagggaaccctgtgtcccccgggtccaatgattccccgggcccagccccccaaatagcggggaatacagggg

SEQ ID NO: 581960 - DNA, 120 bp, Homo sapiens
tgcttgaggaccttttacgcgagtacaagctcatcatgagtgagcgtgaccaggtatctctgagctggacaagctgcagaccgaagttggagctggccgagtccaagctcaagagcagca

SEQ ID NO: 581961 - DNA, 453 bp, Homo sapiens
gtagctccatgacctttgtgcacagacattctatggcacagctgactttgtagtaactgactgaggtacagtgcattaaccctagaatgctggttccataactgcagagccttaggcaacaggcatgacagccgagaacttttacctgggtctgttgagggtagatcctgtcacaacaggcagacttgtctagacaaaaatcacatgtcaaatggaagtctggtttcctcctccattgcttactaattgaatgctttccagaaaaggaagacaatggaagccagcacagacagaaaacctatacagtgtcatgaactcaacacaaagacacaagcacttagggtcggataggcctgcctgcacaccttcagagatctggacagaggtacacaggacaaaggagaagccacagcccagatagaccatgaggtgcatgggcagacccaatcgtac

SEQ ID NO: 581962 - DNA, 764 bp, Homo sapiens
gggagggacggtccagctttagctctctgctcgccgccgccgcttgtcgccgccagctcctctgatctacgaaagtcaatgtgacccaaacaaccagggaggctggcaggatgtactagtttttatcacgaggtgcaagcgcagtggtcattggcaaagctattgcgattgaacagcagctacaaggactggagtcaaatcattgtgtgatgtgctagcgaagagaccgcaccatgccatatccaaaacgttctagggcacaatctatactgctgctgaagaaattgaagcagttggaggaaaggccttgccatgtactgtgatgtgagagatgaacagcagatcagtgctgcagtggagaaagccatcaagaaatttggaggaatggatattctggtaaataatgccagtgccattagtttgacaatacattggacacagctacaagagattggatctgatgatgaacgtgaacaccagaggcatctaccttgcatctaaagcatgtattccttatttgaaaaagagcaaagtggctcatatcctcaatatcagtccaccactggaacctaaatccagttgggttcaaacagcactgtgctttataccattgctaagtatggtatgtctattgtatgtgcttggaaatggcagaagaatttaccggtgcacattggcagtcaaatgcattatggcctaaaacagcatacacactggtgctatggatatgctgggaggaaccggtatcgaaagacagtgtaaaa

SEQ ID NO: 581963 - DNA, 152 bp, Homo sapiens
ggaaagatggcgtcccgcaagaaggtaccggctctactgccacctcttcagcttcacgcggcgcaagggaaaggcaaaggcaaaggcggctcgggagatcaagccgtaagaagtcagatagatgcttgtgtattaagatatcaacattatca

SEQ ID NO: 581964 - DNA, 507 bp, Homo sapiens
tcgagctcggtacctttattcttttggttttggcttccttagcgaaattcacgggcgggaccaggggtttagattctcggtgaggggcacagtgtcaagggtccccttccaggccctgttacaggctgcacttgagaagggaaaaggactcgggaggagaaatggttgggcgaaaggagtcctgagaaagaaaagaaaggttaaatctgagagctgtgagcgcccttaaatttatcgggcccaggcggggtggtgggggctcatacctgcaatcccagcacttgggaaggccgaggcgggcggatcacctgaggtgggaagtagggaatcagcctgaccaacagggagaaaccccatctctattaaaaatacaaaataagccaggcatcgtagcgcatgcctgtaatcccagcaactcgggaggctaaggcaggaacatcacttgaccctgggaggcggcggtgggggtgagccaagatggcaccatggtactccagctggggcaac

SEQ ID NO: 581965 - DNA, 282 bp, Homo sapiens
gtgatctagaggatctcagctcatttcagttctggttggacgttctggcgcgtgcgcggccgtgactttaccgcgatccagatcgcgctcttgcaagcttgtgggtaaattagaggaaatggggattgaaccttatgagctgcagtcgaatgttgaatgtacttcgataaatgaagagattacgcacgaagcccagagtcagcctattcttcatcaagttgtgcccgacaatcaaaaagtacattctgctaatgaacaaaggaatgtgaactgaaatgagct

SEQ ID NO: 581966 - DNA, 550 bp, Homo sapiens
gggcgcagtggctcacgcctgtagtcccagcactttgggaggctgaggcgggcggatcacaaggtcaggagatcgagaccatcctggctaacagggtgaagccccgtctctactaaaaatacaaaaaattacccgcgtggtagctgggattgcaggcgcccgccaccacgcctggctaactttttgtttttttgagacggggtctcgcattgttgcccaggctggagtgcaatgacacgatcttggctcactgcagcttccagcctgggagacaagagtgagactccatctcaaaaatagtaataataataataataataacaacaaatttgtaaagattaagttgaaaaagaactactatataattgagtgaattagaagctaagatccagaaaagtatttagtctaatctcagatatttagcctaatccattcattttaaatgaaaaaaggagacttacagagttgcaaagagttcctacaaatcccaaaaagagcaaatgttttgaacgtgatctaaactagggtgccagcacatctcataaggggc

SEQ ID NO: 581967 - DNA, 106 bp, Homo sapiens
gatgctgagatgacttggagaatgttctctttggtgctctcgatctgctcccttgcccctctccggatggctatcccattcatccctacctagtggaatctgtgcc

SEQ ID NO: 581968 - DNA, 230 bp, Homo sapiens
caacttaaaaaaactcctgggggtaactcccagtttgggcttaaccccctttgccatgaggtgccaaaaaaaagtttgagtccccctgtggaaaatgttggtttattttcagggcttgaaaaaccattcccaaaaacttggtttgggaaaaccccgtttaattttaagttaacctgcatgttgtaaatgcgttttatgtttaaataaaaaggaaaatttttttaaatgta

SEQ ID NO: 581969 - DNA, 142 bp, Homo sapiens
ctacaatcatggtagaaggcaaaatgggcagcgagcatataaccatggtgcagtgcagggagcaagagagagtgagtgaggtccccagactctaaacaagcaaatttcacctgaactaacgatctcactcatcacccaaggt

SEQ ID NO: 581970 - DNA, 236 bp, Homo sapiens
tcagctcgtacccgtactgcgctgggatatattgcaattgtagggttttacgtgactttgggacacatatcaataacatttatacaaatacagcccaaacaaagccaaacccaattttatatttggtagtgcttcctgtataatttttggtaccaaataagccaaatttcacttttacatcagtgtgctgttaatgttaaaacccaatccttttttttttttttttttttttggag

SEQ ID NO: 581971 - DNA, 363 bp, Homo sapiens
  misc_feature (253)..(253): n is a, c, g, or t
  misc_feature (256)..(256): n is a, c, g, or t
  misc_feature (275)..(275): n is a, c, g, or t
  misc_feature (303)..(303): n is a, c, g, or t
  misc_feature (330)..(331): n is a, c, g, or t
  misc_feature (333)..(333): n is a, c, g, or t
  misc_feature (339)..(339): n is a, c, g, or t
  misc_feature (356)..(356): n is a, c, g, or t
ccagagcaaatgcaaagagcccttttgtgaatggattggattatttaataaccttccccttctgtggaggaaggattgtaaaaaaaaatgcctttgagacagttttttagctttttaaatggtgtttctttttaggggtctttgtaaaagggtagaagccttccttttttgataatgttaaatttgtaagtttcaggtgacatgtgaaaccttttttaagatttttttcaaagttttgaaaagctattagccnggntcatggggtaataaaacanaacgtttttcctttaaaaaaatttaagngggtgtgtaaagttaaaaagctgttgnncntttatnatttaataaaataattntaaagga

SEQ ID NO: 581972 - DNA, 1287 bp, Homo sapiens
gggcaagtgacatcgtctttaaaccctgcgtggcaatccctggacggctccgcgcgtgatgcccagggaagacaggtcgagctggaagtccgatctacttcccttaagatcatccaggtcattggattgattgagtcctgagagatgttgtcattgtagggagacagagcaaatgtgggcatcgcttatggagatgcaggcagatcctgctatgtccgctttcgccgggaaggcagtgtgtgctcgatgggcaaggatcgaccatgacttgccgctgaggctcatgccgagtggcacctaggcacaataggaacccgagcatctcgtgatgaatactagcttgcctcaatatcgcggcgggaattgtcgaggcttcagtagtatcaacccaagggagagagcatacactaggaacatctatgggacccgtgtttcgctaggacgcacatgacacggttggccgagctaggcttgaccgctgctcgccattgggtagacgcagtatggcaccctcgatgtcagacagttcgaccatggtgagccaaggcgaccagtacaacactaggcttctccgggggaccacgaaagaaagaaccgttcctatttgtcccaaggggccatttttgacagctaagttcaagcccaagcttaacaacattcttcgccaagccgtggggccaaccgcaactttggcatatagtccccttgcacgcttggaatggttgccaagaccatagaagtcgagaggaacctcgtgaagcatcgacacaagtaggggcgaaggcccagacagagagatacacgaccggtcgtggcaattggaaaccaattgccttccacacgaagtcctttcaccccccctcgtataccttcagcatttgatgacgggggtctttgagcatccatccacgagggtcgaagagggttggcttgccgaccaaaaattagaagcagagtccagttccttaaagcataaaaccgcctttgagacggtggcattctcggataacatccaggcacgggcaaagtggaaaacaaccacatctgtggcaaagtataccattccggacattgtaaccgcatggtcacaggggcgggtttgtccccggtgcagaaattggtttttgcgcaccaaggatgggctcgttggatcagctggctcaggaactttcggcggctataagccttcaaaacttgggtcggccagttcatacggataacccaccgaagtacttaggtcaaatacagagaccggggggtttaccacacaagccagaaggttcccag

SEQ ID NO: 581973 - DNA, 182 bp, Homo sapiens
cccctaataatctctgttgctattattttgagtagtgtttattaatgcctttatcactagattttaaattgcttacacaacttattacttttattccccccagtgtcaaaaacagtttgtgatgtttaataaatgcttatgaatgaataaacaaatgaataaggagctacagatacaatcgt

SEQ ID NO: 581974 - DNA, 151 bp, Homo sapiens
gttttgaacaagcccagattacaggagtttaaaagaagccttcagctttatcgaccagaatcgtgattgcattatcttcaaggcagaccttagggagaccttcttccagcttgggaaggtgagttttccagaggaggagcttgacgccatt

SEQ ID NO: 581975 - DNA, 180 bp, Homo sapiens
cctatgaggatccagcgatagggcaggcagcagcgtggactgttacctgggtagcactaagccagtgcttctctgtgtatctttacagatgaacgggacgggttcagaagaaacgttcacaagtggtcaacaagcacttaatgaaggtaggaccctttcatatatatgctgtcccagaga

SEQ ID NO: 581976 - DNA, 459 bp, Homo sapiens
  misc_feature (7)..(7): n is a, c, g, or t
aactcanagtatcacacacgtgtagtctccatatatatatctctaacactatatatatatagactctctcaacactgtgaaaatctccgagtatacactataggatattgtgtcaatatgataaccaaatgtttgtctaagagtggtttaatatttgtgagataatactccatggctccattgctttatactgccatgggcccttcgctttttcatcgagtaagcctttgggtatctcacttctcgatccataatagagatgtagataaccaataaaaggatgcacaaagaatctcatatagaagagccatagatattcacaacacagagcgctctcgagtgtcacaatactcataagagtgtagataatagagaataagaaaaagacgtctcccacattaacctcctgcggtgcacagttactttcgctacaacgcgccgggagtgcactccctacgt

SEQ ID NO: 581977 - DNA, 161 bp, Homo sapiens
agcaaacaggtactcaactgtgaggggagggctgtgtctgggcagaagtaggaaggttccaccctggaccgtccgacccccccgggccggcaggggcagcgggtccggcgctcagcgcgcggcgacctgttccggggcgtgctcagcccgagcaaccgcta

SEQ ID NO: 581978 - DNA, 463 bp, Homo sapiens
ctgcggagcagctcactttatcagagacatagataccatctagagatttgctgccctgcttgtcaggaccgcgcctgtatccgtgaggatcactatggcagagctggacctatccagatctcaggtaggccccgcttaccattgcatgaccccttcagtgaataataatttttttctgcctggtatgtgtccataatcaagcctttctacgttgcagagttgtgagataccactttgtcacatcatttttctccctactttttgcttctatgggagggaggcagatcttttttcttgaccacagatactaaagctgtttcaaccgtgctcctctcctgcagatctctgggggagccatggactctcaattacatccaaacagtggaggcttccgccctgggacaccctcactgcacccttacagatcacagcccctatacctacccccgggcccagcccctcc

SEQ ID NO: 581979 - DNA, 329 bp, Homo sapiens
tgtggtgtagcatcagataagcgaagggtccaggttggggagagccccaagttgagaacaagtaagtgaacaattattgtatgaacaacttgttacgatgacacgctaatcacaaacaacctgtgtgcaatatgttttcctaaaaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 581980 - DNA, 879 bp, Homo sapiens
  misc_feature (879)..(879): n is a, c, g, or t
ggacgcgtgggtcgacccacgcgtcgcatatagtaaagcccagcccatgacccctaacaggggccctctcagccctcctaatgacctccggcctagccatgtgatttcacttccactccataacgctcctcatactaggcctactaaccaacacactaaccatataccaatgatggcgcgaatgtaacaacgaggaaaagcacagttaccaaataggcccaccaacgaacacccaccgtgttccaaaaaaggcgcttccgagtacgggataatcctgatttattacctcagaagttttggtttcttcgcaggatttttctgagccttttaccacgtccagcctaggcccctacgcccccaactaggagggcacgtggccccccgaacaggctatcaccccggctaaagtcccccgtagaagtcccgactctctaaaagcacatgcggttagtgaactccgggatccagggagctattccagctctctgcgtggaggctcacgccatagcgtcgtacagctaggcaaaaacgtggccggaggagcgcgctcagtcactgtgccaagctgccaaccttggctttacgtctaacccaactgctcttacccttgggcggtccctccgaagttgttctgacgccccgcgtgcccgtacacaagagcgccccttctgcgaagggtgaccttgttcccggaggttcctgccccccttgtgcgcgcccgattttgttcccctgcgcccgtggcccgattggccttaccggggggtctgccacacgcagtgtgtgtgtgcgtgtcgtacgcggccaccccactgggggcgtctttccccacgcgtggggcccctgccacgcgggtccgacttctaccgtggggggccn

SEQ ID NO: 581981 - DNA, 1147 bp, Homo sapiens
ctcggtcaaggttctacttgagcaagacaaagtgggtaatagtgtgcccatgatgagtctgcatcaccatgacgtattaccttacgttccagggaacgagagagctgtccttgcaccgtggtggagctgaagatacacaggcaatgccagtcgcacatcttcatccttccctgtatcaagacaagatggaggaagtggaagcctatgcatgctcccagagaccctgtaagcggtggagagactctctggaggttcatgagaggataggtgacgctctacctgctcgatagtctatccatctcgagggactataacctgaacgacatacttctccagctgggcacttgaggaacgccttcactcagtcagatggctgaactctgtcagggatcagcagtgggccaggtaacgctagctagtctcccaggctgggtccataaggctgatgctatgatgtagtaacgaggagggctacagagagcaatctgctgccagcagcagtcaaagatcaacctccttgctgcattagtgtgagacaaggaccacttgtgcgtttcaatcagggcacttccatgatgagcgcttgtccctagcagacgcccacgaacatctgcttcagtgagcaaagtcaccaatcgcatagaagtctagagcttgccatcaagcacggggaggctctcggctcaggaccttgcggctgccagctggactgcctggcgtctctgcggcccaggcctggccctgttgccccgagtggccatgggcatgtgcagcccctgcccgcctatacttggccacgtgacccgcactccccatgcggtatgccctctctaaaattccccgcgcgggcacccctcgggaacctcgtccagacccgagcacgccacggggacccgctcgtccaccgccatacacgcacgccggcgcgtcacacaccacccaaccgcgcgcgcccctcacagccgtccccagggagacgccaagatacgcccacccaccactcattacagcgggccccgaaagggaccaacacggacccgcgccccaaacacccgcagcgaacactcggcgcacatccacaaccccagcgcaacgacagcactcacaacaccgcccaataccgtcccgaccacacgcgcacgacaca

SEQ ID NO: 581982 - DNA, 1172 bp, Homo sapiens
  misc_feature (818)..(818): n is a, c, g, or t
ctgatttgtgtgtgcaccgcgtctccagcgatcccgcgatccactgcgctgccaggggcctgggggtgggtctcttgctgtctctgcgacgacatccttacgtttctggcactctaatgctggcgtttgtgcgtgtgtgtctgcttagcggtctacgcgtggctgttaggctccctcgtcccccagctccttgtgctcgttcatgctcctccaccgcagcccagcatgtgagcacgcgcgcgcaggcagctccccacgagatggctacatgaccgaacgtgctggagccacggtaccctgggtgatctgatccgccatcctagtaccagctctattgcacggcgagtgacggtcaatgctagaggacggtgcatgccatcgatggaacgcctactgagaacgaaccaaccggagtgggcaaggtacgccaatgttcgaccagtacaggtatacccgaaatcttgtggatcaacggaacatggaccatttgaatctcgatcgattctctgtagtgggtagaacggacattgtgcagccagtatctcttcgatcataccatagtcccaatgcttgtcttgaacgatggctacagagagagtctacagcgagacattaacttggccttggcctgacgatggattccaatgagtatggtcacagaacggtctgaaagagtctggagggagaaccagtgtgcctagcatcaatgaatcccatagcgcttagcatcgcagtaagagaagcatacgatgcatactggaaccctggtgtgagccttcacgtaagtgacatgcccaccctttctgataacattgcgnaaagccctttgagtccaagcagcaacagggactgatagaccaaaagttcacaacttgacattcccattaatgcaacttgtgggaatcgggagagtcccagaattggtcaactttccagggcttcccgtggggaagaaacaaacagagaagggggccgcccaaacccatcatagaggggttttacattttaaaaaggtcccgttggatagatttccgcctttggaacaaaaaagaggagctgaacctcagcaagcgacgtggataccccaggagaatacttgtcatgatacccacgaatcaaagcaacgctattataagggcaacgacaatataacgagcgcaaagtacacccac

SEQ ID NO: 581983 - DNA, 99 bp, Homo sapiens
ggatttgctggtgcagtacaactaggcttaatagggaccctattaagcctagctcgaattcgagcctcgaattcgagctcgaattcgacttctaacgtt

SEQ ID NO: 581984 - DNA, 146 bp, Homo sapiens
ctgattctagaggatcaccaatgcagcggaatcgcgaggcagcagtcatagacgaccacttcctcttcgacaagcccgtgtcgcccctgctgctggcctcgggcatggcccggtgatggccctgacgcccgcggtaatctggcaca

SEQ ID NO: 581985 - DNA, 346 bp, Homo sapiens
ctgctcagctatctagtagctgggactacaggtgcacgtcaccatgcccggctaattttggtatttttattagagacggggtttcaccatgtgggccaggatggtctcgatctctggacctcgtgatccccccgcctcggcctcccaaagcgctgggattacagggggagccaccgcgcccggcctttcttcagtgcaatttttaaagagaaacttaaatcctgtggtattctttcaacacaagcaaggatacttctcagagtcggctcaaaagctcagctcggtggactccgtgacaaaaggtacgcgtccacggccgaccctctgggtttctgaaaccaacctg

SEQ ID NO: 581986 - DNA, 880 bp, Homo sapiens
gccccctgcatttccaaagcagagggggcatggcaatcttgggtcccattttggcgtctacccagaggaaagagtccatatatggaaatgaatcctgcagcacgcatgtgttagagcagcgacaattcacatttgcaaaaatggggaaaccagcccaagctgcccatcagtctactagtggataagagtaatgtgtggtgtatctatacgtaccatggaatactatctcagccaggaacgaatatatatggcattcacagtcaacctggatggatttggagaccattattcgtaagtgatagtaatctcaggaattggaaaatccaatagcatcgtatgttctcaattataagagggagctaagctatgaggatcgcaaaggctatgaggtaatgatacaatggtactttggggatctctggggaaatgacgtggaggcgggtgagggatcatagaactacacactgggtccgagcacggtggctcatgccatataatcccagcactttgggaggccaaggtcaggtagattatgaggtcgggagttcgaaaccagcctggccaacaaggtgagaccccccccatctctacatataaataattagccgggcctggtggcgcatccctgtaatcccagctactttacttgggaggctgaggcaggagaattgcttgaactcgggaggcggatgttgcagtgagccaatatcgcaccactgcactccagcctgggcaacagagcaagactccgtctcgtaaaaaaaaaataaattttaaaaactacacattgggtacaatgtacactcctcgggtgatgggtgcaccaaaatctcaaaaatcactactaagaactatccatgtaaaaacagaccttccagcc

SEQ ID NO: 581987 - DNA, 262 bp, Homo sapiens
catagctattcctgtgtacaatagtaatccgcaaatggagtgcgctgttgaagtcagaggagacacctggtgctcagtgtagcccaggatgccttgagggggcctccgacgcctgcttcaccaccttcttgacgtcatcatatataggcaggtattcctaagacggcaggtcaggtccaccactagacacgtatggaagtggggcacacgggaagggccatcgcaagtagagcttccccggtagcagcctcaagggggatcg

SEQ ID NO: 581988 - DNA, 125 bp, Homo sapiens
tagaatcgagccggtacccgctcacacatgcacaggtggctgttctgtcgttatgtcagaggaacagtcctgtcagaaaggggctcttctgagcagaaatggctaataaacttgtgctgatctgg

SEQ ID NO: 581989 - DNA, 166 bp, Homo sapiens
gtgatcccaggattcggctcatttcagagtcttcgtacatgctgtgtctttctacctacaacatccttctcttgcatgctccaccagttaactggttcacagcttcgcattctttgggtttcggcttaaacattatttccttgataatgtgataggataatgtgat

SEQ ID NO: 581990 - DNA, 244 bp, Homo sapiens
gcggatcccgttctatgagcacagacacacacacacacacagacacacacacacacacagagtgaagagagcgacgggaggaagaggcagggggggggaactgcgcagaggggaacactatggtgtagaagtgtgagactaacagtagaaaagctgtgaaatggtcggagtagatccaaagtgccacaacttcccaacatctattcacaccaccactcctacaaaaaatgagaataatgaaaca

SEQ ID NO: 581991 - DNA, 179 bp, Homo sapiens
  misc_feature (3)..(3): n is a, c, g, or t
gtntttgattttgatttaggggtcttgtgttagtcaactcagaccctctgccttatcacaaggtcagagagctttctgtatcctggggttcttgtcttggtgtaccagaaaaattggatctcacatgggcttggagaatgagtgcaagcttttgtattgagtggtggcatcgataaaca

SEQ ID NO: 581992 - DNA, 241 bp, Homo sapiens
tattttatctcaacataataaaaacgactataaatcttcctaagagaatgctctactcccaagactaatttaaactcggggatcgtcagagggagtgccactgtgacttctacgatgaaagaacaagggagagaagatcttatcgacaatcatacaaagccatatatacgctattcctcaactcacagagttaattaaatgtcaccaggatggaagaaaccttataagcccctatctatca

SEQ ID NO: 581993 - DNA, 294 bp, Homo sapiens
  misc_feature (163)..(163): n is a, c, g, or t
  misc_feature (165)..(165): n is a, c, g, or t
  misc_feature (208)..(208): n is a, c, g, or t
  misc_feature (230)..(230): n is a, c, g, or t
gttgcgctgccgccgttcttgccgtgcccgaacgtcgatgcgcccagcgaaatcgcgttgtaacgttgagctgcggctgcttggtgacgacgttgatcatgccgcccggatccatcagcccgtacagcagcgacgtcggccccttcagcacctcgacgctgtnanccgccgcgttgaacgcacggccctgcacgagcggcatgccttnctgcatgatcgagccgtcgcgnttgccccgaagccgcgcttcatgatcgtgtcctgcgtgcccgcgagcgtgttgccctgcgtgat

SEQ ID NO: 581994 - DNA, 175 bp, Homo sapiens
ccggatactcatcatttgcagcaaactcagcactctgactgcctgcattcatggtgtctgcgcgcgatgctctaccccatgtactggcagcactgtgtacatccccgctgctgccgccgcatctgctggactactgctgtgctcccatgccctacctcataggaatccatttaag

SEQ ID NO: 581995 - DNA, 821 bp, Homo sapiens
  misc_feature (95)..(95): n is a, c, g, or t
ggccgtccccttttttgtcggaggtgtttgctcggtttcgcgggtcctccggacacaaaatgccgccggggtttttctgcgccttattccgggcncgcgcgggggtgtacaaccaccccctcttgtgtgacgcggacgggtctcatctcagttgctagctcgcccgcccctttgtgtctggcgccttgtttgctcctgtcgcccgcgcctcgtcttattggcatagcgcgtctctactgcgtctcttctagcccccattgcttcctgtgggtaaagtctcccccacgcatgattccggtttgtacctctcctgttccacacccctgctgggcaccgcggctattgtctccccgccttatggataggaaccacctaatgggtttgcataaatgacatctcactgtggacaccactttgttctctctctcctcgaaatcattcccctcgcgggctctccaagttttctaaaaccacgctcgtgattcggtgcacactatctaccacgtcacccccccaaattgtatcgaacagtctcgatccccgccacggtttctcttctatttacccaccctctcgctgtcgtgtcatcagctcccgtcctctctgagcgattgctttactaaaaaggaaagtgtttaagaacaatgttatatgactccgcgcccatattttgctccctcccttttttgacacccaaaacactctcactcctcttatctcgtctcgcccccttttttaggcgccccccctctgcgccccatgacaacccataacttcttcatcggcccccggttcccctaacccggcggacaataacaaaa

SEQ ID NO: 581996 - DNA, 883 bp, Homo sapiens
  misc_feature (41)..(41): n is a, c, g, or t
  misc_feature (144)..(145): n is a, c, g, or t
  misc_feature (147)..(147): n is a, c, g, or t
  misc_feature (150)..(150): n is a, c, g, or t
  misc_feature (172)..(173): n is a, c, g, or t
  misc_feature (182)..(182): n is a, c, g, or t
  misc_feature (185)..(185): n is a, c, g, or t
  misc_feature (193)..(193): n is a, c, g, or t
  misc_feature (199)..(199): n is a, c, g, or t
  misc_feature (201)..(201): n is a, c, g, or t
  misc_feature (203)..(203): n is a, c, g, or t
  misc_feature (211)..(212): n is a, c, g, or t
  misc_feature (220)..(220): n is a, c, g, or t
  misc_feature (226)..(226): n is a, c, g, or t
  misc_feature (230)..(230): n is a, c, g, or t
  misc_feature (241)..(241): n is a, c, g, or t
  misc_feature (244)..(244): n is a, c, g, or t
  misc_feature (246)..(246): n is a, c, g, or t
  misc_feature (254)..(254): n is a, c, g, or t
  misc_feature (334)..(334): n is a, c, g, or t
  misc_feature (338)..(338): n is a, c, g, or t
  misc_feature (345)..(345): n is a, c, g, or t
  misc_feature (349)..(349): n is a, c, g, or t
  misc_feature (352)..(354): n is a, c, g, or t
  misc_feature (400)..(400): n is a, c, g, or t
  misc_feature (404)..(404): n is a, c, g, or t
  misc_feature (412)..(412): n is a, c, g, or t
  misc_feature (421)..(421): n is a, c, g, or t
  misc_feature (434)..(434): n is a, c, g, or t
  misc_feature (436)..(436): n is a, c, g, or t
  misc_feature (444)..(444): n is a, c, g, or t
  misc_feature (446)..(446): n is a, c, g, or t
  misc_feature (453)..(453): n is a, c, g, or t
  misc_feature (457)..(458): n is a, c, g, or t
  misc_feature (460)..(460): n is a, c, g, or t
  misc_feature (467)..(467): n is a, c, g, or t
  misc_feature (490)..(490): n is a, c, g, or t
  misc_feature (492)..(492): n is a, c, g, or t
  misc_feature (509)..(509): n is a, c, g, or t
  misc_feature (511)..(511): n is a, c, g, or t
  misc_feature (540)..(540): n is a, c, g, or t
  misc_feature (587)..(587): n is a, c, g, or t
  misc_feature (669)..(669): n is a, c, g, or t
  misc_feature (750)..(750): n is a, c, g, or t
  misc_feature (873)..(873): n is a, c, g, or t
actttatcctttaaagcagcagcaatcacaaggcacatatntacaaaataccatcaagcaaaatagaaactgaacattcaaaaagtatgtgttgtttaaaaagatgttgaagaccatttgactaataagcacaggttataaaanncncanttccccccctctacctttaacnngacaaggcntgncggcatancacccncncnccataccnncgcacgtntaacanaccnttacaccacanaancnggattgcnaaagaaaaaacaggtaaagtactgcttaaaaatggtatttttagtgctttcacatcttttgtagatatctgggatttgtnagangaaaagngagnttnnntttttccttgggttagtaaaggcgtgtggttacacgtccctagggnaacncaccatanaggggaggngtagatttggtanantctgggananaaagggnaagnntnagattangggatcaacataataaccaactntnttcctaaaatatattanangtgaacacataagatatgtaaagaaaggntaattacattaaaataaaatagcttcagatttaaattattgctcacntaggaagtataatgaatattctctggctaaggatgctcagattagaaatggtgtgacatcaatatttagtgtgtacaaaagntctaagattcaaatacaatgcaaagtttataataatcacacaaaaagtgttccttttagccaccatttagcttcacacaangaagactggaaaatacgtgggttatttagatcttcaatataaatttgtaccacatatgttgaagtgttcctcttagctttaatgttgcagtcaattttctatgaaatactaaggagttaaggngtgcttactg

SEQ ID NO: 581997 - DNA, 401 bp, Homo sapiens
ggcttaaaacatctttttcttgggaagtccaatctgagtccatgagccctccatgttatagttataccatctagaatttatggtgtccagcattgctggggaagagcaggcatacaggggaggctcgtcagtgagtgactgccgaatctcagaagtacattcttcctgctcattgttcattggtcagttcttacgcacatggccctagaagctgcaggggagcctgcacgatgtacttttcaaaactatatacccaaaaaagggaatgagtagaatttggtaagcatatagggttgtctctactacacaggtatacttaatcttcatttagtatatattagtaaagccattttggtatgctcccctgaaattgagaaaatgaatttctccagtgacaatat

SEQ ID NO: 581998 - DNA, 861 bp, Homo sapiens
  misc_feature (113)..(113): n is a, c, g, or t
  misc_feature (268)..(268): n is a, c, g, or t
  misc_feature (640)..(640): n is a, c, g, or t
ccattgaggtgggcacccagggaagacggccacacactgcccgggggaccagaacagattccccgtgaagtccgaccgccgagcgcgcgcgccgcgcgtaagttgggttaggnacagctcacacccccgaggcagttgcaggagagccacaccaccataccaaacgttgtggttggcacactgcggctctcaccgggggaaaagaagacaaaagagcagtacagtgttcgcacggaagttggatgctacaaaataatatgaaggaggngccccgctgatctaaggatctccacgtggagtgaagcgggggagaacagaaacgccaacacacagaaggcgcctccggcagcgccgccgcggcgccgcaactcccgccgaggaattgtcttatctatgcaagaccacgcggcgtcacgactgatatgtactagtggggagttgggcggttgcatgccaccgcccagtcgctacattcatcctttcttcccatctgcaccctactcacacgaggggttggcgagcacatgtgcagcgccgaggacacaggaaggaagcgagggtgcaaggacgctctcctatgactatggtcctattcgtggcatggtaggcaacagcgaccgcgtgacgccgacacaccacncgacgccgcgtctaccaagggcgacacagttacgtgtacgacacacaagaatagactctatgagctaagctaacgtactttacttgacccagagcgacacgcgcctcacgactcactgacgcgcgcagtgccgactataacccgataagtgacacggacacaactgtccaaacaaagccactgacgcagtgtgtatcgtccacgctcatataacataatat

SEQ ID NO: 581999 - DNA, 144 bp, Homo sapiens
tgaccaaaattgatgtatacttgactcggtaacacgttataagagttctgataattccatgatctcagcaaacacttggacttgcctctagatactttcacctgagcttattaaattaaaggaaggcttactgtcctttctcac

SEQ ID NO: 582000 - DNA, 608 bp, Homo sapiens
agaaagaagtgaagtcgagatgaagaaccatttgcttttctggggagtcctggacgggttttattaaggcatgttcatgtgagaacgcccaagaagatgaaacggattgttcttgtcgacaacgaatgtcatgtgtgcccggattacttccaggtatcatccgtatctgtccgaagatcctactgaggacagtgtggagagaaacatccgaatcattgttcctctgaacagcagggagaatatctctgatcccatctcaccattcgagaaccagattcgtgtaccatttgtctgacctctgtaaaacatgtgatcctacagaacgtggagctggatacatcacgatagttactgttaaccagagcaatatctgtgatgaagaccgtgctacagagacctgctacacttatgtacagaacacaagtgctacctcagctgtggtcccactcgtatatggtggtgagaccaacaatggtggaaacatgccttaatcccagactgcctgctatcctgactaatttacagtcatctgctgactgcatagctctataatcttgagcaggctctccatttgcattcagacaagttaagcctatttaataaccaag

SEQ ID NO: 582001 - DNA, 148 bp, Homo sapiens
taaacattgatattagtagtggctagcagcaaggatctatgggcgtccgaccgtgatgagttcgttcaacgtagcataagaacgactcgtcgtagccatagcgtactctcagatatgagactggctctgaccatctacaaccactctt

SEQ ID NO: 582002 - DNA, 373 bp, Homo sapiens
cattgtaccatcatggacgatgctgccactcatttggattctgactgcggtggggatgatgggatccccaagtagcagagattgagtggcagcacttaacactacagataggtgtgccatgcagaatgggcagtgggaatgagcggccagcagactgctgctggccacagggatctttggcaatggctgactggctattatggtgtccttaagaatgaagtagatgggcagcctaataagtgttgctttatctatttgatggcagaaactccaccaggtctgggtagccagaggtgccacagggaacagtcacagcctcaccccaatcccgggcctaaccagttctcagattggaagccccttgattgaatcc

SEQ ID NO: 582003 - DNA, 383 bp, Homo sapiens
  misc_feature (14)..(14): n is a, c, g, or t
gtacagccccaggncatggtgttcaacaccctgtaatcctcagcactttgggaaggcccattcctcgatggattgcctagaagcaggagtttgaaaccaaccctggacaacaaagtaagaacctgtatctacaaaaaaaaaatttttaattaactgggcatggtggcatacaccagtggtcccagcctcccgaatagctgggattttaggcgccgccaccgcgtccggctgatttttctgtttttggtagagatggggtttcaccatgttggccaggctggtctcaaactcctgaccttgtgatccgcccacctcggcctcccaaagtgctgggattacaggtgtgagccactgcacccggccagagatattcgtaaaaaaaa

SEQ ID NO: 582004 - DNA, 961 bp, Homo sapiens
caccgtgctgaagggaaaagacaccagttgcacttggtgtgagcaggggtccggcaagaagggagacacatgctgtgcctgggagggaagaagtcgcatgaagaagagcatcaggggtccggaggctaggctagcgcgagcaggagtagcgaatagtgaacaaaggaaggcagctgggtggtcgttgagggagacgcccagtcccgatgcgaagtgtagtgatggtgcaactccgaggacatggcaatccaccatctcgacatactagaccgcgcactgtatgagctcgtgagccacaagtccagtcgtcacgtcttgtcgctgaggaccaccttgaatttttggacatgctgacggacggtgcatgggggactatgggactccttggggctatgtgcgcgaggcacttcgatccacgtcgagtccattgcacgaacaacctcccgttgtccttctgcgtatggtgcgcctcatttgcttggcacagtgaaacgaacatcgaagccccaaaggaaatcacattcaggagtcgggcatgggcgtaagctggatgcgcggattcatttgcgccacttgcagccagaagttgtcctcgtctcccagtggacacctagggttaacagcggtagtggctcattggtaggtgtattcaaaggaactggcccaagggaacttccctaagatgtggaaacttacacgggagaggggacacggtcgtcacgacaactgttgcccaccaagggagcctgtgaagacacccactcccgggacgacgcacaactcctggcgcaatcccacttcgaggtacccttccaaccaaacaaggggctaccaaaaggtgacaatggaaaggcccccccttggggacagcctcacgtacttcatagccttgctaccaagcgcacgtgggtggcgaacagccgtttgacacttcctggtcccatgtgcccttcccacagga

SEQ ID NO: 582005 - DNA, 555 bp, Homo sapiens
gttacagatctgcagactaacaccagctgcatagtcctgaatagtgcactttgtgtaaacagtttcactttctagatgctcagcagcttgtgcatggaacagcatcgactcagaacgatgtcgacgtagagtctgctgctcaccttcggtgacctggtcgattcccgtgccctgtttaaattcaaaatcccaaattgcagcacatgatgccagaaatagcactgaatcaagaaaatagccattgcgcgagttggcctcttgagtctttctgtccatcccattctattctgtaactgtgacttccagtcaggaagtttggtaaggtgtttaaaataaagtgggaagagcaagtttgctcaggtcaagtgctcagatcccgaatctagattccccagttctaaggccttatcacctcccctgcccataggccaacaaccatagttcctcacattagtgattagcagactctttgtggacgagtgaatttcacaaacagcacaaatttcagaagacatcgagggcacaggccctcacttgtcttcttttgacgcatca

SEQ ID NO: 582006 - DNA, 823 bp, Homo sapiens
ggccaccggggtccacaatgctccgggggaccccccctggccccccctggggagctgtgcccccccgacccattgttcaggcaaccaggtccaacccaccaagcgcgccttggggcggaacggaccaccccccctgggtccgcccggagatccaaagcgggaaacaaagttggtcgcccgccctcccagcgcatggaggatggggtgcacctgggaaagacctggtcacgagggtttatcatccaatcggagacagaatgcaatggggaaaatggtgggacccttttcccccgaggctgaccaagtccgccccactgctggttaggaagatccccggagagagtccctgaggggcctacctcttcagcctacagccacgtgtttatgactcccctcagcactggagacgctgtcagaccacagtttgagctggatctgccccctgtgcaactccatcactcagccaaatgatccttaatgaggagctgatggcctcctggaccagcccacacagacagtggtgatgcaccgcactgagcccactgccccgcagagacctcggctctgcaactggccgagaaactgggcagcctcggtggagaaccacgaacgggggtttgaccacacagcagggcacctacgggggctacttccgagaccagaaggaccggtcccgccaaaacgagggtacatgccccgcggtggtacccccagcagcagtttcagacggcctactgagctttccactttgtttcccgcctgggccatccaaccttgaagtcctaaaccccacctcagtcattaaggttttgtttaaagttta

SEQ ID NO: 582007 - DNA, 266 bp, Homo sapiens
atcccagaagcttctggcaaatggtagatgtcaatagataataatcaaattgactaatacacaatttaagccactcctgcttcagacccagtaaatatactgttcctccttcaaacacttaaacttcattatcacaagctaataaagcaactagataaaattgtgaaacataatttagtaatagacttctaaatatcccagaagtgtaaaatcttatatgtggaaatgttcattgagatactaggcattctagggatatcatggaa

SEQ ID NO: 582008 - DNA, 131 bp, Homo sapiens
cgttgcgtgtcacttacggccgtttggattaacgtgaaatattagttggcggacttaagcagatgtgaggaaagttgagccaataatgacgtgaattccgtgaaactctgtggctacaaaaaatgttgagc

SEQ ID NO: 582009 - DNA, 373 bp, Homo sapiens
  misc_feature (233)..(234): n is a, c, g, or t
gagatcatgccattgcactccagcctgagccatagagtgagtcttggtctcaaaaaaaaaaaaaaaccttgtgttggaaaccatctccaatgaagcagtgttagaaatagggcccaataggatataaattacagtgttaagatgcatactttactcttttcttttgagaagggagagagtatgttatgcgatgaaaacttttcagatttcttacagaggtcatagtgttccannacaagctgcgcaccaatgcgttggcgggtatgttgcgatatgtatattgcgtagcattcagatttgggctggctggtgtctggaaagttggggacaggttcatggtaataacctgctcaatgtaaaataaaaaaaaaaa

SEQ ID NO: 582010 - DNA, 418 bp, Homo sapiens
taacagagctgggaagaatattcaagatgacctgatttaacacctttcattctgttggggggcctttgatttcctcatatccagaagttgagagacttactcaagattgtaccatgcaagctggcaactagaacccaaatccttggactacttgttgaatgcagtttttctagattgtaaattaaaaatcatatccccacaacggctctggaaccccggggaccgcctcctaacccagcccacaagcgacagaaaacccgccatgccgctctgcagcctcacctcagacctctaaacgcttacttaaatgtaaaaaaaatttttttttacaccttttaaagactatatttaccattttgttgaaaaagtaaagaaaaaccatgacccgcaaccaaacgcgaaccacaatccccgagaa

SEQ ID NO: 582011 - DNA, 502 bp, Homo sapiens
  misc_feature (417)..(417): n is a, c, g, or t
ttaaggtcttatcgatgctgttgatactagttagcctgtcggctaatctgtggtgaaggttgttagcttctgtgagatgggttcgaacatcctcctttagctcggagaagttgttattacctatcttttgaagccttcttctctcaactcgtcaaagtcattctctgtccagctttgttccgttgctggtgaggagctgcgttcctttggaggaggagaggcgctctgatttttagagtttccagttattctgctctgtttttttcccatctttgtggttatatctacctttggtctttgatgatggtgatgtacagatgggttttaggtgtggatgtcctttctgtttgttagttttccttcaacagacaggaccctcagctgcaggtcggagctggctagaggtccaatccagancctgttgtgctgggtatcagcagcggtggctgcagaacaggggatattggtgaaccgcaaatgttggtgctgatcgtcctctgga

SEQ ID NO: 582012 - DNA, 128 bp, Homo sapiens
ttgatgtaaaaatttgtaaggaaaattttccccatttcgagggtcaagggtatttttaaccgtctggtttgtccttttaggccttttgtccccccaaagcggggttaaaaataaaaatgttaaacgca

SEQ ID NO: 582013 - DNA, 100 bp, Homo sapiens
gctccttcaccaaacaacttcccgagaaccataaattgaataaatattcacagaggtccgaggagaagcaagatcactcttctctccatggaagagggag

SEQ ID NO: 582014 - DNA, 552 bp, Homo sapiens
aaaatgagcagctacaaagactacacgttggcattaagaattgccacagcacatcggccagctccaaaacctgacattaaccatccctaataacgactgtagttcccaataggctttatagtgctttactcttttctttttgttttaagagactgtgactcgctatgttgatcacgctggttttgaactcctggcctcaagtaatcctcccagctcaacctcccaaagtgttgagattataggtgtgagcacagcacctgccccccaaccccaactgcctttatcattagagacagagtcttgctctgtcgcccaagctgtagtgcagtggcatgattatagctcactgcagcctcaaactcctgggctcaagcaatccacccgccccagcctcctgagtagctgggactataggcacacaataccatggccagccagtgctttactcttaaatatggacaaccaaaaactaccatgcagctgaggaagccaccgacatgggagagaccaagaaaaacaaataaacaaaaaattatgctagaggaaacagat

SEQ ID NO: 582015 - DNA, 823 bp, Homo sapiens
tagaggcttactagaagtgtggactagttctagatcgcgagcggtcgcccttttttttgtttttcatatatatctataaattgctggtggatacgcttcccaaaacagagacatccaaccaggcgttagaatggcccatctcgcaacatttcaaaaaacattgcaccccccagtggggtgaccaaagtatcgagtagtaccctagagttcagctgagtaggccacttgtggagcctacaagtggctgaggtctccaattccagagtgatgtgtctctcacctggtatcatcatttaacgcggaaaaacataatttgaactttgggggaacctgacggattcatctcgtaacaggattagtaacagcattcacggaatttcacacctctcctttggcgaccggctgcagaaccatgactggctagctagaagatcaccggggatcccagcctccagctgcaggatggaatgacgatataccaggacaaaaaacacctaatatttgcgtttacaacagctaacagccgttttaaatcgtgtcactctaattgacagaccaaattaaaccagaacctttttcaacatggcgccacatataccacccagcggcgtgtctcccaacaacttcttttctcgccaacaggtggcataggtctaagtggcctagttaaataaaacggccctggacacatttctcgccccagcgcagctccgctctggaagctcattcaccccagttaaccgttttctctttcacccattatagctcgcaaaacctcttagagacgcatcgggtccacgcttcacgcgtcttagctccccac

SEQ ID NO: 582016 - DNA, 399 bp, Homo sapiens
  misc_feature (220)..(220): n is a, c, g, or t
ttatcgctcctataggaattggcctcgaggcaagattcgccgaggtatgtagtttccattactccgtgactaagcttcaacgcctagggtcgcctgacccaccgcggcttagcgtgacaagcaaaggtggtctccgaggtgatcaggcgttctccgcccgagaatcagggcatgacgaggctggatacgcctgcacgacatgggtgtcttaagttgtcgnttggcaagtctcgaagcccaggtctagatgcagcctgtcaggcaagtaagggtgtttctccgcccatactgcccccatgggcctgtgtgggcaggtgccgctctgagagttggccctcccttgtgcctgccaggggaggaaaggcttgatgttccagcaataataaatgcgcctgtatt

SEQ ID NO: 582017 - DNA, 2132 bp, Homo sapiens
ggatcatgcacagaaactttcgcaagtggattttctacgtgtttctctgctttggcgtcctgtacgtgaagctcggagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagccaagggaacctgagcaactgcggctgcgaccgcgagaagcagggctactacaaccaagccgagggctggaagtggggcggctgctcggccgacgtgcgttacggcatcgacttctcccggcgcttcgtggacgctcgggagatcaagaagaacgcgcggcgcctcatgaacctgcataacaatgaggccggcaggaaggttctagaggaccggatgcagctggagtgcaagtgccacggcgtgtctggctcctgcaccaccaaaacctgctggaccacgctgcccaagttccgagaggtgggccacctgctgaaggagaagtacaacgcggccgtgcaggtggaggtggtgcgggccagccgtctgcggcagcccaccttcctgcgcatcaaacagctgcgcagctatcagaagcccatggagacagacctggtgtacattgagaagtcgcccaactactgcgaggaggacgcggccacgggcagcgtgggcacgcagggccgtctctgcaaccgcacgtcgcccggcgcggacggctgtgacaccatgtgctgcggccgaggctacaacacccaccagtacaccaaggtgtggcagtgcaactggcaaattccactggtgctgcttcgtcaagtgcaacacctgcagcgagcgcaccgaggtcttcacctgcaagtgaggccaggcccggaggcggccgcgggcaccctggaacccggcggcattttgcacatccactcctcaccttccctgccttggtgctgccagcagcagacatagacgggtgcagaagcggggagctccaggtgcaggagggcaccggccggggcccacgccctctgcccgcctccctggggctccttcctgccacctcctcccatcacctcctgcggcagaacagcacccgtgacccacccagagagcaaggccaggggtcttggtgctccccgacggggcccggcaagttctctttcttctctctgggaaaatgaacgtccaggacacacctgtatcccagagagcaaagtgatgaggagactgagcgtccccagccccacctggcggcatggacacagaaaagctacgccggctggcctctccagaccagttcccaggctgggtctgccgctgggccctggggcggtggggacagatgttgacacaaattatttatgttttcttagtatcagaagaggattctcggcactaacacatagccagtcctaactccgtactctgtgtcagcccatcccctagacaccctctgtttcctttcccggccccacctggccggcctctgcccctgcagagctgaggcagcctggggttgatggggaccacgcggtgcctgcaggtcctagaagtgagctgggcaggggctcttcagaccacacagccctgaccgggccttggaggagagccatggacaggctcctccatgccgtctttccttcttttgaaaatcctatcaatggctgggcgcggtggctcacacctgtaatcccagcactttgggagaccgaggcaggtggatcacctgaggtcaggagttcgagaccagcctggccaacgtggtgaaaccctgtctctactaaaaatacaaaaattagctgggcgtggtggcgtgcacctgtaatcccagctactcaggaggctgagacaggacacttgcttgaacccgggaggtggaggttgcaatgagccaagattgtgccactgtattccaacttgggtgacagagcacgactctgtctc

SEQ ID NO: 582018 - DNA, 259 bp, Homo sapiens
  misc_feature (6)..(6): n is a, c, g, or t
ggggancccccccccggggggtccccttccctttggggccttcccctttttttgggggaattaggggccggggccttttgggccccccgtttttgggttttttagggggggggggtttgggggcccggccctttttttttccccctggggggaattaaattgggggggaggggtttggggggggcccttcccccccccccccttcccctttgggtttttgggaagggggcccccccggttttttttgcccggtttttta

SEQ ID NO: 582019 - DNA, 352 bp, Homo sapiens
  misc_feature (341)..(341): n is a, c, g, or t
gagacggagtctagttctttccctcaggctggagtgcagtggcatgatctcggctcactgcaagctccacctcccaggttcacgccattctcctgcctcagcatcccgagtagctgggactacaggcgcccaccaccacgcctggctaattttttatatttttggtagagactgggttgcactgtgttagccaggatggtctcgatctcctgacctgattatccgcccatctaggcctcccaaagtgctgagattacaggtgtgagccaccacacccagcctctttctttcttctttctttttttcttcaggatttcattcctgttgcccagattggactnagtggcacgat

SEQ ID NO: 582020 - DNA, 111 bp, Homo sapiens
tactagagatctcttcgacggtgtctgtaatgctgactggtgagtgtttgactgtccccagtttgtcaccgagaggaagtcatgctttgcacagcccgctgtagttatcat

SEQ ID NO: 582021 - DNA, 401 bp, Homo sapiens
agcccagaggccccccggggttgtttttttaagggtttttttccggggggggggggaggggggtgggggagaaattagcccccccttagggggggggggggggccccccccccccctaaaaaaaagcccccaaggggggggggccccgatttcttggggttgggggttggggggggggggtccccccaaaattccccttgccgggttcccctttaggggggcccctgggggaaaccgggggcccccaaaaagggtttttgggttttaaccccccccccccccccgggggggtttgggggggggggtcccggggggggggttttttttccccccccggggggttaggcctttttcccgggccccattaacccccccttttttttttttttttgccttccgga

SEQ ID NO: 582022 - DNA, 134 bp, Homo sapiens
  misc_feature (39)..(39): n is a, c, g, or t
cctgcaggttgcctctacgacggactccccgaacccaanccggtgacgcccacgcgcaccaacactactcctgcggtttccggcctgcgtgccggggtacccgtacgctcgacatcttcgtacactcacgtggt

SEQ ID NO: 582023 - DNA, 690 bp, Homo sapiens
ggtcttttatcatatcctataaaaagttgagttaacaggctgggcacggtggctcatgcctgtaatcccagcactttgggaggccaaggcagctggatgccccaaggtcaggcatttgagaccagcctggccaacatggcgaaaccccatctctactaaaaatacaaaaattagccaggcatggtggcaggcgcctgtaatcccagctactcgagagactgaggcaggagaatcacttgaaaccaggaggcgggggctgcagtgagccaagatcacgccactgcattccagcctgggtgacagagcgagactccgtctaaaaaaaaaacacaagcgttgaatttcccaatacaggacaattgaggatgaagcggtaacaacagtgtttggggtcacctttatactctcagaaagctatgtggttatagacgcaaaggggcccccaaaccaccaaaacgtcacggggaactaatacctgtcgtgcttcatactaggtatatggtaccctgagaaagtcaccttaacctcctcttgaacctttaacttcggtccaatctaatacaggtgaaattctcaaccgttttcgcccccaggggcttaaccttcaaaagggtataggatggaaacaggaatccaactctgaaacttaagtgtaccgtgaaacaagaccttacttttcacactgggtta

SEQ ID NO: 582024 - DNA, 348 bp, Homo sapiens
  misc_feature (348)..(348): n is a, c, g, or t
ctcctacaggcagccaaacacattgattacctgttacattttaggatagaaatcaaagtagagcacgttggcatgagcctctttgtctcactccatcatttccagtatattcagtagttgaagaaagagctctacctgagtcagctgcactgtcatgagttagaccagtggctgagattagtagatggttcactagacatgttgctgttatgcagacattatatccattccagtcctctgcactgtacactgcagcagtgtgcctatgggacttagagggttgctgtcatctatccatgtgtggtagcttgctttcctctgactgtgcatttgcatgcttgtgcttgn

SEQ ID NO: 582025 - DNA, 470 bp, Homo sapiens
ggaggactgtcctgagagctggtgcattaggtgcctggccagtcaccatggtgaggacctttggccaactgccatgtaggagctttgcaggggcctgccagacaactccggctcccactccagagtctccttgtccctccccttaccctgtcaactctctgataacaccccctcgccgaccatagtcctttggccccagcctggagatggcctctgctgttggttctctggattctggattgagtcactggaaagggttgcatggcccattgtgtgttcagcgcttgtttgtttccaccaaatctcggaacaatgctcaccctagtctgcatgtccagtttcttgacagtattggaaaacacagctctctaatgtgtattctatccagtcggcttaactccaattccctgtttagatgactcggagaaatcgttttcagtggctagcggaccataatgaccttggccgta

SEQ ID NO: 582026 - DNA, 200 bp, Homo sapiens
  misc_feature (18)..(18): n is a, c, g, or t
  misc_feature (36)..(36): n is a, c, g, or t
  misc_feature (76)..(76): n is a, c, g, or t
  misc_feature (79)..(79): n is a, c, g, or t
  misc_feature (102)..(102): n is a, c, g, or t
  misc_feature (131)..(131): n is a, c, g, or t
gagaccctgtctctaaanaaattaagtagatatatnatatataatacatttttataattatcttattttataaccnagncatggttgcgtgtgactgtggtnccagctactcggggggctgatgtgggagnatcgcctgagcctgtagatggtttgaggctgcgatgggctcatggtctatgccactgcactcctagctc

SEQ ID NO: 582027 - DNA, 137 bp, Homo sapiens
gtggtaagctgctcctacagtagatggtattgagggtatagtaagtgtaaatctcaacactccttaactacatttgtttcttagaatccttctaactctgattatgtagatacctgggagacgttttaaaacaaaag

SEQ ID NO: 582028 - DNA, 185 bp, Homo sapiens
ccgggagccttaccctccggtaggccttaacctcggagccttaccctccggagccttaacctccggagccttaacctccggagccttaacctccggagccttaacctccgggagcccttacctaactcatgttctttttcaggatccaatcaatgctatacattacattaagtcacatgtcccct

SEQ ID NO: 582029 - DNA, 140 bp, Homo sapiens
agaccttgggcagctgcagtccccccagaattggtccctattatcccgccaggacttaagagccagcggaggtaaaccgccagcccctttagagaatgcctacctaagtagtagccttaccaagagacgcagtctgccgt

SEQ ID NO: 582030 - DNA, 519 bp, Homo sapiens
aatgaaaaccttcaaggcgatattaacgattgggccaacacaaaaattttggcacagtgtaatgaaattatcccccggctttataaaactccccccccccagaaggaaatattttacctccacaaaaaaaggtgggaaaagtttgccccccctttttccccaaattttaccaaagtgcaggaggcctccccggaaaaaatcctgggggattttctggggggggaacccccccctttggtggggcttccccagggccccccctttaaaaggtttattaaaccccccaagtgtgaatgtagcctttttcccccccttttaaaccttttaagggccttaatttggaacaaattttggggccgttttaaaaagttaaaccgctaaagtaagtttcggggccttttccaacctttaatatgggacatatgccccggggaaggaaaaaaccttcccctttttaaacccttttttttaaatggaaaaaccaatttttttaataaaacttttttaaattggccccca

SEQ ID NO: 582031 - DNA, 534 bp, Homo sapiens
  misc_feature (1)..(1): n is a, c, g, or t
  misc_feature (148)..(148): n is a, c, g, or t
  misc_feature (207)..(207): n is a, c, g, or t
  misc_feature (224)..(224): n is a, c, g, or t
  misc_feature (250)..(250): n is a, c, g, or t
  misc_feature (267)..(267): n is a, c, g, or t
  misc_feature (285)..(285): n is a, c, g, or t
  misc_feature (290)..(290): n is a, c, g, or t
  misc_feature (295)..(295): n is a, c, g, or t
  misc_feature (298)..(299): n is a, c, g, or t
  misc_feature (307)..(308): n is a, c, g, or t
  misc_feature (312)..(312): n is a, c, g, or t
  misc_feature (317)..(317): n is a, c, g, or t
  misc_feature (319)..(319): n is a, c, g, or t
  misc_feature (321)..(324): n is a, c, g, or t
  misc_feature (346)..(346): n is a, c, g, or t
  misc_feature (360)..(360): n is a, c, g, or t
  misc_feature (362)..(362): n is a, c, g, or t
  misc_feature (369)..(369): n is a, c, g, or t
  misc_feature (371)..(371): n is a, c, g, or t
  misc_feature (404)..(405): n is a, c, g, or t
  misc_feature (408)..(410): n is a, c, g, or t
  misc_feature (417)..(417): n is a, c, g, or t
  misc_feature (432)..(432): n is a, c, g, or t
  misc_feature (472)..(472): n is a, c, g, or t
  misc_feature (522)..(522): n is a, c, g, or t
ntattcttcttaggttgtgtaaataatttttttctaccatcccccatcatttgcatacatttttgtcaagtccaaacataatttgaagtgaggtaggtagtttctctctacttgtgccgttgtccttggggtgatgtcggggcctgtnccctgaacgcacttgtctcctgtgcaggggcagtgccaggactggcatcagtggctggnggagcttctcagttggntattttctcaatctcgtccaaatcanctgtgtccaatctttcnatcttcttattaaaatgntcctngattnaanncaaaaagnncatncagtncntnnnntccaccatgttcactgccaggnccctcttgccaaancngcccgtncncccgatccggtgcaggtaggtctcattgtcagnnctnnngtccttntccacgggtagttcnaagttgatgacgacagatacttgtatcaacatcatatgcngcgggcacacacgttggtggtcaccaaaaccttctctttgccctctcggnggcgctcaatca

SEQ ID NO: 582032 - DNA, 914 bp, Homo sapiens
gggacccttggggtctggacgcgacggcgggggagatgaacgcccctccagccttcgagtcgtcttgctctcgagggcgagaagaagatccccattagcagggggactcctagcggtacccaatggccctgttttattcaacacattcaacaaatgaaagaccgacacactgcggaaacttcaattaaatcacaagttccataaaaagaacgcgcagaggtgccttatttgtgctgtgcttagcaaaagtgtcgcccccaaccctttggggaggcaacaaagactatttcagtccggaggtggctaagaccgacggcgggggattttacaagcccccccaggggataggccttatgtaacaaaaggggccgtatcaccagagtcgtcatacagtgagcgtggcccccgtgtcttggagaggagcggcttttgccgggtgttggccgatatagaagatcaagcaggggaaggggaattgggaggtagcgggggccgggcagggggggctctttgcctccggggtccttgttgagccccagggtttcacctaattgtgttgccttagaaccacttcgcgtttcccagggttaccactcacccggggagggaaagaggccagggcggggccaaaggacacagtggtccccgggctgtttgtgttgggccactctcttatgaaacttgaaaacggaacggggttctgtactgataagagtaagggtttaagtattccttaaataaggttatagcgcaaggaggcagaagaaatgagaaaaaggaacaaagtgttttggggggcctgtgacgccgagagaaaaggttttagacaagaatggtgggggggggggccaagagtttgtgtacatggtccaaggggcaaggaaacgggaaggaagggggggcttctcaaaaag

SEQ ID NO: 582033 - DNA, 114 bp, Homo sapiens
ggtgtccggcgacctagaggatccccctcttcattgatttgtcatgatggttgatttacgttgtcaccttcctcttacggattttagctctaacttttgtttccacacgtcata

SEQ ID NO: 582034 - DNA, 454 bp, Homo sapiens
gcggccgctactactactacgcctactactactaaattcgcggccgctcgacgctatgttacccacagtccattgcgcagtgtcttgatcccaggcctctacgtcgcggttatgaaccttcccggcgtgcgcacagctcatgaattcactacctcctgtccttgtcgaactacgcgcgggaccgtgcgtgcaccgacgcctcgatacccgtctgccgttttcccgcatggacctggcgctgtaccgcgagctgatgagcgcctattacggcttctatcagccgctggagcagccctggcgccgtggggtgaaatcatccctgacctggaatgggggcggcgtacgaaaaccccgtacttgcaggctgatttgcgggcgctgggcctggaaaactcgcaaatcgacgccttgccgttgtgctccgaactgcccgccatcaccaacgtggcccagg

SEQ ID NO: 582035 - DNA, 1244 bp, Homo sapiens
ggcttgtaaacatatcctcgtgcctttatctgtcggtggagttgttcatatgcgcctccaagtggtgctatgtcgtcgcgcactctgcgctcagggatgcagtgacacgtatcacttttgcaactattgtgctaaatgttgcgcggttaaccgtttatttatctgttcgctcacatgcactagttgatggaggctcgcaactacctgcctgtcaatgtgcgaaatattgatggctcaaaccccatgttccattgagtaagtgttccgaagaatcaaatccgttgagtttcgttactgatttggcgcggccatgttgtgcatatggatgttaaagggcccaagtatatatgggtaagattcggatatgcaggacaggtcgtatgtatgaccagggcttaaacacaggtgagtttaaagtacccatgtcaagtggctacattaggtgtacgactctcatctctgtctgaatagaagtgtatgaatcttagcccttgcgatgttggcatcatgcacttgtaggtcccagctatctttggaagactgatgttcgtgatgtttcgcttggtgcactggtaggtcgaggtctagtcagtgatgccattgagcctggccacggtatctccagcctgggtagcaagagtcaagactccacctcatacgataagtaagtgaaatggattaatcggctagtaatagtaaccgtgactaaagtttacaatagtaaacagtggcattggccatccaaaacatggagtcgagtaaattattttaagatacacgtgggtaataagcagattaacagactataatagttgaaatatacagacataatttataaatggatgcagatgaacgagtaagttagtgagcttgaaagatcagcttgaagaactcttccacgaaagaagcagggacaatgactataactataataacaagaacgatattactgcttggggccaggtgctgtggcatcacgccttgtaatcccacgcacatttggcgacgcgaccgagtgccagtgtggatcacctgaggtcaggagttcgagaccagcctggccaacatagctgaaactccgtccctacttaaaatacaaaactagccgggtgtgcgtggcacatgccatgtaatcccagctactcaggaggctgaggacaggagaatcgctgagcctggagtgatcggtgacggttttgtctatgtcgagtggtcgtaggacttcggtgccttaaaaacgccag

SEQ ID NO: 582036 - DNA, 189 bp, Homo sapiens
cttaaacacaccacaatactatagtgtatagccagtggaatgtagcgtgggtgtagcgtagtagtagtagcgtagtagtagtagccggtgtgtagtagccatgggtgtagcatagtagtagcgtgggtagtagcgtagggtagtagccgtgggtagtagccgtagcgtagtgtagcgtagtgtagtagc

SEQ ID NO: 582037 - DNA, 437 bp, Homo sapiens
aggaccggaactggtatataccactaggagacacattctttggaaaacgatattgataacctgatgcgggactgtccagacgatcaaagcggttcttttccatacttatttatatacccatttaattatatgaagagcccttggtggcccttaaactacatactctaacatgcgttttagaaccctaagggaaaatgtggccctcatatataactcctaccacaatcaccctaatgggcctaagtactgtgcagcatgaggactaatccgttgttgttcacatactatccgcatgacatttcccggttaggaatacgcaatgaatcctttctggtacttgagatagcaacgctattggctgatacttgcagactgtgctcatgtgatcatccgcgtcgaataacgcactattgccacctgctgtggtgctgttgcgt

SEQ ID NO: 582038 - DNA, 419 bp, Homo sapiens
  misc_feature (316)..(316): n is a, c, g, or t
  misc_feature (325)..(325): n is a, c, g, or t
  misc_feature (356)..(356): n is a, c, g, or t
  misc_feature (387)..(387): n is a, c, g, or t
  misc_feature (393)..(393): n is a, c, g, or t
aaacagatttttctagattacattctgacaactattaatgtattttgagattatatattttagccctttagaattgaaatattttacctactttctagatgttattatttttaacaatgtgtttgtttgttgatctttttatcctaatagttttttcaaaatgttaattataaataatgaattatgaatcctttttatatagacattttcatatgtatttgagtaatagaaagtggaatagagataaataggagagaagaatgcaaaactaaaaatactgttggatattcagtaaaaccaaacacttctaccattnctccaatcnggagccatatgttaagggcaaatcaggtggncttgatgaagggttaaaggcagtagtttttncgtacngtctttggcaatgggtaaatacacca

SEQ ID NO: 582039 - DNA, 615 bp, Homo sapiens
  misc_feature (4)..(4): n is a, c, g, or t
caanactcattttatttttctactttatagtaggcctgacagaaacatagtgaagcaatctgggaggcaacctgtggtagattttatgctaaatgttaatgtaacctctgttgattttttaaaaatgtgtttatatataagatttgaaataaaaactttaatacaggctagaataaggaattttacaaattctctttagagcaaccaacattaaagttttagagttgaattttgctctatttcaactcccttacctctctagttttcagtttatattaagttttaataactttgcggggccctgcaaattaataatctacatgaagtatattattagagggaaacctaatcttactgctaagcagttggtgttggtactacataagtgaatggttcgtgttttggaattctaaaacattatttaaagtaagtgggtgttacgaaatggtttaaaaaatgtctgggtgaccttgcttatattattaaagtgatcaccacttaaggtcagaaaaaagtgtatttgttaaaatgtttctatgaaggtgcacttttgagacatttattaaacacgcggcatttaaataatggcgataaaaataaatatgaccatgttca

SEQ ID NO: 582040 - DNA, 228 bp, Homo sapiens
  misc_feature (7)..(7): n is a, c, g, or t
  misc_feature (16)..(16): n is a, c, g, or t
  misc_feature (42)..(42): n is a, c, g, or t
  misc_feature (57)..(57): n is a, c, g, or t
  misc_feature (206)..(206): n is a, c, g, or t
  misc_feature (217)..(217): n is a, c, g, or t
ggcgggnggatccccnggggtcgggagtttggggcccagccntgacccaacatgggngaaacctcatccctactaaaaatacaaaattagccggcctggtggcaggcgcctgtgatcccagctactcaggaggctgaggcaagagaattgcttgaacctgggaggcggaggttgcagtgagtggagattgtgccattgcaatccancctgggcaacngagagtgaaac

SEQ ID NO: 582041 - DNA, 198 bp, Homo sapiens
tttcattagtcgtttcctgccagcgtggtgctcccgcgcgtaatcctaccactttggaggccgaggcaggtggatcacgaggtccagagatcgagaccatcctggccaagatggtgacaccctgtctctactaaaaatacaaaacattggccgggcgtgatggtgggcgcctgtaatcccagccaatccagaggctga

SEQ ID NO: 582042 - DNA, 127 bp, Homo sapiens
tagtagattccagcatctaacatctataaaggtgggcccagatttcttgattcgaccactgtgctgttcctaccacacaaatatccattcctgttttgttagaagcagccactggtcctcttgtttc

SEQ ID NO: 582043 - DNA, 129 bp, Homo sapiens
cattagaggctgaggccagaatgggcgaaagcactaagaaggcatagtgggcttccggaaaaagtgcagtaatagtctggggggcagcattgttggaagatagctaatccgcctgtacttatggcgtgg

SEQ ID NO: 582044 - DNA, 145 bp, Homo sapiens
attgtgttatgtgcagtctgtgcagccattgctatctggttacaactcgccatgtcttaccgaagtctgaggtgcgctcaatcagcatgccggcgggcatgggcccctggaactccatcatgacttcttgaagctggaatctcct

SEQ ID NO: 582045 - DNA, 205 bp, Homo sapiens
  misc_feature (11)..(11): n is a, c, g, or t
agagacagagntttccctctgttgcctaggttggagtgcagtggtgcagtcatggctcactgcagcctcaacctcttggactccagtgatcctcctgcctcagcattctgaggagctgggaacacaggcatgcaccatcacgccttacttagatgtttatattatgattttaagaagtttgtcttatcccttctgtcgtcttctc

SEQ ID NO: 582046 - DNA, 167 bp, Homo sapiens
  misc_feature (146)..(146): n is a, c, g, or t
  misc_feature (160)..(160): n is a, c, g, or t
cctgcctgcacacaagaaagagagcaagggagcaaagtagaagaaaggtggcacgggggaaaggatatcaattcaagacggatggtaaaaatggcttagcaggagtgaaggctctccggtggtttcaccaagtggatctgctggangggattttctccangcgacag

SEQ ID NO: 582047 - DNA, 252 bp, Homo sapiens
cgccccccacccgcgaccccggaaatctcgcccctacctgcttcaccctcgccccacccacagcgcacttttcgggacctcccagcggcccttccccggttctctggacccccgtctccccgccctgcaacgcccccatcctggtgcccacgaaaggtcgtcccagttcccctcttctctacctcaaaggaggaggtgcaaatgaggaagcctaaataaaaacaggaaactcgatttttttaaaaagcctca

SEQ ID NO: 582048 - DNA, 705 bp, Homo sapiens
ggtaccagcacgccgtacggggccctggcatggcccgggatctcaggccttggctgctcggatgctgaaacagcggaggccggagagctcgcacacacacggtcaatcaattctctctggtgtttgcgtaaccaccagcaaacaaacttgacagtttgtgatacggctgaatgtccaccggcagacttccatgatagttcagatgctgattcatcagcaaattgatcttctggaagatgaaatcacttgctaacagtgtgtggttggcaaaatttgcatgcacgtgaactggaattttgagagaggcgtttacagacgctgattactttcgaatccagttccctttaaaccttgatgttaaaatgaaagctgtagtgattgttgcctgtgtcctcattgacttcatgtattttgaaagcactggctgccagaaacaaaaatcacgagcgtggatgtggactagggaaagtctcctcagcaaatctgaagtctgtatattgattgagactatgtaaactcatacctgtatgaattaagctgttaggccgtgcgctctggttgtatacttttgcttacaaattatagtgtatcttctggataacatgattataaagggttttgtacatttatttatactcattggcaatttgagagaaaggacatatgagtttttgcatttattaatgaaaacttctttgaactaag

SEQ ID NO: 582049 - DNA, 1640 bp, Homo sapiens
  misc_feature (74)..(74): n is a, c, g, or t
cacgcacagtcctgaaaaaaattttaatcttcttttcttagaactatcttggttggcatcatcaggccctgagngcacagtgcatgtcagcatctaagattccacttttcaaaatgaaggacctgatactgatcctatgcctcctggaaatgagttttgcagtgccgttctttcctcagcaatctggaacaccgggtatggctagtttgagccttgagacaatgagacagttgggaagtctgcagagattaaacacactttctcagtattctagatacggctttggaaaatcatttaattctttgtggatgcacggtctcctcccaccacattcctctcttccatggatgaggccaagagaacatgaaactcaacagtatgaatattctttgcctgtgcatcccccacctctcccatcacagccatccttgaagcctcaacagccaggactgaaaccttttctccagtctgctgctgcaaccaccaaccaggccacagcactgaaagaagcacttcagcctccaattcacctgggacatctgcccttgcaggaaggagaactgcctctggttcagcagcaggtggcaccatcagataagccaccaaagcctgagctcccaggagtagattttgctgatccacaaggtccatcactcccaggaatggattttcctgatccacaaggtccatcactcccaggattggattttgctgatccacaaggttcaacaattttccagatagcccgtttgatttctcacggaccaatgccacaaaataaacaatctccactttatccaggaatgttgtacgtgccttttggagcaaatcaattgaatgcccctgccagacttggcatcatgagttcagaagaagtggcaggcgggagagaagacccaatggcctatggagccatgtttccaggatttggaggcatgaggcccggctttgagggaatgccccacaacccagctatgggcggtgacttcactctggaatttgactccccagtggctgccaccaaaggccctgagaacgaagaaggaggtgcacaaggctcccctatgccggaggccaacccagacaatctagaaaacccagctttccttacagagctagaacctgctccccacgcagggctccttgctctccctaaggatgacattcccggcctgccaaggagcccttcagggaagatgaagggactccccagcgtcaccccagcagctgctgacccactgatgacccctgaattagctgatgtttataggacctacgatgctgacatgaccacatccgtggatttccaggaagaagcaaccatggataccacgatggccccaaactctctgcaaacatccatgccaggaaacaaagcccaggagcccgagatgatgcatgacgcatggcatttccaagagccctgacagctctaagatattagctactttctgtatgcacaagcttcccagctttgtccccacagtgtacctttttgctaaaacacttattacccttctgcagcaaaggcattaaaagcgctaagcatatattaataaatgcaagtggctagaaatagtgtaggtccccttcttgctttcaatatcttgttgaaataaaatgtgtcaattgtctctgtg

SEQ ID NO: 582050 - DNA, 1104 bp, Homo sapiens
  misc_feature (494)..(494): n is a, c, g, or t
gggagggccctgggatgccgggtgcccaaaggtgcggcctcgtctagcggggatagggagcgggatcaccctggcccgtgagcagagctctcagcggccctatgcattgccgtgggccagagcagggtgcttgccgcgagaccccgaccgatggcaggctgcgactgtggggggcattgcgtgttcaggtatctcgctctatgcattcatggggacatctagccaccgacgatggcagcaagggtaggagactctttgctcctacgatgaatggagagaacaggggtatcgaggtgtgggcacgtcgagctcgcgtgtagactagggtgcgcacttagccatcgattccccgatgagcttagtcgaaatccatatctagtagttgcgatcccccgattcgagagcactaagtcgcttgagaagactggagatctccgacgaaactcgtgcgaaaacagcgagatcagttggggtctcttagcatttcgactccntgtccttgcgtggccattgggcacagtgacgcagagggagcaaagaaccttcccagtcctattgtgaatgctgcacacgtacgagtagacaagcaacttggaggacacaacacggcaacttagacgaaagggccttggtttaatgtgccacgccagttggggtcgagttgggcccacgccaccacgttttttgtgttggccggcacgaatcggatcgttggacggcgcaacgccacgggagcggcaaaccggcctgcaggggaacacacctgcgaagtttccggtagggaaccaccaggggcccaccgagcgccttttttggacagggacaccttgaaggcgaggaacagaaccaggctaaggctctagtggttgagttactactcgcactattgtgggtgtcatatccaggagtgtataccgagtggggaatgaggggccccgcctgggggggcccgaccctgaaccgtttccattttcccggacgccattttcgttgaccatagcgcaccaccgtgtttcttccctttatctaggagtgaacccgtggtcgccaatgtgggaaagctttggcgttacaacacccgatagggccgcttaagcagcagac

SEQ ID NO: 582051 - DNA, 1983 bp, Homo sapiens
  misc_feature (74)..(74): n is a, c, g, or t
cacgcacagtcctgaaaaaaattttaatcttcttttcttagaactatcttggttggcatcatcaggccctgagngcacagtgcatgtcagcatctaagattccacttttcaaaatgaaggacctgatactgatcctatgcctcctggaaatgagttttgcagtgccgttctttcctcagcaatctggaacaccgggtatggctagtttgagccttgagacaatgagacagttgggaagtctgcagagattaaacacactttctcagtattctagatacggctttggaaaatcatttaattctttgtggatgcacggtctcctcccaccacattcctctcttccatggatgaggccaagagaacatgaaactcaacagtatgaatattctttgcctgtgcatcccccacctctcccatcacagccatccttgaagcctcaacagccaggactgaaaccttttctccagtctgctgctgcaaccaccaaccaggccacagcactgaaagaagcacttcagcctccaattcacctgggacatctgcccttgcaggaaggagaactgcctctggttcagcagcaggtggcaccatcagataagccaccaaagcctgagctcccaggagtagattttgctgatccacaaggtccatcactcccaggaatggattttcctgatccacaaggtccatcactcccaggattggattttgctgatccacaaggttcaacaattttccagatagcccgtttgatttctcacggaccaatgccacaaaataaacaatctccactttatccaggaatgttgtacgtgccttttggagcaaatcaattgaatgcccctgccagacttggcatcatgagttcagaagaagtggcaggcgggagagaagacccaatggcctatggagccatgtttccaggatttggaggcatgaggcccggctttgagggaatgccccacaacccagctatgggcggtgacttcactctggaatttgactccccagtggctgccaccaaaggccctgagaacgaagaaggaggtgcacaaggctcccctatgccggaggccaacccagacaatctagaaaacccagctttccttacagagctagaacctgctccccacgcagggctccttgctctccctaaggatgacattcccggcctgccaaggagcccttcagggaagatgaagggactccccagcgtcaccccagcagctgctgacccactgatgacccctgaattagctgatgtttataggacctacgatgctgacatgaccacatccgtggatttccaggaagaagcaaccatggataccacgatggccccaaactctctgcaaacatccatgccaggaaacaaagcccaggagcccgagatgatgcatgacgcatggcatttccaagagccctgacagctctaagatattagctactttctgtatgcacaagcttcccagctttgtccccacagtgtacctttttgctaaaacacttattacccttctgcagcaaaggcattaaaagcgctaagcatatattaataaatgcaagtggctagaaatagtgtaggtccccttcttgctttcaatatcttgttgaaataaaatgtgtcaattgtctctgtgatttagaaacactattaataacatcagagcaaggttctaagggtctcagcatttgatcatcactttttacttagctgtcttaagcattatagaatttctcttaccagcatgacactattatattcaggaaacatggcactgcttttttctctaagcaaaggcaaatatcctcataattctaagctaattcatttaaactttattaaatggggattggtgggaaactcccgactggtattactgggtttggtataatttaatttaaaattctcatttatagagtattttatttaatctagtataaaaaatctagcctaatttaaataaagaatttttctcactg

SEQ ID NO: 582052 - DNA, 184 bp, Homo sapiens
aattcaagcttctaacgatgtacggggacatgggtggtgcacgcctgtggccccagcaactcaggaagctgaggtgggaggatcactggagtcctggaggggtggaggttgaactgagctgtgatcctgccactgtactccagcctgggttgcagagtgagacctgtttcaaaaaagataaaaa

SEQ ID NO: 582053 - DNA, 1861 bp, Homo sapiens
tacagccccccattttataattatataatgaaagagaaaaggactttcgtgttacctcacatctgttacccgggtatggctagtttgagccttgagacaatgagacagttgggaagtctgcagagattaaacacactttctcagtattctagatacggctttggaaaatcatttaattctttgtggatgcacggtctcctcccaccacattcctctcttccatggatgaggccaagagaacatgaaactcaacagtatgaatattctttgcctgtgcatcccccacctctcccatcacagccatccttgaagcctcaacagccaggactgaaaccttttctccagtctgctgctgcaaccaccaaccaggccacagcactgaaagaagcacttcagcctccaattcacctgggacatctgcccttgcaggaaggagaactgcctctggttcagcagcaggtggcaccatcagataagccaccaaagcctgagctcccaggagtagattttgctgatccacaaggtccatcactcccaggaatggattttcctgatccacaaggtccatcactcccaggattggattttgctgatccacaaggttcaacaattttccagatagcccgtttgatttctcacggaccaatgccacaaaataaacaatctccactttatccaggaatgttgtacgtgccttttggagcaaatcaattgaatgcccctgccagacttggcatcatgagttcagaagaagtggcaggcgggagagaagacccaatggcctatggagccatgtttccaggatttggaggcatgaggcccggctttgagggaatgccccacaacccagctatgggcggtgacttcactctggaatttgactccccagtggctgccaccaaaggccctgagaacgaagaaggaggtgcacaaggctcccctatgccggaggccaacccagacaatctagaaaacccagctttccttacagagctagaacctgctccccacgcagggctccttgctctccctaaggatgacattcccggcctgccaaggagcccttcagggaagatgaagggactccccagcgtcaccccagcagctgctgacccactgatgacccctgaattagctgatgtttataggacctacgatgctgacatgaccacatccgtggatttccaggaagaagcaaccatggataccacgatggccccaaactctctgcaaacatccatgccaggaaacaaagcccaggagcccgagatgatgcatgacgcatggcatttccaagagccctgacagctctaagatattagctactttctgtatgcacaagcttcccagctttgtccccacagtgtacctttttgctaaaacacttattacccttctgcagcaaaggcattaaaagcgctaagcatatattaataaatgcaagtggctagaaatagtgtaggtccccttcttgctttcaatatcttgttgaaataaaatgtgtcaattgtctctgtgatttagaaacactattaataacatcagagcaaggttctaagggtctcagcatttgatcatcactttttacttagctgtcttaagcattatagaatttctcttaccagcatgacactattatattcaggaaacatggcactgcttttttctctaagcaaaggcaaatatcctcataattctaagctaattcatttaaactttattaaatggggattggtgggaaactcccgactggtattactgggtttggtataatttaatttaaaattctcatttatagagtattttatttaatctagtataaaaaatctagcctaatttaaataaagaatttttctcactg

SEQ ID NO: 582054 - DNA, 800 bp, Homo sapiens
ggctggtacggccggaagttagggcattgcagcgtcagcgcctgcgctcgtgcgtttcctcttcctcctcctactccttggcatacgcctcttcttcctcctgcgtctcccccgctgcctccgctgctcccgactgcggagccctggagcccgctgccgagcccctggcctcgcggtgcctatgctgccccaggcggctggcgcgtgacaggatgtgctgacgccagctgctctcctgccctctcccgctggcgacctgctggctgctgcggctgctgctctccggcctcgtccttcggctgccgcccctgctgtggagccgcctgccggccacccggatgtagccgcctgtcccgggagcctggacttgtgccctgacgaggccgggcacaggtgtcctcctggttgcacatgcctgtggggccctgccttcagcccttccaggagggaccaggcaagggctctgttggtgcccaggatgcgcccggcctccaggccgtgggggcccgggcccagcccagaactgccaagattgagcattgacttcctggccccaggagcttgcccggaacggagtctgcaacacttcaattccgcccccttaccaaagggacccgaccagctggttcccggacaccctgcaacactgggctttctcgggcacggtggccagcgtgcttggacagcttggtgcttccctttccgactccagggatccccctatgcccacggctccaatcccttccctttgttctcctgtgtcatccgaccctgttgcacactgtcgcccctgttgcccg

SEQ ID NO: 582055 - DNA, 1852 bp, Homo sapiens
aaaatcgtaacctaacgtgccaaaggcgcacagagcgttcgtttttctcacatctggacaccgggtatggctagtttgagccttgagacaatgagacagttgggaagtctgcagagattaaacacactttctcagtattctagatacggctttggaaaatcatttaattctttgtggatgcacggtctcctcccaccacattcctctcttccatggatgaggccaagagaacatgaaactcaacagtatgaatattctttgcctgtgcatcccccacctctcccatcacagccatccttgaagcctcaacagccaggactgaaaccttttctccagtctgctgctgcaaccaccaaccaggccacagcactgaaagaagcacttcagcctccaattcacctgggacatctgcccttgcaggaaggagaactgcctctggttcagcagcaggtggcaccatcagataagccaccaaagcctgagctcccaggagtagattttgctgatccacaaggtccatcactcccaggaatggattttcctgatccacaaggtccatcactcccaggattggattttgctgatccacaaggttcaacaattttccagatagcccgtttgatttctcacggaccaatgccacaaaataaacaatctccactttatccaggaatgttgtacgtgccttttggagcaaatcaattgaatgcccctgccagacttggcatcatgagttcagaagaagtggcaggcgggagagaagacccaatggcctatggagccatgtttccaggatttggaggcatgaggcccggctttgagggaatgccccacaacccagctatgggcggtgacttcactctggaatttgactccccagtggctgccaccaaaggccctgagaacgaagaaggaggtgcacaaggctcccctatgccggaggccaacccagacaatctagaaaacccagctttccttacagagctagaacctgctccccacgcagggctccttgctctccctaaggatgacattcccggcctgccaaggagcccttcagggaagatgaagggactccccagcgtcaccccagcagctgctgacccactgatgacccctgaattagctgatgtttataggacctacgatgctgacatgaccacatccgtggatttccaggaagaagcaaccatggataccacgatggccccaaactctctgcaaacatccatgccaggaaacaaagcccaggagcccgagatgatgcatgacgcatggcatttccaagagccctgacagctctaagatattagctactttctgtatgcacaagcttcccagctttgtccccacagtgtacctttttgctaaaacacttattacccttctgcagcaaaggcattaaaagcgctaagcatatattaataaatgcaagtggctagaaatagtgtaggtccccttcttgctttcaatatcttgttgaaataaaatgtgtcaattgtctctgtgatttagaaacactattaataacatcagagcaaggttctaagggtctcagcatttgatcatcactttttacttagctgtcttaagcattatagaatttctcttaccagcatgacactattatattcaggaaacatggcactgcttttttctctaagcaaaggcaaatatcctcataattctaagctaattcatttaaactttattaaatggggattggtgggaaactcccgactggtattactgggtttggtataatttaatttaaaattctcatttatagagtattttatttaatctagtataaaaaatctagcctaatttaaataaagaatttttctcactg

SEQ ID NO: 582056 - DNA, 1883 bp, Homo sapiens
ctgttatacgaactactggtatacgcgcccagaggataagctgaccaggacagaacacaattcagttactttgactcagcaatctggcacaccgggtatggctagtttgagccttgagacaatgagacagttgggaagtctgcagagattaaacacactttctcagtattctagatacggctttggaaaatcatttaattctttgtggatgcacggtctcctcccaccacattcctctcttccatggatgaggccaagagaacatgaaactcaacagtatgaatattctttgcctgtgcatcccccacctctcccatcacagccatccttgaagcctcaacagccaggactgaaaccttttctccagtctgctgctgcaaccaccaaccaggccacagcactgaaagaagcacttcagcctccaattcacctgggacatctgcccttgcaggaaggagaactgcctctggttcagcagcaggtggcaccatcagataagccaccaaagcctgagctcccaggagtagattttgctgatccacaaggtccatcactcccaggaatggattttcctgatccacaaggtccatcactcccaggattggattttgctgatccacaaggttcaacaattttccagatagcccgtttgatttctcacggaccaatgccacaaaataaacaatctccactttatccaggaatgttgtacgtgccttttggagcaaatcaattgaatgcccctgccagacttggcatcatgagttcagaagaagtggcaggcgggagagaagacccaatggcctatggagccatgtttccaggatttggaggcatgaggcccggctttgagggaatgccccacaacccagctatgggcggtgacttcactctggaatttgactccccagtggctgccaccaaaggccctgagaacgaagaaggaggtgcacaaggctcccctatgccggaggccaacccagacaatctagaaaacccagctttccttacagagctagaacctgctccccacgcagggctccttgctctccctaaggatgacattcccggcctgccaaggagcccttcagggaagatgaagggactccccagcgtcaccccagcagctgctgacccactgatgacccctgaattagctgatgtttataggacctacgatgctgacatgaccacatccgtggatttccaggaagaagcaaccatggataccacgatggccccaaactctctgcaaacatccatgccaggaaacaaagcccaggagcccgagatgatgcatgacgcatggcatttccaagagccctgacagctctaagatattagctactttctgtatgcacaagcttcccagctttgtccccacagtgtacctttttgctaaaacacttattacccttctgcagcaaaggcattaaaagcgctaagcatatattaataaatgcaagtggctagaaatagtgtaggtccccttcttgctttcaatatcttgttgaaataaaatgtgtcaattgtctctgtgatttagaaacactattaataacatcagagcaaggttctaagggtctcagcatttgatcatcactttttacttagctgtcttaagcattatagaatttctcttaccagcatgacactattatattcaggaaacatggcactgcttttttctctaagcaaaggcaaatatcctcataattctaagctaattcatttaaactttattaaatggggattggtgggaaactcccgactggtattactgggtttggtataatttaatttaaaattctcatttatagagtattttatttaatctagtataaaaaatctagcctaatttaaataaagaatttttctcactg

SEQ ID NO: 582057 - DNA, 1090 bp, Homo sapiens
gctcggccccgcgcgtcgcctggtcctccgagccagtcgctgacagacgcggggccgcgagcttctcctctcctcacgatccgaggcagagcagtcattagtggcgaagccttgggctgctgtgatgctggattctctttgtggcctagctatggagtgacctggagcctctgcaatgaagcgcccgaagcctggaggatggaacactgtggggcagctcgatacccgtgtggcagggcagccctggatggcaaccgctacccacctcagggtcggtggttgtgctgggggcatgcctcatggtggttggctcggggtgcaggctcgtggtggtggctgggggcgagcccatggtggtggctggggactagcttcatggtggtggctggggtcgaggaggtggcacacatagtcagtggaacaagccgagtaagccaaaaagcaagatgaagcacatggctggtgctgcagcagctggcggcagtaggtggtgcgggccttggctggtctacatgctgggaagtgccatgagcaggcccatcatacatttcggcaggtgactatgaggaccgttactatcgtgaaaacatgcagcgttacccaagcaagtgtactacagggccatggatgagtacagcaaccagaacaactttgtgcacgactgcgtcacgtcatcacaaatcaagcagcacacgggtcaccacaagcaaccaaggggcgcaacttcaccgcagaccgacgtttagcattgatgcgagcgcgtggctgagcagatgtgtatcacccagtacgagagggcaatttcaagggcttatttaccaccagaaggctccaagcatttgtcactttttttacttatccaactgtgtggaacccatcgagtaattctatccactaatcgtcccgacaatctgggactcaggacagcgccttatccctgtattgtgccagctcttctaagcattttactcagattatatgctatgagcatctacacagtgtaccccattaagcagcggttgtcaaacactaaacatagatagttcacaagtatttacatcaaagcgatcgtatacatagtggactgtgc

SEQ ID NO: 582058 - DNA, 1874 bp, Homo sapiens
caaacacaaaaaacccagaccaccccccttacacactgaccaacaccaccacccttcataatttcctcagacatatgctaccccgggtatggctagtttgagccttgagacaatgagacagttgggaagtctgcagagattaaacacactttctcagtattctagatacggctttggaaaatcatttaattctttgtggatgcacggtctcctcccaccacattcctctcttccatggatgaggccaagagaacatgaaactcaacagtatgaatattctttgcctgtgcatcccccacctctcccatcacagccatccttgaagcctcaacagccaggactgaaaccttttctccagtctgctgctgcaaccaccaaccaggccacagcactgaaagaagcacttcagcctccaattcacctgggacatctgcccttgcaggaaggagaactgcctctggttcagcagcaggtggcaccatcagataagccaccaaagcctgagctcccaggagtagattttgctgatccacaaggtccatcactcccaggaatggattttcctgatccacaaggtccatcactcccaggattggattttgctgatccacaaggttcaacaattttccagatagcccgtttgatttctcacggaccaatgccacaaaataaacaatctccactttatccaggaatgttgtacgtgccttttggagcaaatcaattgaatgcccctgccagacttggcatcatgagttcagaagaagtggcaggcgggagagaagacccaatggcctatggagccatgtttccaggatttggaggcatgaggcccggctttgagggaatgccccacaacccagctatgggcggtgacttcactctggaatttgactccccagtggctgccaccaaaggccctgagaacgaagaaggaggtgcacaaggctcccctatgccggaggccaacccagacaatctagaaaacccagctttccttacagagctagaacctgctccccacgcagggctccttgctctccctaaggatgacattcccggcctgccaaggagcccttcagggaagatgaagggactccccagcgtcaccccagcagctgctgacccactgatgacccctgaattagctgatgtttataggacctacgatgctgacatgaccacatccgtggatttccaggaagaagcaaccatggataccacgatggccccaaactctctgcaaacatccatgccaggaaacaaagcccaggagcccgagatgatgcatgacgcatggcatttccaagagccctgacagctctaagatattagctactttctgtatgcacaagcttcccagctttgtccccacagtgtacctttttgctaaaacacttattacccttctgcagcaaaggcattaaaagcgctaagcatatattaataaatgcaagtggctagaaatagtgtaggtccccttcttgctttcaatatcttgttgaaataaaatgtgtcaattgtctctgtgatttagaaacactattaataacatcagagcaaggttctaagggtctcagcatttgatcatcactttttacttagctgtcttaagcattatagaatttctcttaccagcatgacactattatattcaggaaacatggcactgcttttttctctaagcaaaggcaaatatcctcataattctaagctaattcatttaaactttattaaatggggattggtgggaaactcccgactggtattactgggtttggtataatttaatttaaaattctcatttatagagtattttatttaatctagtataaaaaatctagcctaatttaaataaagaatttttctcactg

SEQ ID NO: 582059 - DNA, 1499 bp, Homo sapiens
  misc_feature (1247)..(1247): n is a, c, g, or t
gttcttctgtacattcgtggttgacaagcaggttccttgtcctctcgtgtggtctccgctcttcttctctactcattctactgtgttggctggcacctgtgttctcttgtgggttgctctccgccgtctcgtgccgcgctcattttgttttgctcccccgctcagaggtgtggctcccgtccctcccccatttgggtgtggcaaatgtccctcgttgtttatataaacgccccgtgggcgacacacccccctgggttttgtttccccccccgggaccccacacgacactttttgggggggggtgctctttaagtaggagaaattgttgttgtctccacgtacggttggttttctcgccgcccgattgtcgttgttttgctcctccctcagtcccgcttgctgtcagccactggctgcttccccaagtatttttccggcagcacatcgccaaagacgatatatggcccccgggggctctgggaagaagtgccccccaaaaggtgagaggatgcgcgctcccccaacggttgcacaaaaatggtcccacaactgggcgccacagattcccacccgggggccccataaggaatttgctctggcacaatcttgtcttctggcccacaacggaggacctcgcacaacgccccccccaacacaggaagttttgtataatttaatgcacagaagcgcccgcggacacccatgtgacacgggtcggggagttttatagaatatccgggataaacgccaaagagccctgtgttgtgttttccccagatgggtataggagcgcccctgtctaatcccacacacatgtctaagcggtttttccacaggcttgagaggaggcacggcacgagatattggccccccacgggggtagaggtagaatgggagacgccctataggtgagaggcccgccccacaggcacacattttttctccctcccaacatagggcccacagggtctttctccacagagaaggaatccccgtgggcgactttcacaccctgcgacactgcacagagatacttatctcaccacgccacatggagagaggccaacatcctctgcacagcacccgtgggcccttcttgacacatctacccacacccggcacatgagacccgcccacaaggcccttctctatgaacggtgataccctcacagtgccggcagcccacacccgtgcacacatattgacacacaaggagcccgcgtggcgtctgtcttaacacacacagntggagaggcttgttcacagtgagatgagaggcctgtgacctatatggagttatcgggaatggaaattggtgttcgctccttataggtgcttggaacttcagccctcggaggtcacaatgtgaaagaaaaattccacttcactcaatacacttttctgaaagagggttcaatagacccccaatctcaccaatttgtccttcgcttacagttctgagacatccgtttaaaagttctatatttgtggctttatta

SEQ ID NO: 582060 - DNA, 1810 bp, Homo sapiens
tgaaagaaatgaaaataaatattcttcaatgtcccgcacagttcagcatgcagtacgttgggaagtctgcagagattaaacacactttctcagtattctagatacggctttggaaaatcatttaattctttgtggatgcacggtctcctcccaccacattcctctcttccatggatgaggccaagagaacatgaaactcaacagtatgaatattctttgcctgtgcatcccccacctctcccatcacagccatccttgaagcctcaacagccaggactgaaaccttttctccagtctgctgctgcaaccaccaaccaggccacagcactgaaagaagcacttcagcctccaattcacctgggacatctgcccttgcaggaaggagaactgcctctggttcagcagcaggtggcaccatcagataagccaccaaagcctgagctcccaggagtagattttgctgatccacaaggtccatcactcccaggaatggattttcctgatccacaaggtccatcactcccaggattggattttgctgatccacaaggttcaacaattttccagatagcccgtttgatttctcacggaccaatgccacaaaataaacaatctccactttatccaggaatgttgtacgtgccttttggagcaaatcaattgaatgcccctgccagacttggcatcatgagttcagaagaagtggcaggcgggagagaagacccaatggcctatggagccatgtttccaggatttggaggcatgaggcccggctttgagggaatgccccacaacccagctatgggcggtgacttcactctggaatttgactccccagtggctgccaccaaaggccctgagaacgaagaaggaggtgcacaaggctcccctatgccggaggccaacccagacaatctagaaaacccagctttccttacagagctagaacctgctccccacgcagggctccttgctctccctaaggatgacattcccggcctgccaaggagcccttcagggaagatgaagggactccccagcgtcaccccagcagctgctgacccactgatgacccctgaattagctgatgtttataggacctacgatgctgacatgaccacatccgtggatttccaggaagaagcaaccatggataccacgatggccccaaactctctgcaaacatccatgccaggaaacaaagcccaggagcccgagatgatgcatgacgcatggcatttccaagagccctgacagctctaagatattagctactttctgtatgcacaagcttcccagctttgtccccacagtgtacctttttgctaaaacacttattacccttctgcagcaaaggcattaaaagcgctaagcatatattaataaatgcaagtggctagaaatagtgtaggtccccttcttgctttcaatatcttgttgaaataaaatgtgtcaattgtctctgtgatttagaaacactattaataacatcagagcaaggttctaagggtctcagcatttgatcatcactttttacttagctgtcttaagcattatagaatttctcttaccagcatgacactattatattcaggaaacatggcactgcttttttctctaagcaaaggcaaatatcctcataattctaagctaattcatttaaactttattaaatggggattggtgggaaactcccgactggtattactgggtttggtataatttaatttaaaattctcatttatagagtattttatttaatctagtataaaaaatctagcctaatttaaataaagaatttttctcactg

SEQ ID NO: 582061 - DNA, 157 bp, Homo sapiens
agatcttggactcacggtgtaagaatgggagaggatggtttctcttactgccctcactagggcctagggaacccaggagcaaatcccaccactgccttcctatctctcagtcctatggagacagccaccttgagtgacgtttagttccaacacatta

SEQ ID NO: 582062 - DNA, 376 bp, Homo sapiens
actagaacggctgcttatcttctcatctggtggtggcatgcactataatcctgtattttaacaagaatagtacctagaaactgcctcacgctgcatttaagttgtaacagcagtacactggtacatggctctagtacccagtatcaggaatgtacaaatgtctttttattccagattacaatatacattatctagtggcgttgactgtgaccgctgtccacccttatatattttgtctactgaatccagtaacttgatggttattgtgattttccgccatgcctttttcttcattttctcccccttacttcgtctacgtttttggtgaggaacactgccttgggcttcctgtctcagttcattaataaaggtgctg

SEQ ID NO: 582063 - DNA, 110 bp, Homo sapiens
taattatacccaagagtagagtggaaattttttatagatggtcttagtttggaaattgaactaagaaatgagaaaatgttggccagagatgatgcatattttgtatacgt

SEQ ID NO: 582064 - DNA, 290 bp, Homo sapiens
  misc_feature (123)..(123): n is a, c, g, or t
  misc_feature (151)..(151): n is a, c, g, or t
  misc_feature (162)..(162): n is a, c, g, or t
  misc_feature (221)..(221): n is a, c, g, or t
  misc_feature (235)..(235): n is a, c, g, or t
gagttggagaccagcttgggcaatatgatgagaccctgtctctataaagaatacaaaaataggctaggcatggaagtgtgcacctgtagtcctacctacttggggtggctggggaggtagggncgtttgagcccaggggttcaaggatagngtgagcccgtnattgagtcaccacactgcaacctgggtgacaaagcaagatccttctctaaagaataggngaattttggatgancttgcctgcgctgagtcttacttcttcacttacttggtcactttggcccttcttc

SEQ ID NO: 582065 - DNA, 970 bp, Homo sapiens
gctacttcctcctgcttccccgccgtcgccgccgcatcatgagggacatcgtgtacttgcaggccgggtcgagagcggaaaccaatagttcgggtgcaaggttttgggaggggatcagcgatggagcacgggatcgaccccaagggcatcgtaccacggggacagggatctgtagcgggaatgcatcaaacgtgtactatcaaggagagccgtcgtgcggtaagtatcgtgccccgcgccgtgttcggggatctggagacccggaagcatggactccgtggcgctacggggccctatacgaggcatgatcttgccgtggcggagcaaacttcgtgtttcgcgtcggagtggtgctgtggagacaagcatggcgtcgcacaggagggcagctacacaggaaggctgcggagtctggatgagtatctcggagcgtggatgtgtgtgacgaaacggaaggttggaaatgcagtgactgcctggattgtgtctcagagatgacaccaaatccactgtcgtggcgccgacgtggcgtccgggacttcctgccctaatcttctggactgtccgggggacgagaggatagctctgacctggattgtgagcatcgctcaagcagtaggtagtgctgtcctggaagcttgtcggcgtgaagtgcgttgggcccgccgatagaaccgcccacacacgtcatgcaggttgcagcgggctcggtactgtgactcagttgggcactgccgcgtggataggggaacgtgcacctgacactgcttttgcggttcagagccccttgttggtggttcaccgcgcaacgtggtgggtgacctgtactggcctgggtggtggccccaaggggtggggccccgctggtggcgctgaaacgccaagtgaagctggctggggggtggggggctcatggccgcgcaccggggctttgtgcccgtttgcgctggccccgggtgcccgtccggca

SEQ ID NO: 582066 - DNA, 292 bp, Homo sapiens
atccagctcgttccccaggaatcagctattacacatcacaagagagcattgtggatgtacgaaggtgttgtgagaaaatgctgaatcagaacaattggaagctgttcacagtcaacgacgttgagttacatgcttcagaagatttatgtgatctgtttggctgaaccccgtgtgcccctgtgtttggataaagctgtccggactgaggcagaaggagaagaggaaggaagagctactgttaaccaggatacaagattagacaacagagtcattgatcttaggacatcaacta

SEQ ID NO: 582067 - DNA, 473 bp, Homo sapiens
tttaatcaattcattgacacacgtaacacgttgttatattataaatctaggaggctggcactcataccattacgctccagtttgggttccaaggtgcttctctctggattttcaccttccttgccaaaaatgattgattacgctgggccaactgggtgtccggcaatacccaacaagtgactttggcccctaacagcaggtcttggccagacagaaatcaatatttcaccattaaaatctatcaaagaagagttaaggcaccatctgtgcctgccgcctctctatggtgtgcgaacgttaaatccgacacttgcattacatgggtaatcaatatataccggtttacacatcacttgcggttcccttttagcagagagggatgtctggaatcgctcccattcattttcccacaccatttaacaagatttccgccccccaatcccaaccaaaaaaatggcatctatgggctgagg

SEQ ID NO: 582068 - DNA, 138 bp, Homo sapiens
gtccgggccacactttgtactcagtctctgccttccgggctcaagtgatccgtccgctcggcccgcaaagttctgagattacaggcgtgagtcacggcgcctggctctcctcccatttattgaggatggtccgcacag

SEQ ID NO: 582069 - DNA, 964 bp, Homo sapiens
  misc_feature (55)..(55): n is a, c, g, or t
  misc_feature (59)..(59): n is a, c, g, or t
  misc_feature (67)..(67): n is a, c, g, or t
  misc_feature (71)..(71): n is a, c, g, or t
  misc_feature (78)..(78): n is a, c, g, or t
  misc_feature (90)..(90): n is a, c, g, or t
  misc_feature (92)..(92): n is a, c, g, or t
  misc_feature (96)..(96): n is a, c, g, or t
  misc_feature (112)..(113): n is a, c, g, or t
  misc_feature (115)..(115): n is a, c, g, or t
  misc_feature (120)..(120): n is a, c, g, or t
  misc_feature (124)..(124): n is a, c, g, or t
  misc_feature (132)..(132): n is a, c, g, or t
  misc_feature (134)..(135): n is a, c, g, or t
  misc_feature (139)..(139): n is a, c, g, or t
caaggatgggagatcatgaccatccggctaacactaaaaatacaaaaattagccnggcntggtggcnggcncctgtantcccagctactngngagnctgaggcaggagaatnncntgaanccangaggcggngnntgcngtgagccgagatcacgccactgcactccagcctgggtgacagagcgagactccgtctaaaaaaaaaaaaaaagttgaattaacaataaggaaatgaggatgaagcggtaaaaatgttttgggttacattatactctcagaagctatgtggtttagagaaaagggcccccaaccacaaaagttagtggttcttattctgtctgcttcgtactaggtatatggtaactgagaaagtcacttaacctctctgaaccttaacttcgtcatctataaagtgaatctaacattttccccccggcctacctcacagggttgttgtgaggatcaaatgaaataatgtacatgaaaagacatatataaaatgtataatacagacaaagggtcctgttacacagttggaagtcattccctcagattttgggcctaggaaggtaggtgatttaaactcactgaaagcatgtaccatgtccaggttggatacatggcaacaaggctatgttaaattttttttctctgagttgagtccctaaaatactatcatgggctaattctaagaaggagcacgaatatatattcccctaaaattatagcttagcattgtcaatgctttagagcagttatgggagttatagattataacatattagtgatttgtgaaacttttttactaaaatgtgaccctcatttttctttacatgaaagaacatagaatatttcacaatgcatcccacgtggtaagaataaaaaattgttttagttatatgtacaaatgtgtgtgtgtgaacgtgtgtgtacttggtcattaaataaaatgtacttttttttt

SEQ ID NO: 582070 - DNA, 904 bp, Homo sapiens
  misc_feature (55)..(55): n is a, c, g, or t
  misc_feature (59)..(59): n is a, c, g, or t
  misc_feature (67)..(67): n is a, c, g, or t
  misc_feature (71)..(71): n is a, c, g, or t
  misc_feature (78)..(78): n is a, c, g, or t
  misc_feature (90)..(90): n is a, c, g, or t
  misc_feature (92)..(92): n is a, c, g, or t
  misc_feature (96)..(96): n is a, c, g, or t
  misc_feature (112)..(113): n is a, c, g, or t
  misc_feature (115)..(115): n is a, c, g, or t
  misc_feature (120)..(120): n is a, c, g, or t
  misc_feature (124)..(124): n is a, c, g, or t
  misc_feature (132)..(132): n is a, c, g, or t
  misc_feature (134)..(135): n is a, c, g, or t
  misc_feature (139)..(139): n is a, c, g, or t
caaggatgggagatcatgaccatccggctaacactaaaaatacaaaaattagccnggcntggtggcnggcncctgtantcccagctactngngagnctgaggcaggagaatnncntgaanccangaggcggngnntgcngtgagccgagatcacgccactgcactccagcctgggtgacagagcgagactccgtctaaaaaaaaaaaaaaagttgaattaacaataaggaaatgaggatgaagcggtaaaaatgttttgggttacattatactctcagaagctatgtggtttagagaaaagggcccccaaccacaaaagttagtggttcttattctgtctgcttcgtactaggtatatggtaactgagaaagtcacttaacctctctgaaccttaacttcgtcatctataaagtgaatctaacattttccccccggcctacctcacagggttgttgtgaggatcaaatgaaataatgtacatgaaaagacatatataaaatgtataatacagacaaagggtcctgttacacagttggaagtcattccctcagattttgggcctaggaaggtaggtgatttaaactcactgaaagcatgtaccatgtccaggttggatacatggcaacaaggctatgttaaattttttttctctgagttgagtccctaaaatactatcatgggctaattctaagaaggagcacgaatatatattcccctaaaattatagcttagcattgtcaatgctttagagcagttatgggagttatagattataacatattagtgatttgtgaaacttttttactaaaatgtgaccctcatttttctttacatgaaagaacatagaatatttcacaatgcatcccacgtggtaagaataaaaaattgttttagttatatgta

SEQ ID NO: 582071 - DNA, 1027 bp, Homo sapiens
  misc_feature (55)..(55): n is a, c, g, or t
  misc_feature (59)..(59): n is a, c, g, or t
  misc_feature (67)..(67): n is a, c, g, or t
  misc_feature (71)..(71): n is a, c, g, or t
  misc_feature (78)..(78): n is a, c, g, or t
  misc_feature (90)..(90): n is a, c, g, or t
  misc_feature (92)..(92): n is a, c, g, or t
  misc_feature (96)..(96): n is a, c, g, or t
  misc_feature (112)..(113): n is a, c, g, or t
  misc_feature (115)..(115): n is a, c, g, or t
  misc_feature (120)..(120): n is a, c, g, or t
  misc_feature (124)..(124): n is a, c, g, or t
  misc_feature (132)..(132): n is a, c, g, or t
  misc_feature (134)..(135): n is a, c, g, or t
  misc_feature (139)..(139): n is a, c, g, or t
caaggatgggagatcatgaccatccggctaacactaaaaatacaaaaattagccnggcntggtggcnggcncctgtantcccagctactngngagnctgaggcaggagaatnncntgaanccangaggcggngnntgcngtgagccgagatcacgccactgcactccagcctgggtgacagagcgagactccgtctaaaaaaaaaaaaaaagttgaattaacaataaggaaatgaggatgaagcggtaaaaatgttttgggttacattatactctcagaagctatgtggtttagagaaaagggcccccaaccacaaaagttagtggttcttattctgtctgcttcgtactaggtatatggtaactgagaaagtcacttaacctctctgaaccttaacttcgtcatctataaagtgaatctaacattttccccccggcctacctcacagggttgttgtgaggatcaaatgaaataatgtacatgaaaagacatatataaaatgtataatacagacaaagggtcctgttacacagttggaagtcattccctcagattttgggcctaggaaggtaggtgatttaaactcactgaaagcatgtaccatgtccaggttggatacatggcaacaaggctatgttaaattttttttctctgagttgagtccctaaaatactatcatgggctaattctaagaaggagcacgaatatatattcccctaaaattatagcttagcattgtcaatgctttagagcagttatgggagttatagattataacatattagtgatttgtgaaacttttttactaaaatgtgaccctcatttttctttacatgaaagaacatagaatatttcacaatgcatcccacgtggtaagaataaaaaattgttttagttatatgtacaaatgtgtgtgtgtgaacgtgtgtgtacttggtcattaaataaaatgtactttttttttttttttttttttttttttttttttttttttttttttttttttttttttttttttttttttttt

SEQ ID NO: 582072 - DNA, 170 bp, Homo sapiens
cggagtgaagacccaggtctggctctgcacttgcctggccatgtcaccttgaagctgtgacctgactcccttatattgtttcctcagttgtagaccaaaggcaatggttgtctgcccttccttaccttagaatgacaaatgcaagggcattttcaccacagagttggacc

SEQ ID NO: 582073 - DNA, 247 bp, Homo sapiens
tgtcgtcgatagcaatctaagatatataatcccaaaacgttattttctaaaataataaacaaacacctaccaagggtctaattacaggtattctccaagaagtctttgtcatgctgtcagtgtagaagtctaaaaccttaaaagtatagctatcagtttcttttaatatgactataatctaataatgaaattatgggcacctccaaagctgcaatattttgaaagacagattatacctcttataatg

SEQ ID NO: 582074 - DNA, 195 bp, Homo sapiens
tgagacggtgacggtacgagacatgctgtacggcgatgcatcggtccaaccgacgcgggcgcttgccgactcgctgcatcaaagcggcacggtcagtaatctcgtggcccgttttcccggagcttcgccgctcgtcgagagcgaagtggcgactcagaccgatggcttctttcgctgggtctgctcgatctggcc

SEQ ID NO: 582075 - DNA, 228 bp, Homo sapiens
  misc_feature (69)..(69): n is a, c, g, or t
  misc_feature (72)..(72): n is a, c, g, or t
  misc_feature (82)..(82): n is a, c, g, or t
  misc_feature (86)..(86): n is a, c, g, or t
  misc_feature (94)..(94): n is a, c, g, or t
  misc_feature (124)..(124): n is a, c, g, or t
  misc_feature (157)..(157): n is a, c, g, or t
acccacgttatgaaaaacgtcagttttacaacgcctaattgtgtgttttttttttttatatcaattaangtnaaaaatggcntcanctatttanttcatgaggatctttcatattaaaatttanccttaagattcaaccgccaggtgcttttataanggaaacattttttagagacgtctgagctcacttttacatgggggtgcctacggccggtaagtgtagagata

SEQ ID NO: 582076 - DNA, 4574 bp, Homo sapiens
ggaggcaggcaaggtggcagccccttacctcctaggcccacgctgcccctggcctgtgttaggcactggcatcaggagccactggcccagcagagggtggatatgtgggctgcagtctgcgtgcggaggtgccctctgctgtcttttgtttaatagagacagggtcttgcttctgtggcccaggctggagtgcagtggctgttctcaggtgtgatcatagcacactgcagcctggaactcctgggatcaggagaccctcccgcctcagccccccaagactacaggcacatgcgtgcctggctccctctggtttctcagtcagagcctctgcattgagccagtcctctcagcagctcccaggactcagaacgcagaagcaggaaatggagagtttgtcctatttggggcttttctatttaagaagttactgtacaaatgccaatttcttgaaggagagcaaggtagaacgtggtgaaataacccacagatggtctagacagccctctgtcaccctgagctgcagcccgctggctgctgagcgcatcggtgcttgagtccctgcagctctgggtctggttcttcaagttggcaaagctggtctgtccaccaaggccagctcagaacagacacgccgccctccttgtgttctcgtgaccatcactgtggtgcccactgtgccccaagtgggatacgtgaatttaactggaaacatctgagctcagtgactgcatgctgtgatgttgcctctaagtgcgtggtcgtcagtgaggaagccgcacacatgcctgttctgcagggcccagcaggtgggccgccaccagctcagctgattctgacctcagcgtctccatggcagctccacgggtcgttaggcatgaactggagagccaaggcctctgttttagtctttcagttcccaagagtttgggagttggaggtttctttgaatattagaaaacgttattaaggttttctaaaaccaaaagaaaaaccattttgaataggatggaatctaacactcagatatttatatctatgtaataataattattattatttttgagacagggtctcgctctgccagccagactggagtgcattggcgagatcacagctcactgcagccttgaactgtgctgaagcgatcatcctacctcagcctcctgagtagctgggactacaggctcatgccaccacacctggctaattttttattttttgtagagacgagatcacactatgttgcccaggttgctttcgaactcttgaggtcaagcaaccctcccacctcggcctgaaaaagtgctgggattaccggtgtgtgccagcacacccagcactcaaatgtgttttaaccacagcaccttgctgtttccgtggagcctctcactcagtctccattgcttgatgtgtggggttcagtgtatcgacctttctacttttgcatgtttcaaattattcatgataaaatgttcaaaaagcaaagcaggacatgttgctctgagacaagtgggccttggggtgttcgccagacacactgtagagggggtgagcggcagcggcaggccctgtggtgccactgggtgctgggctctgtggttcagcccaaggggtggccggatgattctggagcaggcaggtgcagggccactggggaggagaagacaaatcagggagcctcgcctggatgtagattcccctttaaggtttttggagaaacatgagttaaagattagaattagttattattttactgttttatctatattaccccacctaactttctttttttttttccatttaaattatgtttggttttttaattttttagagacaaggtctcactctgttgccaaggctggagtgcagtggcacgataatggcccattgcaggctcaaactcctgggctcaggtgatcttcctgcctcagcctcccgagtaggtgggaccacaggcatgcgccagccaaccatgggtggcacttcttgtgcccattttcaaattgggttgtttcctgtatagaattttgagagatctttctatattctgggcacaagtcctttgttggatttatggcttataaatatgtattttttttaacttttaatacatattgttttgttcttgaatagagacagcctgtgttgcccgggctgatctttaactcttggccttgagtgatttgcttgcctcagcctcccaaagtgctgggattatacgtatgggcctctgctcctgcccatagacattttcttacaggtctgttgcttgtctttttactttcttaacactgtctttcagagagcagaagttttaattttttttcaatggccagtttacttgagatggagtctcactctgttgcccaggctggagtgcagtggtgcaatcttggctcactgcaacctctgcctcccaggttcaggcgattctcctgcctcagtctcctgagtagctgggatcacaggcatgcaccaccatgcctggctaattttttattttttaaatttttagtagacacagagttttaccatgttggccaggctggtcttgaactcctgacctcaggtgatctgcctgccccggcctcccaaagtgctgggattacaggtgtgaggcactgcacgtggcctaaaagttttaagttttaggattcacatataggcctatgattcatttttagtttttttttttttttttttttttttaggtggcgtctcaccctattgcccaggctggagtgcaatggcgtgatctcggctcactgcaacctccacctcctgggttcaagcaattcttgtgcctcagcctcccgggtagctgggattacagacgtgcaccaccacgccaggctaatttttgtatttttagtagagacggggtttcgccatgttggacaggctggtctcaaactcctgacctcaggtgatcctcccgcctcggcctcccaaagtgctgggattgcaggcatgagccactgtgcccggccttttgagttaatttttgttaaatgtgaggtgtgtttgaggctcgtttttttgcatgtgaatgtccagttgtcccagcaccacgtgttgagaacactcttctctgtacgttgacaaattgccttgcatcttcgtcgaaaatcaggcaactgtatggattctctctaacgctccagctccactcatctgcggcatctgtcatcatctgtcagcagtaccacactgtctttccatggctttacgttgttctttttttttgagacggagtcttgctctattactcaggctggagtaaaatggtgccatgctggctcactgcagcctccacctcccaggttcaagcaattctcgtgcctcagcctcctgagtagctgggattataggcgtgtaccaccacacccgtctaagttttgtattttcagtagagatgcagtttcactgtgttggccaggctggtctcaaactcctggcctgaagtgatccacccgcctcggcctcccaaagtgctgggattacaggcgtgagccaccatgcccagatgctttatagtaagttctggagtcaggtaatgtgagtcttccatctttggtctttttcgatcatgttttggctattttagttcctttgtttttccctgtaaattttagagtcatcttgttgataatattccgtcttccaatccatgaaagcagtacatttctacacttatttagatcttcgattttgttcaccagtattttgtaattctcagcatgtcgattctgtatattctggtattttgttagatttgtaaaagctattttgtttttactgccattgtaatggtacaattttgttcatttcaatttctaactgttcatcgttagcatacagaatatacaattaatttttagatattgaccatgtatcctgtggctttgcttttctatagattctttgggattttctacatagagcatcatgtcttcttcatataggcacttttatttgtaaatctgggttagctttttttgttttcttgacttactacattggtgaagtctctagcatgctgctgaatgaatagaagtggtgagagcagccacccctgctttgttcccataaggggaacatactgccttttactattaagaatgctgggggctgggcgcagtggctcatgcctgtaatcccagcactttgggaggctgaggcgggcagatcattcaatctccttgagttcaggagttcaaaaccagcctggacaatctggcgaaaccccatttccacaaaaaatacaaaaattagctgggtatggtggcacatacctgtggtcccagctactctggaggctgaggcaggaagatcactggagcctgggaggcggaggttgcggtgagccaagatcatgccattatactccagcctgggtgacagaatgagaccctgtcacacacacacaaaaagttgaatgctgggccagcgcagtggctcacacctgtaatcccagcactttgggaggccagggcaggaggatcacttgagcctgggagtttgagaccagcctgggcaacatagcgagaccttatctctacaaaaaaaaaaaa

SEQ ID NO: 582077 - DNA, 1173 bp, Homo sapiens
agctggctgtggacgactcctcagactgaaggtggagctgtttctgaacgaaacaggaggactttgatcagaagtacaatttccgtttcgaggatgccggactcagtcatgtcggttcaagagcctacccacgcagtgattcgcgtcctccgtgtgtcgccgtaaggattgagcgcagaaaacggagtaagagggaagagactcggagagacgaaagaagagggatgaaacgcaaagaagcagcgaacagctcaatgcatgactgaagaatcctgaactaggaagggatgagttctggccaagtctggagaagctgcgcgaaagtaacaggcgaacgagatgctgggcctcgaggtatggggaccttgtatgacgacttcgaccctgccctaggctcgacacagtctcatgcaggaatgtgcttagcgggacgagtacatactcgtggaccgtgtgatgggagtgagaagtccacaattttgaggacagagagaagggcttgaaggacgagtggaactgggacatcgtgggacgggcctgagcaggagggagactggagtccacgcaggagctgcactgtgaggaccccaacttgcaacgatggactgccgattacgacaccagccagccgaggaagaacaaagcgcgatgcccccttgacgggcaagaagaagcgcaagtcgccttcgccgcggccgtggggccaggagaagcgcgtggttgaacccggggacaaagacgttcgaggagtacctgggatgagtattaccggtgtggaactacgaggaccttcatcgacgaactgacctgtcggttcaaggtaccgcatgagtggtgccctgtgactttgggctcagaactgaggagatctcgtgtgctgacgataagggggttgaaccggggtggctccctaaaggagactggatgttcgggtccacacgggaagaacctgggggacaagcggggggtcagcaagagaggccgacgcatgtgaaacggggagggctcaggaccctgcgaagaggagggagaccatggtgagccgagggaacacatagagtgaaccgccaaaaggagtccccttgagggtaggggggagaacccagagagacggtttgctaggacacggggagaagagcagcagagtgcaacacagaggcgtgagacggggac

SEQ ID NO: 582078 - DNA, 132 bp, Homo sapiens
  misc_feature (62)..(62): n is a, c, g, or t
tttgaaatattcaattttatttgatgcagtggttacatgggtgaatacaattgtcaaaactnattaactaggccaggcgtggtgactcacacctgtaatcccagcactctgggaggccaaggtgggcggatc

SEQ ID NO: 582079 - DNA, 277 bp, Homo sapiens
tcccgtgaggacataaaacattcttccccgtggtgtgtgtagaggaactctgtgtctgtgtgatgaggggcatgtgtgctctcagcacccacctcctgtgcccagagagccctgtcctgtgcagggtggttatcgcagtggcagggttcaattcgagaagaccttgagggccgcgctgatgttccctgaatgcgcccctggtcgttgcttgtccctgactctccatttccccatctgagtggatttggacctaatagggcactggagccggttcgaa

SEQ ID NO: 582080 - DNA, 334 bp, Homo sapiens
gctctagaggacccctggcaggctctctactcaactttttccctacatacccaggggggcttaatccctcctatctttctgggcctctaaccaaaggtctcctctgggggacttcctcggtctaccctattttaatagcatccccctaaaccagcattcttcccggctatttttttctaactttggtcaccatctgacaaaccatataaggtagctataatggatggtgggtctttctcctagaaagtaaacttgcggagggcaagaatatcttccagttgggtaaactacggtatggacggctgggtaggtagagagccgggcaagggtaccg

SEQ ID NO: 582081 - DNA, 398 bp, Homo sapiens
ctgcatggctgactccggtcaataagaatcgatagctggaaggtgtctgtgtaccaggctaaggcggctgcgagtagcgagatgccgacattttccccgaaggaatcttccggtgcctttcacccaagtacgggcaggagtttcctgaataacagcaaaaggtttccgttagccccgcagggcgagcaattccgattccctccgggccttccccggatcatgctcagccctgtgtccggcaggggctcctcgatcccatgggccgccagcgcccgagggccgaggcctggacacggaaggccgtggcgccggctatctcgaggtcccatggcgccaccttcggctccgctaccctgcagcagggaccaggaaaggccagacccagtcggaaaaggggc

SEQ ID NO: 582082 - DNA, 352 bp, Homo sapiens
taggatgcttgtgggtattctctgggtggacacttagaatttactgtattgtctgggtgtgctggctcatgcttgtaatcctagaacttgggaggccgaggcaggaagatcgattgagcctcggcaggtcgagatcagcctgggaaacacagggaggcccccatcgctacaacaaatattttacaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaacaaaaaaacaaagg

SEQ ID NO: 582083 - DNA, 473 bp, Homo sapiens
gaggaagccgaggtctgaattgcgcgttgtggccatggcggccagcggggctgtggaaccaggcccccgggggctgcctgtcgccccgtctgcccgccccggccccgacgcctgcccctgatcacctgttccggtccatcacgcgccgaggacgaggagcagcaagcaccaccgacatctgagtctgctatgcatgaactgttcactgcacatggcactgacgcgcctcctgctcaccaatgattcccttcttcacgcgaaactaatacgtgagctcctttctcctgcgcagccactgtgcgctggaacacacacggcagcatccagtcggccacgcaggatccaggaccacgcacgtgcgctacacttcgctctgctcagggcctctggcaggacactgaaccagcagcaagctggtgaacgcactgcactcttgctcgccccacggattcctgaccctacatcccgcacac

SEQ ID NO: 582084 - DNA, 1128 bp, Homo sapiens
cattcgccagcagtgtcctatggaaactatcaccaccgtacaagaatgatggatgtcactgtgactatcaagtcttccatcgacagatgaacccgaccttggtcttaggccctctgaagtctgtgcaggacgctgacggagggacgcagcagctggctagagactcgaggcccgcaggcagcgagacgggcatgcacagaacgtgcaactgagagaagtgccgacgcacaacgaatgaccaatgcctctcctgtgcatggagaatggtacgactgacgttagcacagggccccgttctctgtaatgattgtctccttacttgggctgcaggctctaggacgcagcacaagatccacttggttacaccggctcagtctaacagagctcgctctgtgtaatccgcccattcaattggaaggccgtatgtcagtgggccgcacagcctggcccaggggaaaggctgactcggagatccgatggagacaggccaggccgtgatactatcagcaaggccagcatccacgcccggagttggaacggagtcgcacgattggtcatcaggtgcacaacgggggcaagttcaccagctgattcacagtccttatactgatgacaaacggtgcctaacaggtggtcgggaccccttgccacacgtgaccctggaagctacacgagtgaccctacacacgaacacgaagcggcaaatggggccatggacctgccgggcagagacagggcacaccactccggagtacccttccacggcccctagtgcccctgtgcaagacgataaagcgcctggcgcatacaagcagctcgaagcgaatgagcccacgcacacaccgggaagaagacccccctaaaaccccctcaaagcagcgagtgcccccagtgcaagagccccaaccccgtggagcgccgggcagaacaagggcagacaagcgacgtcacaaagcagaagagacccgaggacgaacgatagcccgcacaaaccgcgagcagaagaggcaccaccagggtagcacccactcacgagacgtccagggggcgaccaccgcaaactaagagcacacacaacaggagcaacaacccgccccacacagacagagacaacggaccacccacaag

SEQ ID NO: 582085 - DNA, 578 bp, Homo sapiens
  misc_feature (113)..(113): n is a, c, g, or t
  misc_feature (271)..(271): n is a, c, g, or t
  misc_feature (425)..(425): n is a, c, g, or t
  misc_feature (524)..(524): n is a, c, g, or t
tatgttaaacaaccaaacttaaggataatcaatgttcctgaggaagaagagaattctaaaagcctggaaaacatatttgggggaataattgaggaaacttcccctggccttgntagagacctagacatccaaatacaagaagcacaaagatcacccaggaaattcatcaccaaaagatcttcacctaggtacactgtcatcaggttatccaaaggaaaccattttaagagctgtgagacagaagcaccaggtaacttacaaaggaaaaatntatcagattaacagcagatttctcagcagaaaccctacaagctaagacagaattggggccctattttcagccccctcaaacaaaacaattatcagccaagaattttgtatacagcgaaactaagcatcatatttgaaggaaagatacagtcatnttcagacaaacaaatgccaagacaattcacaccaagccaccactacaagaactgataaaaggagctctaaatattgaaacaaatcctggaaaacagagnttctttaaagcataaatcacgtgggacctattaaaaaacacacacacacaagtt

SEQ ID NO: 582086 - DNA, 134 bp, Homo sapiens
gggctcactcaggccagcacattaacaagatagaaccctcattcacactgagaaaacaccctcatgttcatacaccttatcccccattctcctcctatccctcaaccccgacatcatcaccgggttttcctctt

SEQ ID NO: 582087 - DNA, 226 bp, Homo sapiens
ggggaatttttttggttttggcccccaattttgtttttccccagtttggaagggcccaacctttttggccccccttttccaaaggaaatttgggatcccgccaatttttttcctttttgggtaatttaaggggggggggcccccttgggccttgatccttaagaaaggggcccgttttttttggttttggttttaaaccttgtaaaaaaaacttttttttccccca

SEQ ID NO: 582088 - DNA, 897 bp, Homo sapiens
gagacctggctgctgtgtcccgcggcttgcgctccgtagtggactccgcggtgccttcggcagatgcaggcctggggtagtctccttttctggactggccaagcagaagacatggtgaagcccctcgttcccattagtgccctttgctgttggtgtggcttcggctatcacgatgttactggtggtttctggtgggattcgttggctatgtacaatcgggcagcgtgccgtccctggcttgcagggctgcgtcttcggccgtctagccggcctgggtgcttaccaggctgtatcgggatccagggagcgtttggggcttacctagccgctacatctgttactttgttgtaggttgtagtgggaatgagatcctacgactatggggagatttcagtgcccgtgaggtttacctggcgggtgccagtttgctgatggccgcaaagctaggagtcgaatgtgatgacatcttgattagcagaagtcatgtaccagcttgtgactcgtgacaggattgtacatctgcatctttccactattttcccctggtattacgagcaactaaagtgcagcatttcggatctgacatgtttacctgaaataagaaatacggccatccacgcttgtgggggtcgtgcgtctgcaaaatctgtgtgtttccaatttttatccctacgaagggggtggggcatgtacgctgacctttgtggagaccatgcgacacctcgcacctggtaaggattggactcgcttctgacgcaggggacacttcacggccaatgggggggtgccctgatagcttgagagcattccggtccgacatgtgaaccactctgcacatgcaaactttgacgtaaccaacgcggaattcgagtcacaaaacagaatggggcgcggaaa

SEQ ID NO: 582089 - DNA, 225 bp, Homo sapiens
ggagacagtgatcaccaggagacaggatcacagggagccagcatcactgagagggacgctccgacgaggcagagacggtgacaccagcggccatgcccaacacagatgccggagtgcgacacgggcagatgtgtcctcatcaaacgagcagtgcgactccttccccgagtgtatcgacggctccgacgagctcatgtgtgaagtcaccaagccgaccgcagacga

SEQ ID NO: 582090 - DNA, 157 bp, Homo sapiens
acagagattgggagtgatttagtacacagcacgcccaatacccaacaagcagcctcagagagactgagagaagggggagaggggactggaagccatctcctcgtgttctgcaagggcaggtgctccttcccaagaacacgcactcagtagacgccaa

SEQ ID NO: 582091 - DNA, 97 bp, Homo sapiens
gaccgccgcagacacggctgtctattattgtacgagagaatatagcggcccgtccctctgggactggggcccgggaaccctggtcaccgtctcctca

SEQ ID NO: 582092 - DNA, 582 bp, Homo sapiens
ttctgccagatatcctaatctctctctgaagtataaggttccacagatctctagggcagggcaaaaatgctgccagtctcttggctaaagtatagcgagagtgacattcgttccagttcccaataagttcttcatctccatctgagaccacctcagcctggactacattgtccatatccgtatcagcatttcggtcaaaagcattcaacaagtctcttggaagttccaaacttttcctcatcttcctgccttctgagccctccaaactgttccaacctctgcctgttactcatttccaaagtggcttccacattttcagattatctttgcagcagtaccccactctgctggtaccagttctctgtattagtccatgttcacactgctataaagatactacctgagactggtaatttatacagaaaggagttttaattgactcacagttctacatggctggggaagcctcaggaaacttagaattatggcagaaggggaagcaggcatcttcctcacaaaggtggtaggagagagagagctcatgcgaaactgtcacttttaaactatcagatctcctaagaa

SEQ ID NO: 582093 - DNA, 269 bp, Homo sapiens
ttcattgtagtgagcatctctgcgatagacaataatctgtggtcacacgcgggagtggcggtgcgcgcggggcaaccgcgtggagctgtcgggagggcgataggatgggcgcgcccgggctgcaggctggggagccggaggtgggaggtgcctcttgagagtggctctccaccgctgacagcaaacgagctggtccggacggaggacagagggggaagaaacggagggagtcgctgggggacggcgacgagtgggatccgggcggatgg

SEQ ID NO: 582094 - DNA, 576 bp, Homo sapiens
tcgcgacgtgttatccatgactgagtttagaagtgtgtctataaactccttgaaattgtacgaaaaatgttagagtgtgtatttatttttatcaagaaaggatccatggcttcagtcagattcttataagggtctgtgactccaagaagggtgagaaccactgagtcaacaggtgcttgcacagcatcaaaaagtagcaatagcagaagctaaagttgggtaagactcagaaaatgttttcctaagtcccctgtagaggagtaagagagaagatgctgggggctgatcatggcaagggcttatagctctaaaggacctactccagggaatatggttcaatcgcatataaatcaggagaacttgttcccagtaaccacagggcccctttatattagattctgttaatgatttaatatgctacctctctggggtggcggggaggtgagtgcctaaacccagaggaatgaattcacagtgactgggcctggaggtctcttgaagacttgacaaaatgaggtagaggtggacatgggggggctcctggtcctgtacatgtcaggctgcttgtctgtgtgg

SEQ ID NO: 582095 - DNA, 913 bp, Homo sapiens
aggccggcgagttgcctcacggctgtaatcccagcagttgggaaggctgaggcgggcagatcacgaggtcaggcgatcgagaccctatcttggtaacgcgatgaacacccccgtcctctactaacatagatacaaagcagttatatttagccagtgtctgtgcgtgcgcggtcgcatggttgctccctaggcttactttggagagggcttcgtggcagagaagaaagtcggcctggaacctggggaagcgcgcgatcttttgccatgtggctccgaggattctgttgccacttgagacagccaagtccttgcggcggagacgagaaggtgagatttcttgtctcagtaaactttaggtgacaaattcaaccactgacgggatctgagagagactttttttatggcctaactcgttttgcccaaccgaaaaagcctgtttcccaagaaacccgtttgaatacgcttgagccagggtgagtgctcccaaagattactttaaaaatgcggctccgcgacaaaatgcaggggtatcctccagtggaaccacttacgtggcccgaagagcattgacggggcgggattaccctttgccccgctaagaaattatgcccgggggggcgaaaacccacggatcgatatgtttgccaagaacccttcctcgaaaagttggaccggttcgcaggggcactcacgaggtggtgcgaacccaaccctggggcagtttcccaggaaccaagcgcggtacatgctgtgttaccccccgccgtcgtccgcttctgggtagaattgcgccggtttatttgcccgagattcccagcgcaaattttggaaatgctgttgaaaattccttgtgccaaagaccgagtgaaatttcctgcacagtggaaacttgaaatgaaacctaattgtacaa

SEQ ID NO: 582096 - DNA, 114 bp, Homo sapiens
ctctagaggatctcatgtaatcagccaacacggagaacagtgttcttactaaaaatacaaaataagccgggtgtggtggggccagactgtaatctcagctactcaggaggctgg

SEQ ID NO: 582097 - DNA, 888 bp, Homo sapiens
ccacggaggcccgcctcgtttggcccccgggaattcgccctttggtccggggcagaagtagcctctccagaggtggaacagccggcaacaagaaaaagcaaccaacaaggtaaccacataaaagctgcgggggcggtgtttttggattctcttacgcaacacactaacatctatatccccacgcacccattacccatcccgccgctccctgaccactgtaagtgaagcccgggacttgtccacacacacaacaatcgcatcctcaacaacccccaacaccaatatcaatacggacccgattatctctacttgtccactatctaataggtataatttaataatatcaatcacccaacctaatgtgtcaagtctgagaggtgacgtaatatctatatgtgatctgttggttgtggtttttttttatgttctccactccctaaatatcaaacaataaaccggcagcgtgatgactatagtacgtcatactacaagtacctctcgtacaataatattttgtaatgtcaataagtactcacacacgttaacgaatgtaaactgtaaggcccctctctctactgcttcgcctccatcgtatacttctcttctttctaccggtaacacacgcgtctgtctccgtctagtcgcgtagggttgcgaattctatattatcctttcttctcgtttctttaatctgcgtatttctttcgcacctctttgcgcttctctttgttgtaatgggtgatcgttcacgaaaggaggacggcttgactaatatgcactcacattggggttatggcaacagcgcccaagagaggaccccgcgcagcttagcaacgggtcgagaagctgccgcccaccccaatatactaaggacggtactccagcaac

SEQ ID NO: 582098 - DNA, 230 bp, Homo sapiens
gaagggggtcaccggcgtcgagaagggcatcgccaatactgtcgaacatcaacgtcggcttcctgtgcctgctgctgcttgttcgtgtttttgtgccgggacgacgctgaacctgctgaacggcatgttgcagaacctcggcgattatctcacctcgctggtcagccgcagcttcgatatgtatctgtacggcaaggctcgccaatggcagggtgcctggacgctgttct

SEQ ID NO: 582099 - DNA, 946 bp, Homo sapiens
tctgcgtgcccagcctctcctcacgctcgcgcaggctccgccgagtctcagctgcagctgcagggagtgagccgtgcacccggaggagatcccggtgatgatgcgaccaacttcggacagtgcctgacgacccaaacactcagccactgttggtagcctgcaagcatggcccagctgttcctgcccctgctgccagccctgtgtcctggcccaggctcctgctgctttcgggccgctgtcctggatggagacagctcagaggaccgcgcttttctgcgtgcgcatctgcgggcgacgcagcacactgcagggcgtgcttcgcgtggcgcccgtcaccgatcccttgctcaggtccactacctgtcggtcacccgccgagccgtcggggtgtgctgggctctccgacggtgctcatacgtggcacatttctcgtgtgccgcggaccgggacggagaggttgctgggtggctgcggggagtgggcgctccagtgtgaacagaggcctatcggttccgcgtggtactgacctgcgtacccagtgtcgtcaccgacgttctcgctggcgctgagcgagctgctcgccaaggattcaggtatctatcgctgtgagggtccacaacggatcgaatgacatgcaagctgacgctggtggagcgtcacaggtcatgaggcggtccgtcttactctagccgaaaaggggctctgcccgcagttgcattcataccttttactttgggaccagacggcctgtgcccgcagtaggaagccacattcagcacccccgtaaggagtctatccagcctaccttgaggctaaagacaaaaggtaatgtggtggatggccaaagaaccgtaaggatcccgtccaacccaaaaagcgcgtaagcagacgtgtggaacagagacgagaaagagtgtgcgcgtagacaagaggtagaactaacaaa

SEQ ID NO: 582100 - DNA, 522 bp, Homo sapiens
aataaaagaagagtccgatctgtagcctaggctggagtgcagtggcaacgatctcgactcactgcaacctccgcctcacaggttcaagcgattctcctgcctcagcctcccaagtagctgggattacaggcacccgccatcacacttggctaattttcgtatttttagtagagacggggtttcaaccatgttggacaggcagtctcgaactcttgacctcaggtgattagcccacctcggactcccaaagtgctgagattacaggcgtgagccactgcacccagctggactctggtaaattctttacacagggtgttttatttaatcctcaataaccatttattcagtgaggattattcattccatttatccagttgaagaataggaatcaggttggaagagatgaagtaacttacctcaagttacatagttgttggtgacaaagttgggatttgaatctacgtcttccaaatccagagccctgatgctctagtctgtaatctattgcttatatactatagt

SEQ ID NO: 582101 - DNA, 293 bp, Homo sapiens
aatagattacccagaaaacatggaatagtctgcataaaaatcgcatgactgctaatcaagttcagcagagtcagcccggctgtgctcctgccagtctgttcctccctcatgggagtcacacaaaatgaaaatctcctagaaagaggaattcctctgatcctctgagattcttcactatagtacgctgtcgaccttcccatgatagttcaacatacctcaagctcgaacgcgtcactggactgtatggtggtctataaattggaatcggcttaactatctcttcactgacaacg

SEQ ID NO: 582102 - DNA, 118 bp, Homo sapiens
tttcacagcacactctgctatttttattaccaggactttttaataatcaaactataacaatatactagctcagaacatctagaatagtatctgtggttgtcactcttcattgcaataa

SEQ ID NO: 582103 - DNA, 222 bp, Homo sapiens
  misc_feature (80)..(80): n is a, c, g, or t
  misc_feature (83)..(83): n is a, c, g, or t
  misc_feature (108)..(108): n is a, c, g, or t
ctctctgtgtgtctagatccccgcgctagcggcatagtgacggaccctgctggatggtgcctcctggggacacttgggcnggngcaatgccctggatggccttgtccnctggatccacccagcaagggaccagatagacagataatgtcagagcaccagaaggtactcctgctctgaaagttctttctccaggatgaaggcgttcacttaatgccgctagcg

SEQ ID NO: 582104 - DNA, 612 bp, Homo sapiens
  misc_feature (12)..(12): n is a, c, g, or t
  misc_feature (470)..(470): n is a, c, g, or t
  misc_feature (493)..(493): n is a, c, g, or t
aaaggaactcgncaaacaagaaccccgcctgtttaccaaaaacatcacctctagcattacaagtattagaggcactgctgcccagtgactaaagtttaacggccgcggtatcctgaccgtgcaaaggtagcataatcacttgttccttaattagggactagcatgaacggctaaacgagggtccaactgtctcttatctttaatcagtgaaattgacctttcagtgaagaggctgaaatataataataagacgagaagaccctatggagcttaaattatataacttatctatttaatttattaaacctaatggcccaaaaactatagtataagtttgaaatttcggttggggtgacctcggagaataaaaaatcctccgaatgattataacctagacttacaagtcaaagtaaaatcaacatatcttattgacccagatatattttgatcaacggaccaagttaccctanggataacagcgcaatcctatttnagagttcatatcgacaattagggtttacgacctcgatgttggatcaggacatcccaatggtgtagaagctattaatggttcgtttgttcaacgattaaagtcctaacacatgtcgacgc

SEQ ID NO: 582105 - DNA, 273 bp, Homo sapiens
ttcccccgggaaccccttttcccccttggccccttttgggggcccctttaaaccagttttgtccaaaaaacgggggggggcccggccgggatttcccgggattttttgccccccccggccccccccctttaagggtttttaatttttttctttttgggcccgggggggttttttaaacccccctttttttttttggtttaaagttttccccctttttttttttaaaaaggcccccccccccccccccccgttttttaaggtttttttttttta

SEQ ID NO: 582106 - DNA, 114 bp, Homo sapiens
tgctgtcaaactaccgcgtgacttcaccttctacccacgccgtacgccgctgcagcacgaggcaggcctctagatggaccagctctgcaccggctagcatgaagacccccttcc

SEQ ID NO: 582107 - DNA, 530 bp, Homo sapiens
  misc_feature (10)..(10): n is a, c, g, or t
tcgaccggantggagatgaaaatgccagccctgctagatccaggcgggatggagtgtggggtgtgggcacagtggcttgtacaggcctgggctgggcagacttgccccggagtctcaggccactgcggaaggaggacgcgtggccagcaggtgccaccaggagaggagaggagggccaggctgagctgcatctctggactccaaggagagcttggagaggtgactgaaaccctgccccacccccagcctgtctccatctgtgggtccttgggcaaattgcctcatctctctgagcctcgaatgcgtagctttcaggactaactagggtactgtgtaccaactgcctctgccaacgcccctgcactgggcagccctgggtacctggcttgggggaggagtaggcctgggaggagactgatgctacatttctctttatctatccctgtattgtttaatttgttccaagtgcttgagttactttggcaaatagaaacaattctaataaagagaactaagaccttaaaaaaaaa

SEQ ID NO: 582108 - DNA, 154 bp, Homo sapiens
caggaaacagctatgaccaggaaacagctatgaccaggaaacagctatgaccaggaaacagctatgaccaggaaacagctatgaccaggaaacagctatgaccaggaaacagctatgaccaggaaacagctatgaccaggaaacagctagtgac

SEQ ID NO: 582109 - DNA, 274 bp, Homo sapiens
cccgaggcacatactataagatagggcactggtatcacaagttcgtttggttaaaaaaaaaaaacaaaagggggggcggggggcaaagaagaagttgaactgggatgatttccatgcccatccagctgtaacattctatgacggtgacccagccttggttctcttttctcactctcctactagacttttcaatgaaaagtaaggcaggaaaaaggaaaggaatcccaagtggcggccagctctgatgagagatcaggtgggggtaccgagctcg

SEQ ID NO: 582110 - DNA, 381 bp, Homo sapiens
aaggatctcaggattgtgtggtgttatggtcttgttacaattattattcctagctaatatgaccgtatcgtgtccataccacgtcggtgaccatatatcaagcaagtgaacgtttatttagaaatcaagtgatgactagcatacggcagactgggtagacgtaccaccattctcggtcatcggtcacctctcgatgtaggtgataacgcccacgataatgtgcactcccaggaaatggtcatcggaagcctctcgattctgaaaatgcggttatccaagaacaagtcaagtatcacgttatgagtatcatgtcacgagaatcaagtatcaagtcaaggtagcatctgcagtccagccggccatacataacaccacacaatt

SEQ ID NO: 582111 - DNA, 601 bp, Homo sapiens
atggcacagttccacaatctcttctcctgctgatggccttcatgttgttaaattttgacatacagcaagtgtagggaaggaagcgttcgtagttatgacttgtccattcggggttcttcgtcataggaatgctagaggaaacagaacactgccttacagtcacctcatgttgcagaccatgttgatggtaatacacactttccaaaatgagccttacaaatagtaaaggggatactataacatgtgctacagttcatttgagacttcctcagtttaaaaagtgggttcttacatagtcttctgtctccctgatatgactacactcaaggggctaggacttcgctatctctgagatgtactgctacttgctgcaaattctgcagctgtctgctgtctctaaagagtatcagtgcactagagggacgtgttccctttacacgatacacgaaccgactgtcctggactggagaactctcacaagcggaacagagatctttctaaatccctgctactgtcccttctcacaggcatgcacagaagccttctgattcgtaagggttacgaaactcatgtacttactccagtaccctgtggatctctg

SEQ ID NO: 582112 - DNA, 169 bp, Homo sapiens
gaggtaagtaaagggtttgctgctgaaatttgggggaaattaacccgagtaggtttgttccctgccttgcgagtcgcgcccttctgggaacggatttttaaaaggagcatgtctggagggctttggtccaaggccatttttgttggctataagcggggtctccggacca

SEQ ID NO: 582113 - DNA, 726 bp, Homo sapiens
gctggccggtgaggccgcggcattggtgcgatgtgcagctcttcgagatcagcctgagccacggtcgcgtcgtctacagccccggtgagccgttggctggtgaccgtgcgctgtgcgcctgggggcaccgctgccgttctcggagccatccggtgtgactctgcataggttcctgcggggtctccaacaaggctaatgacacagcgtgggtagtggaggaaggttacttcaagcagttccctgtcgctggcgataacaaggtggagcctgccctgctggtagagcaacgagcttcccacttccatggttccgtgcttcctgccacgtgacacccacgatcctattgagggtcctttcgggaagatcgctgcaccaggtgagggccgcatcaatacgccaaagggttttccaaggatcacaagtgcaggcctcgtgttctatatcttgagccccttgaacctgaacagacagtcccagacagttgagcaacccaacgtggccctctgagcaaccaagaagttctcctacaagcgtggtgaacgacgggcagcgtgtgtcctcacagtccagcactgatctcctgcggctatgtggtggggcaggcactgcaagctgcatgccgacgttgagaaccagtcaggcaaggacaaccagccctgtgggtggccagtctgctgcaagaaagtgtcctataaggccaagcgctggatccacgacgtacgggac

SEQ ID NO: 582114 - DNA, 987 bp, Homo sapiens
  misc_feature (987)..(987): n is a, c, g, or t
agtcgcgagcgactcccaagagggtgtcgactgtagagccgagcgaagagatgcctaaatcacaggaactttggtcttcaagctcttctggcagtgattcctgaacaagtgaggttgacaaacaagttaaagaggaacaaagcaatgttgtccagaaaaaagcgtgtaaagaaacaagagacaggtgagaattcgagagccccgtgtcgatcattctaaacagagcagcagcaggagagaatggttaaacctgtttcagaattgggaaaaatgagggtagggttagagtgtaccggggaatttaaaaagggccagggtgataagttgatattagaggatatggggagtggatccttgcaagggttgaagactgaatcagcccaggaaggacaaaggggttattggctattaaaatccaagaaacacagtggcagccagcttgaaaggacagcaggatttatgacatgggagtgaatgcagtaagaagacacgtgtaaaaattcgaggggcacatataagattaaaaactgtaagtgatacataagtttgtgtaatactgatatttttaagagtgggatgacggggttacacaatggtgtccaagcataatgtatgttggaattgagacaacacactttggtaggaatgaaattacttgtttcaagtgtggcatcatgcacaaaccaatggagatgaagctcaatgggcaagcgtacatccaggactacgatggtctgacaccccaacccaagggtaaacaacaactcacagacacaacgacctccacaacaaacacagacgacaagacaacactggttgacgacggccccagaagcgactctaacacaaccagtggagggcgaccccaaagaaggaacaagggtagaggaccaagccaccggaacacaaggcgatccacacaaaaaccggggcggcgtgctcaccgagcagaacaagaacaagagcgagcgcaacaacccgggggan

SEQ ID NO: 582115 - DNA, 312 bp, Homo sapiens
  misc_feature (48)..(48): n is a, c, g, or t
  misc_feature (69)..(69): n is a, c, g, or t
  misc_feature (77)..(77): n is a, c, g, or t
  misc_feature (118)..(118): n is a, c, g, or t
  misc_feature (132)..(132): n is a, c, g, or t
  misc_feature (178)..(178): n is a, c, g, or t
  misc_feature (180)..(180): n is a, c, g, or t
  misc_feature (198)..(198): n is a, c, g, or t
  misc_feature (213)..(213): n is a, c, g, or t
  misc_feature (225)..(225): n is a, c, g, or t
  misc_feature (231)..(231): n is a, c, g, or t
  misc_feature (267)..(267): n is a, c, g, or t
acgagggctcatcattcaaaataaaacaaaataaaaaagtattaaggngaagattaaaaaaattttgcnttacttantttacacgaaagcaatgctatcacctcccctgggtgggctnggggggggggtggnccattctccttggggggggggggggggggttttggggtggcaaggnanttcctgtaacaacgcatntcatttttggcatgnctattaaaaaanccccantgtgcaatcaaagtcctcggccactttgtgaacttnggggggtgctcgctccaaccggctgctgtcaccttccccgttcca

SEQ ID NO: 582116 - DNA, 275 bp, Homo sapiens
tagtaaagtgcaggttaaaatacacgtaagcgcaaagcctttgcaactaacttttcaaattaatgatcagttaaaagagctaattaagagagctggaaaggatgcagggagatgccatcaaggtacattgtgcttggagtgtaaattggtacaccctctcgctcagggctatttgcagtataaatgcatacatttcggcctgacgcgggggctcacgcctgtaatcccagcactttggagggccgaggtgggcggatcacaaggtcaagagattg

SEQ ID NO: 582117 - DNA, 1314 bp, Homo sapiens
  misc_feature (1160)..(1160): n is a, c, g, or t
  misc_feature (1314)..(1314): n is a, c, g, or t
ggcaaaacaccatagatgtgctggatgaacgccggttgcagctggggctggcctcaggtgggtccctggtggcacctgagttatggggaaccgcgtgtggattccgcggaggtttcgtcagaaggcatcctggaggccggggtcgcggccgtggtcgggtgccgtgtgggcctctgcctgcggcagctcgcgtattgccggccggcaggatacggacgtggcttgtcctgtcaccgagtctgggcctggtttggtcacaggacatgaagatccatgtccctgtccgtgtagatctatctcttctccctgccatattatgcgaatcaggaggatcccttgatttcttcctggcgcggcccgtctctcaacggatgaggtattgtgaacgatatactgcgcagtgcgagaaagcgataccctggtgccggccagcttgcaccatgtctcacagggacattttgctttgccgtatccgcggtgagcgtaacaagtgggccacctgatcggatcctagtggctgttcacagattgcttccctatgggaacatgtgttggcagcactgaaccatatcgggttggggaagccgagtcaataccctgaggtccataggacttcttcccattcaggtcccgcccagtagcaggcaagaagagcctaacttagggggtgggaaaccaaaggaatccgggcaaaggccccgccgagtacctagtgtcccccctttttagagacaagtgttggacacaagaggccctggtgttgcagggcttcttaggttagcttgggttaacatgcccctcaaatacacccttgacagccccccaagggtgagccaccttgtgggcactcaggttcgttcccggttcaaccccttgatggtccctttaagaagtaaaatgccgttgacttccatttgcactgggggcgtggggattaattctggatttgtaaacgttggcgttaaccagacgtcgttcgcaagcccccggggtgggtccttgtacaccttgtcacgaacgacgccttggtggtacaaaaacacttatacgggacacaaaatggaggaccgtaagcccgttattggcaagttggcccaagattttttgcttaaaggaacccctttacgatgatataagccgttggaaaccccgccgacggnaacccttccgttgagagaaagggaagaaccgttggataaatttgcagccaccagacgcggagtatcattacctcattaattacgaaggggaagggttttaccaccgttgtgaacgcccaaacagcagtctgattacgataggaagaacacgcan

SEQ ID NO: 582118 - DNA, 1495 bp, Homo sapiens
  misc_feature (134)..(134): n is a, c, g, or t
  misc_feature (526)..(526): n is a, c, g, or t
  misc_feature (535)..(535): n is a, c, g, or t
  misc_feature (583)..(583): n is a, c, g, or t
  misc_feature (1495)..(1495): n is a, c, g, or t
ggtctgggcgcacagagctctcagggccggtcgccgagtgcacagggctgtccgcgacctacgccatcagctccaacactgggcaaaaatctcacgagacgcgcgtacagcatgactgaaggcgggtgcagtcnaaggctccctggaattgctgatctatccatggaagctactgcgtggagacacggagtgggttagtatacatacacttgcgtcatccagaggaacgagtagggttgccttagaagacgtgtcatggaatactacctagggaaacattaggcgtcgtcgcgttcgaccagaaaggagagcctacggaaatgggcaccacgccttggcttgatcgcgtttgaaccctgccaatggcagtcgaaagtagagaattcgtggagcaacccaaaagctaagctagtaatagtggtcaaaagcatgaggcatatatcctcagagcaagaatatttcctttgcacatcctagcaaattagggttggggacctctcaggccaatatattgagcggtttcgcncagaatagnacttctcccctttgtctccctcaaaggacgggccttcgatacacaganttcccctctcaaaggaaaaggcccggggaacgccgtcgaaagcggaaagccacagcgtttttgggacacctcatttgggggcgcgttgtggcggaagaaaaacggcacaaaacgcaacgctcatgtgttccccctttgtcacccaaggtccctttgtttgtccttgggtgcacattgccgagttacatgcacagaaccaaggcccccgacgccgctcaggttccccccccgtgggaaggcaaaccaatctttaaaatccgccaagcgccctttccaagttgccccaaggggggccccacgctagcacccgtggggcggcaagaagttaaagggattaaaaggttaaaaaaacgggccacagaagtgtggtttccaagccttttgtttttttttcaaaagaaaacgcgagaagtagaccacatgacgaggagtcacaagcacaacaggacgatacacagcaaacggacaagcacaaaagaagacaaacagaaacacccggggagggcaagcgatactcacaccaaaagcgcgacggcgacgagggtgcagacgcggcggaacacaacaaaacaggggcgatgagagaccagtcaacccaacacacgaagcgggggcacaccacgacacagggggcgtgcccagaacaacaaaacacaggaaggtgggtagtgcactcccgcaggggtacagcccccagcggcgaaaatgtgataagtggcggagggaacaaccaacgagcgcggcggggggacaaccataagcgaagctgccagcaagcggggctagacccgccacccgtaacatgtaggggagcaaagggaaccgaccagaatagaacacacacaatggaccccgcgacaaacgatcaggcgccacgcgggcataatagcaccccgcgcggaataacacacn

SEQ ID NO: 582119 - DNA, 486 bp, Homo sapiens
  misc_feature (148)..(148): n is a, c, g, or t
  misc_feature (281)..(281): n is a, c, g, or t
  misc_feature (387)..(387): n is a, c, g, or t
ctaaggatccctgaatcgacggttctctgctgactgcagaccaggttcggccctctcggactctactcagtccctatgacgggcgcacgtgggcagggctggaggtggtgcgctcgccgtcgcggcgctgcgctgagctgcagcaatnccaccaggtcgctgttgtctccccttggccaccagagcttccagtttgacgaggacgacggtgacggggaggatgaggaagacgtgcatgatgaggaagacgtggatgaagatgcccatgattcagaggccanagtggcgagcctgagaggaatggagttacaggggtgcgccggcactcaggttgaatcagaaaataaccaagaagaacagaaacaggtgcgcttaccagaaagccgnctgacaccatgggaggtgtggtttattggcaaagaaaaagaagaacgtgaccggctgcaactgaaagctctagaggaattaaatcaccaactagaaaaa

SEQ ID NO: 582120 - DNA, 926 bp, Homo sapiens
agtgggcccaggtgttgcgctctcgttggccgttccttacacttgcttcaggctccagtgcagggcgtagttgggatatggctaactcgggctgcatggacgtcacgggtccagatgaggagagtttgctgtactttgcctacggtagcaacctgctgacagagaggatccacctccgaaacccctcggcggtgtacttcatgtgtggcccagcctgcaggattttaaggcgttgactatggcaattcccaaggcatatcaagtcaaatcgttggcatggagggatatgccgacattttcagagtcctgggcgatgaagtgtggggagtagtatggaaggtgaacaaaagcaatttatgattctctggatgagcaagaaggggttaggagtggagatgtatgtgtaactagaagttacggttgcaactcaagaaggaaaaagaaataagctgtcgaagttatctgatgacaaattacgagggtgctcccttccatccccatagttgtacaagattagttgcatgggtgcgtgggaaaaatggtttgccgcttggaggtatcaagagaagttaaaagcaatagaaccaaatgagtatacaggaggggtctcaggacggaaattgaagatcatcatcaaaaaggtgggggaaaacacaaacttctttagaaacataacagaatatatctaagcggtattctatgtgctaatataaaatattttttaagcagttgagaacagggatctgggggatctccacgttgatccatttccagcagtggtctgaaggagtatcttaactggggtgaattcgtggttttagactttaaaagaactgggtaggagttcgaagacttaaaggggggattgagggcggaattgggccgttgatgggttccctttggaaatggaagacttgatgattagg

SEQ ID NO: 582121 - DNA, 295 bp, Homo sapiens
accgggagcactgatcatacccttgtgtacacattgtacgtacttcccattagtgagctcattaggaatatcatgttgtatgcttatactttcttgttcaaatgtctgtataatgtttttagagttggggtctcgctgtgttgtccaggctgatctagaactcctggcctgtgatggttaatactgagtgtcagcttgactggattgaagaatgcaaagtattgatcctgggtgtgtctgtgaaagtgctgccaaaggagattaacatttgagtcagtgggctagagtctaggtg

SEQ ID NO: 582122 - DNA, 132 bp, Homo sapiens
cagggaaagccaacctccctcctgcttctgtccagagaattgctctattacagggaccagagtaagcatactagctgcctgactgaggcatctcgagatgcactgtgataggaggttagcctacaatgccag

SEQ ID NO: 582123 - DNA, 111 bp, Homo sapiens
gagcatcagtctgaggcatcgttgtagctgccccctcttctatcaccctgtgtacggactagtcaattccattccagcgtagcgtggactagtagccaagcgtggactagt

SEQ ID NO: 582124 - DNA, 393 bp, Homo sapiens
  misc_feature (335)..(335): n is a, c, g, or t
  misc_feature (385)..(385): n is a, c, g, or t
atgcatcagaataaaaatctaaaatcttagtttaagctcaaatgacagagtttctaattacgtgggtctggtttaagagctgaaattttgcttttgtaacaagtgcccaggtatattggttttgctagtctgtggaccacacattgaaaatcactataatattgatagtggcagaaggcagacaaatttctaggcagaaaggggtgggtcccctttttggcctttttgcttgaacctgaccttcaggccaaaaatgacctggaaaaccaagctgctggtacggggataaagaccccaaccagagtcacaacttcctgggatgccttttattccantgtaatggttcttttcccagggttcacggatgggaccattcagcacacantcccttca

SEQ ID NO: 582125 - DNA, 143 bp, Homo sapiens
ctctctagaggcaggactgactatcgatgtagatgtaggtacacagatggagacaagcacgacgtagaacgacgatcatgctcacggcatcacggtggatcacccgctcagcgcgtaactgatggttttcactgtcaccggtt

SEQ ID NO: 582126 - DNA, 785 bp, Homo sapiens
ggggtcacacatcccatcgactatcacacgactgactacgtggatgagatcaagaagatttacccctaaaggagtgtgactattgtcatggaccctctgtggtgggtcagatactgccaagggctacaatctcctgaaacccatggggcaaagtcgtcacctatggaatggccaagctgctgacgggccccaaacggaacctgatggcaccttgtgcaccggtacatggtggaatcagtacagctgatgacagcttctgctagacatgcttgctaggcactaaccagggactgatgtgtggcttccaccttgtggtcttactcatggatgatgaggtggagctggtcagctggtgtggtggcccgcctccatggactctgtacaatccagggtccacatccaatgccctcatcattgactcagattactggaacctatacgagaaaggtgagtctgatgtccatgcacacacagcatgcagcgtagaagaacgcaaatgtgggcaacggtcctcctggttaccagggccagagacaggagaatctaggggccaaggtggctggtcgaagaaccctaagaagaccaagcggaacgcgcgatgatacgtttggagaaggcttaccgtttccttgtttgtgctcactcaagtactttggctaattatcaatgccctcttgtctattatatggccttcttgaccacgtgcgccttccacccccggaagtgagcaatcattcttggatgagatacgattgaacccggatctccgcacatgtacatcttcc

SEQ ID NO: 582127 - DNA, 82 bp, Homo sapiens
ggcagtatccttgacctcccacagccgggccgccagcccggcgatccgcggcggccccaccgagacgcgcccttcgcccgac

SEQ ID NO: 582128 - DNA, 531 bp, Homo sapiens
gctgatgtgaccgatcttgatgattcctctggaccctcaaagggacattccaaaatgaccgcatatctgggattgtacgccatcagtggtaaagaactcgtccagactgatcaactgtgatcctggactcgctgtatgttatagatgagtttaatgctgtggacttctagatggacacacattcgttcatcaacaccgaaatggacgataactatgctggatttgttctttggctaccagtccagcagtcgcttatatgtcgtgatgtggaaacccgttgcgcagccctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaa

SEQ ID NO: 582129 - DNA, 124 bp, Homo sapiens
agctggtcgcagtcccctatagacttctccaggcttatatggattaacctcacaacagtctctcccctatagacttgctccagggctttatatggattaacctcacaacagtctctcccctata

SEQ ID NO: 582130 - DNA, 218 bp, Homo sapiens
tttgatgaaggccgcaacaactttgaaggtgaggtcaccaaggagaagctgttggactttattaagcacaaccagctgcctttggtcatcgagttcactgaacagacagccccgaagatttttggaggcgaaatcaagacacacattctgctattcctgcccaagagtgtgtctgactacgatggcaagtgtggcaacttcaagaaacgagctgaagg

SEQ ID NO: 582131 - DNA, 103 bp, Homo sapiens
ggacgcctctcgacgactggtaccacgactcctacgctctaccttccttcccgcccccacccgtccccgtgctcaccacggtaccttggatacgacggcacgc

SEQ ID NO: 582132 - DNA, 1545 bp, Homo sapiens
gatggaggactgaaggaaaagcagagcatgggaacccaggcaacaggagtagttcactccgcgagaggccgtccacgagacccccgacgcgcagccgatgagccccaggcaccgccgctgttgcttggagaggggcgggacctggagagaggctgctccgatgacccaccatgtcctctcctaccacgagttcccatggatagcccacctgcactggaatatggcccacgctcagacctggacgccccattcttcttcacccaagtgtaaaggaggagggtccggagaccgatggccccaggggaataccgggaaccatggatgtccacaggccacgtgactgagcgccacggctcagccatgccagcacagacatggggtcaatccgcagaatccccgaagagggaacccaagatgcagcaacgaagagcaaggaccggggcccaagaccccgaaaaactgctggggcccacagaagacctcatggacacgaaggatcatggcagcgacgcccaaacggacccaccacggaactacacaacaaaacaaacagaatgcatacaaacgctgaccacaaaaggccacggcaacgggagccattcacactaccagaggagcacagaaggaatggaccacagaaaggaacggagggagcacaagcgcaggcaccaaagaccatagacaccagaagagacgtgcccgggaaacccgaaggacaagaacagggaacaccacacaaaccaatagcgcgggaccgcaacagaggagccaagaacaaggaagccacggagacaggacgaccccacgctcgccacacggaaggacacacaggaaacagacacggagcacacacaagggcacgatcacaaccacagagacaagaaaagaacggaatacccggggacaaccacaaacacacgacaaccgggcaacaccacacacaacgacacacacacaaggcagatcaacaaaagacacaagagcgacagaccaaacataccacaagccagggagagcaccacaagacggaccacaaacacacacaaccaacaagcaacgacaggaggacccaatgcgcgacgatacgccccatgaaaggcgaaaacctgtacgaagcagaagatgcacaccacaaaggagacaacaccgagcgaaaaaagaccacaggaccagtcgacacaacataatcagaacggacggccatccacgcaaacaacacaccgacacaccaacaagcacgagcgagtggagaggacccaaacgacagagaacgcacacagaaaagcagcaacaacagccgacagacagcacgaagagcgaacgacgacacaggacacacgatagcagcagacaacaacacaaagacgcagaagaactaacgccaacaaagacacgagggccacaacacagagagaagacaccaacacaccaagaacagacagataagaggacgcaacaaacacgagacagatacacactgagagaagcacagacacgaagaaaccaagacgaagagaaacaaacacgaagcacacacagacagct

SEQ ID NO: 582133 - DNA, 94 bp, Homo sapiens
gccagcaccaaccagacatctatgtacctctgtgccagcagtggggggtcgagaaaagagcagtacttcgggccgggcaccaggctcacggtca

SEQ ID NO: 582134 - DNA, 150 bp, Homo sapiens
tgactgggcccatcattcccaagtgccggagtggtgtctagtgtgtggcggtagagtccatgcctttgaacttgatgtgttctattgatgacctgtgctctcaggggaaccagaaggcaaatcttgcagatgaaaccctttagtggcaga

SEQ ID NO: 582135 - DNA, 238 bp, Homo sapiens
  misc_feature (98)..(98): n is a, c, g, or t
atccttccaaacgcagaaggttcgagaacagcattccttcagctggagaaacacaaaatgtagaagtagcaggcagggcccgctgggagaattctccntagatttggagcccccttctaagcagaagcgagaaggcaacctcccttaaaaaaagacatgcccaaatttttcaccacacaacaaagacaacatcaccttttttttcaacaaccttccctacaacattcagaaccggaca

SEQ ID NO: 582136 - DNA, 242 bp, Homo sapiens
agttacagcgtcaggcagaggatgtgcacacagatgcacctgaggttcgtgaacgcctgtggggagcagatgcagcgggggggattcccaggcagtgcccactgcatcgtggctcgccttccaccacttccggagaagaagatagtacacagagcccagaggcttgtgtaatccccggaattagcgggattaagccccatttctaggtaaacaccaggccgcccgggtccccaggcaggcca

SEQ ID NO: 582137 - DNA, 314 bp, Homo sapiens
gacccgtagcagcgcaccatcatcagatatgtgacttcagtctacgttagaatacgtttataaggtatagctgcatgatagtgatctctgatgactggacaagtaatggaacctctggaggagtcatcattcagatgcatgaaaacatcatgattcattggaggaggcaaattcacatacaggattagaaagtgttcatccctcatgatgacttgggggtcagcctaccggaggagtaactgcgatgtggtagaatagctagcaactagagtagatcctgaagatgtgactgaattgctgcatctctgatcaac

SEQ ID NO: 582138 - DNA, 128 bp, Homo sapiens
  misc_feature (65)..(65): n is a, c, g, or t
  misc_feature (86)..(86): n is a, c, g, or t
gggagtaatattgtgaggaagcttttataccacaaggcacagcagtctgcaatggccgtgtcccncagacctttctacagaaggcntcctacatctggacatgactctgtcctcccccagtccttagt

SEQ ID NO: 582139 - DNA, 222 bp, Homo sapiens
gatgcatgcatctgtgcttgactagtttttgtattttttagtagagacggggttcaccatgttggccgggctggtctcgaactcctgacctcaagcaaaggatttgcccacctcgagctcccaaagtgctaggattacagtgtgtgagccacctcacccagccttttttttttttttttttggaaataaatttccgctcttttggcccagggtggagtgcat

SEQ ID NO: 582140 - DNA, 175 bp, Homo sapiens
  misc_feature (32)..(32): n is a, c, g, or t
  misc_feature (56)..(56): n is a, c, g, or t
aaataatgaaaataatgacctaactgaaaacnttaagatgccatttatgatagcantaacaaaacgtacttacttaggactaactttaacaccaaggcagtaaaagatctgtatgtacactgaaagctatgagacactgatgaaagacagacacagataagatgaatggctatcc

SEQ ID NO: 582141 - DNA, 106 bp, Homo sapiens
gccgattcctcctccttggtcgccgccgtccttggcctggcgtaaaaatggctacaaacttcctagcacatccagaagatctggttcgagaagttcaaatatgacg

SEQ ID NO: 582142 - DNA, 263 bp, Homo sapiens
cttgccaagagcatctccataaaaaattaaaaaattagccaggcattgtggtgcatgcctccagtcccagctactcagtgagtgccgaagtggaaggattgcttgagcccaggaggtcaaggccacagtgagctgtcatcatgacagtgcactccagcctgcgtgacagagcaagaccttctcttacaaaaaaaaaaatgtgcggaggaaagctccatttcccttttagggagctttggtaaccggggttatcctcctgcctt

SEQ ID NO: 582143 - DNA, 454 bp, Homo sapiens
ataaattggttttgcttccttgccatggattctggaaggacatagttcttctaaaatttcctgttaattggcatgtacgtctcatttaaagcaaattaagtaggacaagcaagtcagtaaaatagaagtattaaaaagaatcatcctttaaatcacagatcttattttgagattaaaaaaaatacttctagctttagccaggtgtgcatgttgctgccattttgcatttttgaatcatcttgtgtaattgtcgccatgaaagtgttactcagaattgtcatagattttctcttctttgtgcaaaaacatggaaaattgtcactgactttgttttgaggtttcccccattttgctgccttttgggacacttcgttaaatactggtcttggctgcattcttttttttttttcctgtggggttcaaaagaataaacattttcttacagataaaaaaa

SEQ ID NO: 582144 - DNA, 166 bp, Homo sapiens
gatccctgttgctaggctggagtacagtggctattcacaagtcaatcataatgcactgcagccttgaactcctgggctcatgcaatccttctgcctcagcctccctagtaactcggactacaggtacatgtcatatggctggccaccattatcctttttttttttt

SEQ ID NO: 582145 - DNA, 195 bp, Homo sapiens
agcattatatagttgatcaatgagacatagttaatgcatatttctgtttgtgtatcatgcacctacctcagaaaacaagtattgtacaggtattctctgacatagaacagcactaccctccatctctccccagaatgtgactattgaccgccagttctgggctgtttcacgattttttattctctgacatttaca

SEQ ID NO: 582146 - DNA, 218 bp, Homo sapiens
ggcgacggcaccatcatattgatgaagctgcagtcacccttagtggccacaccgtccctctccccgcggtcccctctctgtagtgactggccctccgtcttcaagagtgcactttccactctaccaggaagccctatgacatcctcaggctccccagacctgcagcttgcatggggcccctcccttcttccacacccaccctccgtgggcctctaatt

SEQ ID NO: 582147 - DNA, 380 bp, Homo sapiens
cccaaaaaattttttttttaaaaaaaaattaaaggttttaaccccccccccaatttcccccttccccccccaaaaggaaaaaaaccctttgttttccgggaataaaaacccccggcccctggggaggggggcaaatttaagacccttcttaaaaggcccggggtttttaaaaaaatgaaggttaccctttttttttccaaaaaaattttggggggtgggaaaaagggccaaagccttttcccaccccccttaacggggggtttttaaaaacaaggttttttaaaaacccaaggtttttaaaaaaaaaggggttgggggttttttttgggtttttttttttttaaaacacgggcccccggtaaaaggttttaaccatttta

SEQ ID NO: 582148 - DNA, 163 bp, Homo sapiens
tggccaggtctctacctggtgtattgggtcatatggcgtgggggcgaggggatctcttcggtttcttccattgggaggaatcactcatgcctccggctctcattttcagcttcttcatgtgggtccccacatagttctggggttcttctttaaacggaggtaa

SEQ ID NO: 582149 - DNA, 149 bp, Homo sapiens
atggtgtaactgagtgaggcaggagttcgaggaggttagttgtggcaataaaaatgattgaggatactatgtataacgagatcatggttcgtccatttaggtgtttgtgctcattgtctatacatttgggtgatcctcatagacgtcga

SEQ ID NO: 582150 - DNA, 718 bp, Homo sapiens
gagctcattgagaaggtgcgcagagcgcaccaggaaaccttccctgccctctggcagctgggcaaatacgctacgaacaatgagctcatgaacaacgtgtctctctggatcattgacctctgggacaagttcagtgtaatctctcgcgaccataggtgcatcaggttaagactgtggagttcgccaagacacggactgcgccgtgcttcaccaccgctcaccattcgccagaccagatgcaccgctcctcacaggctgtcctgcctggcacgatccatgatcctgcgcgcatcatggacggcggtacacgcccgtagctagggacattgcagtgatcctgtctcgcgagcgggctgaccgcatgaacgcggacccaggatgcactaagcgactgtgcttgcggcccccactcagccagaccatgagtctttgccgttcgcgcaacgcgagctcgctgacccgctggaggatgtgatgactgtcggacgacgcgggctggctggcacgccgtcgcatcatgccgctcgatcgtgcgagagcacgcgcctaggtacactggcagactacgcgcgcgacctggtgtggacaatgcgtgcagggacgccggtgcatggcaggcgccgtagtaggggtcttagcgtgcggaaaagcggatggccgcagccgccccccagagtgtacgcccaaggaatgcgtagatgaacattactgaccctgc

SEQ ID NO: 582151 - DNA, 763 bp, Homo sapiens
  misc_feature (16)..(16): n is a, c, g, or t
  misc_feature (42)..(42): n is a, c, g, or t
  misc_feature (145)..(145): n is a, c, g, or t
  misc_feature (224)..(224): n is a, c, g, or t
cttttctcacgacacngccaggcatctgcttgttgataatcnttgatattgaagaaagcagggagaccaagtgcccaggtgctttaagagtaatggctcaaaggtgctgtagcagcacaggtttcaattccctggacgtgctccnaagtgtggcatacacatacgtaggatctaagtgacattattttctgagcagcatgatttccagatatattgtcttggcnagcaacagcatgtccatagctccttgttccccacatgcgtctcagtttagggtgaggtctctaaagcaattcatccatgcatgacacaagtcagatcaggtcgatacagattaaatcaggtcacaatagataaacaactctggggatgaatgtcttttacaaagctcgagaaacacatccagaacacattgcctttttgtaaaagagccatgtccatcccagcctgccccacctagcccatactcactttggagaggagaattgaaagaatttgttattccaggctgggtgtggtggctcatacctgtaatcccagccctttgggaggccgaggtgggttgatcccttgaggccaggagtccaagaccagcctggccaacatggtgaaacgttgtctctactaaaaatacaaaaattagccgggcatggtggtgcgcgctgaggcaggagaattgcttgaacctgggaggtggaggttgcagtgagccgagattgcaccactgcactccagcctggatgacagaggaagactccatttc

SEQ ID NO: 582152 - DNA, 1973 bp, Homo sapiens
  misc_feature (780)..(780): n is a, c, g, or t
  misc_feature (1972)..(1973): n is a, c, g, or t
aacaccatagctgaagaacacttatcaaggtgtctctggtgcctggctgatatgagcttgcggcactagtcagtgtgtataacaaagctaccaacgtaccaagtcagagcgccgtcgcgtacagtgacgtgacgtgcactacctagatacaataccacaagcctaacatctcagtgagtaagcgcacatagagtgtgcggccggaatgctaacgaagggcacgaagagagcatcataagacacaagtgccctaggcataacagccgagtcatagataccacacaatccgtgctcatcttcagaaataaacttagcgaaataaaatactcttaagtcctgagtgtcagctcgtgctaggcacgcatgctgcccttgctatgctccgacgagactttaactttccgtgggaaggcgctttgatgagccaagcgtacgcaaagtcgcgtcattcaccacctcacagcgcacgggcccgtagacggtagaacgcagcaaacggtttgagggctctcggcaagagatcaccgggcgcactcaaaaccacgcaagcgtgaaggaatttctctcgttcatccaaaagatcacacaacatacacattaaaacataacaatcacaggggtgcagtgtgcacgttcttggccaattacaaagttgaatgtcaattccaaatacgaagcgcgcttcgaaaagcatgcttacacaacgtagagatttcctaacaagtaagtgaaaatatattgtagagatcccagaaaaggaggtgggaggacaacctaacnaatatatcaagagggcagaggttgaggttattattattatacaagaagatttatgtggagcaaatgggggggttcccgtgcgattaagttatttataaagcaacaccagatacgtctttaagcgagaaagtacgcggtcacgaaagaaaggaataagcagttataccaggaacggttgtggtgcgacacaccattattttagagggcgcggaaataatatgcggcagacaacccgtggtttaaattatcatacagcgggggggggttctctaatggcaaattcttatatatgtggggtagagacccacaaacaaagaaggcacctattacgcaaagagaagagaatcttttaaccagcgggtcccatatgaggggtgagacattcaaaacatatattctcttcaagcgtattcttgtcatttggaggtccccggaccaaaatgcttaaaggtaaattatacagcatttagtaccgagttccctgaaaaagaaattcacggttgtgtagacgtgaggccgaaagtagccggatcgtgatcaatgaaataacttgtgagacaatcgaggtgagcagctatgatagggagatatactgagaacaacaagatagagctgggaaactgttctaccaccaaaatcataaatgggcaacgtgagaggggagtactataaacacagaaaacacaagcagacagagagacaaaagaaaaaggggaggatgcgcggccaccaaaaaaaagcatcacactcagcgagggggcgcacacgtatacgcagaacacccagacacaatgtagtgacaaaaagaggggggcccccaaacggagagtgcaaaaacaagacgaacgaagcagaccggcaggaccgcagcacgacatacacaagaggcaagcagggaagaaacaggacagaacggtgacaacatcagaagaaaacacaacagacggggggaagaacaaagaagaacaacacagaagcaaatagagaaggaacagaaaacacagagaccaaggcatcagcacagaagaaataagaagcagacaagagagagaatagacaaccacgaaaagaacgacaagcagacgcaagacgacacaataacagacagaacaaacagaagaaagcaaaacaaacaacacgagagagagagagaaacgcaacagacaactcgagtatcgacgcataatcaaann

SEQ ID NO: 582153 - DNA, 517 bp, Homo sapiens
ggacgcgtgggtggagatctctggatccatgaccatccttttcctttgttcttctttattgctttttaacttgcgggaagttaacataaataaaaatgggagtggagcgtttgagaatatccgctcagggggccccattggttgaacgcggatatccgcctgattattgttatgttacccaatgttgggctccctatagtactggggactgccggctgatctatcatatgctagcccatcgtgcgctgatcagctcctacgcagccggtccgggacctgtgggaaacactgcgtacctcgtggcaactcttggggtacaccaggaacacccctgtatagctctccatgcggagaggtgagcaccacctacactgtgggaccgcagaacatacacccaacaaagcagaaatttctcacacgcggcctccacacaggataacaacactatacaagactgtgtgacagacagcagggtgataaatcaagtgtgtgattcaaacaacaagccaagcgccac

SEQ ID NO: 582154 - DNA, 273 bp, Homo sapiens
  misc_feature (148)..(148): n is a, c, g, or t
  misc_feature (202)..(203): n is a, c, g, or t
tgggccccgtcgggcgtgagaacttgagatgccgccctcggtcaggattcctggcgtgcagcctaggccactgtgttttccatcaacatccggggtttgtgacaagccgcagtttgagggtctaacccagtggttctcagtgtggatnacctgcctccaggggacactagtccatgtctggggacatctgtggttgtcacannactggtgggaacccccccctgcacctatgtgcggggggggttcccacgacgggggactgggcgaatgtct

SEQ ID NO: 582155 - DNA, 286 bp, Homo sapiens
cgggctgtacactgatacagaattctcatctgctagatgcagggaatttgtatacatatttacagggacaacaatgaaatacgaagatgcagattgagagcatcagaaagagcaaagacaagcttccatactatctaaagtagaatatcttcagccttatctagtcatactgtacaatagtcctgtccatagtcctgtttccttaccttgatgtctctgactattccatgaaagcaagacagatatcttttagaacctaggtagacatgtacagtagtcaatttct

SEQ ID NO: 582156 - DNA, 1111 bp, Homo sapiens
  misc_feature (826)..(826): n is a, c, g, or t
ggggaccaggcgcagtatgctgtatgaagcggacgataatcacgttggcaagcatgatacctattatgcggaagacagtgacgctgaaatccgtaggtaccagatcatatgcctccttattcgacccgagctgccttcagtcaggcggacctctcttaggcttcatagatacagatcttacaacgtaatacggtgagagcccatggattggtaatgaagtctcacttgactatgctatatatcctagtcactaaatcggaaggcctctcggcaaggtgatgtagtctatcgcgtaatgtaactcgtgtgtgcccgaaaactggcggtccttctctcggcgtaatccaatactaaggcatgtcttggattcattagcgttccctcatcctcacatagtccctgactcgcgatcatggatactaggtgtgacgcgcctgcgagcaggagtacacaggtgttgatatcagctcttaccaccgtcgctcgttgagcgatggggagacgtgacatgcgcacgacacgcttgggaggacctcctgctaggacgcctaattcaattactctcgtccgtgtacagcactgaggtcataagtgttctcgctgcgtaggtctggacggcggcgcagtgcaagtattcgagtctagcgaagcgaaatggactcaagttagtgaaagatatggcccctgaactatagaccgcgaaatatccagaagcagaccccgtgcgtttgctgtcgtgatgcctgtgtcgtaagttcacagcaagtccgtactctctcctgatcgtctccgcaagtgcctgagtctagcgttggcatcacatatntcgtactaaccagagacgttcacatcacgccaaccatatttaacaagtagtaaaaggccgtcattcacaccgagaggacttggccctggaaaaaaggacttgagcgcctctaatgagaatgatcctccagcaggaggactgttgtccgggggcgaaagagaaagagaaccgagggcccttcctttttcccaccccctttgttttgtgacacgtgggaagcgggggccccctgggcctaatgagagggccggctaacaaaaaagttctttccggggggaggctcgc

SEQ ID NO: 582157 - DNA, 320 bp, Homo sapiens
agcgcctcaccgcaccgcagcgctacgaggcggcatctatgcgtgaagctgccgacgcgcccggctccgacgaggcaccaaggggcccaccacaagaaatatggctccaacgtccaccgcatcaaaagtatgttcctgcagatgggcacgacgtcggggcctcgggcgagtcgcgcggcggcgcggacctgccgagcgccacgggcgtccgagcgcgcgtgcgcctgtcgtgcgcggccagcagcctgaacgagaacgtggaccacagcgcctgctgaagctgggcaccagcgtgtcggagcggtgagccgcttcgactc

SEQ ID NO: 582158 - DNA, 1197 bp, Homo sapiens
  misc_feature (674)..(674): n is a, c, g, or t
  misc_feature (685)..(685): n is a, c, g, or t
  misc_feature (1197)..(1197): n is a, c, g, or t
aaaaaaggaaagctgggttttctagttaaaaaccatttcctttgctcatttatcaaactctccaaacgctaggagggccaccttaacattccttccgttcccacgccaagtggggtgtgttttcttggagccacttccggttttattcaggggaaccccttgttcagttgtgccattcgcacatgtgttttattggggcccagccccctgtgtgtggccccaccgaagagagagagtggggatatctatgtgaaacacacatgtgtttacacaagcgccagaggagagccgggtgtgcccccctgtgtgtgttctcaaaagcccagagttctcttctctgtgccctctcaaccttacacttgtgtgggagagagtctgtgagagcgccagagagagagacaactctgccttgtgagagcacctgtgtgagagagagtgtggagagagtgtgtggcagagtgtgagagcaccaaaagcgtctcagagtgcgccacactgtgtgccgcctctcgcgagtgtgcctgtgggcgacacacacgagaacgtgtgtaaaatctcttcccatgtgtctcacaaaaaaatatatacacacatatattataatatatacacaacatatacacatgtgtacgcgcgtgtgtgaaactatactctatatctttacaggcgccatntataaacacangggaacgtgtgcaaacatatatatgtgctcctgttgtgcgcccctatatgtgtgaggagtctcaccttttttatacacacagatatatatacatatatacacaaatatctacaatatgtgccaacacaggtgtagaagtgtctcaaatctcaccccccagaaatgttggcagagaaaacttgtgggaggtgtgtctctccctgtgtgcccatgtgtgtgagtctcgggtctcagaaggccccaagtgagacacaccttgtgtcctctcaagcacaaattattcgtgacaagtgtgtacacacagaagacgcggtcgctcccgctgcccacaaggaggccgcgacaaacatgtgtaattcgcgcgtgtatatcacacatttatatgcgcgtgtgaggacaaagggcggatttgccacccaaaaatgtgaatgtgcgcgcgtttattaagcgcaaagagacatatatctatatttcacctatatcttttatccccgcgtttaaaagatgcacan

SEQ ID NO: 582159 - DNA, 151 bp, Homo sapiens
  misc_feature (31)..(31): n is a, c, g, or t
gcacgaggtgaaagggggctggtgtggcagnacggtgtgctgtggtggtggagggagtggggtgggaggataaggtgggtggggcagggcccagtgagccccaggctcgtggcaggagccagtgttaagtgcaaccatttgccaagcccta

SEQ ID NO: 582160 - DNA, 426 bp, Homo sapiens
aaaacccagtctacgtcgttagaggcgaaaagtattcggtgtctttgatcctgcaaactccaatgtggcttccaccctgacctatccacattcacatccccactgagacttcctggagactctgtgtagcgttaaccaggggaggttttccatcctcatctgctgcgctgtctctgcagtactggagatgctgattattcttgtggacactctctcttcctttgccttctttgccaccgcagtgctgatgttccttctgtgtccctggcaccttctcctcctctctctggccattaaatgctggagttgctgaaagcttggccctgtccttgtctcgcctagcacgttccttctctgggtgatcttacccacatctggagctttatgactcagacatttatgtttccaacctagattgcttctgag

SEQ ID NO: 582161 - DNA, 385 bp, Homo sapiens
  misc_feature (44)..(44): n is a, c, g, or t
  misc_feature (70)..(70): n is a, c, g, or t
  misc_feature (77)..(77): n is a, c, g, or t
gtggtggttccatgccctgtaatccctgcctactttggaggttncaggtgggaggattgccttgaggccnggagttncgagactagcctgagcaatatagtgagaccttgtgtcctacaaaaaattaaaaaaataaaattagcccaagtatggtgtgcctgtagtcccagctactccagaggctgagcctgggaggcagaggttgcagtgagccaagatcatgccactgtattacagcctgggtgaaacagcaaggctctgtctcacaaacaaacgtgctgagaggctgggtgtggtggctcctgcctataatccagcactttgggaggattgcttgagtctaggagtttgagaccagcctgggcaacatagagcttatctctac

SEQ ID NO: 582162 - DNA, 504 bp, Homo sapiens
gctctacagatccccgcgggccaatcacttggacgtgaatcgccacctaccgcaagcagctggagggtgatgagtgcaggctgaactggcgatggccttggacaagtcaacatctctgtggtgcagtccaccgctctccagtggtctatggccggtgccaggtggtgtcagcacgtggcttcaggcctgtggttgagttaagctagctactcactatcgcagttggtcttggctttttgattgtggcttcagttcctatgcatctggctagatgccctttggggtggcctcatgctctgttggaagcgagagttccatccatcaagtacaccttcatctcctcctccagcaggaagagctatgagcactagagtgcgtctgctagctctcggtcccacagtcctcatgcccctctctggctgcacagccctctcctcaggttgcctgttctctcctggcctccattctcccctgctgtcccagcgtagagctggggattaatgg

SEQ ID NO: 582163 - DNA, 127 bp, Homo sapiens
caattggtatcagagctggcctcaatgatcaggtgatttttgaatgaacgattctcgtgtcttgcaacatattgtcacagttggatgcaattttggtgagtctctctctatgatctctcttaatttc

SEQ ID NO: 582164 - DNA, 174 bp, Homo sapiens
tacccagtctctgtacacccttcaccatcgggatttttatgggttaatttgcctgaatttttaactcttagagctctggtacaaaaagtctgttgtgttttgttttgttttgtttttgtttttgtttttgagatggagtctcgctctgtcgccctggcacattcctttatcgtc

SEQ ID NO: 582165 - DNA, 533 bp, Homo sapiens
agatcgtggattggccctcagcatactgatgctttctgactgagctcctctataccctgaatgcaagagaccttcatagttaggcaggaatatcatcgcccctattcagcctgaagaagttacagaagatggatctttgtccctctgcaacccttaggattaaaggttctcttataaaagaaaggggggaaatgtcagaggcggcaactccatcttaaataggaactgggtgaaatgaggctgaaacctactgtgctacattcccagacagttaaggcattctgagtcacaggatgagataggtcagcacaaaatacatgtcataaagaccttgccgataaaccaggttgcagtaaaggagctggccaaaatccagcaaaaccaaaatggcgacgagagtgacctctggtcttcctctctgctacactcccaccagtgccatgagagtttacaaatgccatggcaataccagggagttaccctatatgttctaaaacggagagacatgaattatccaccccttgtgaagtata

SEQ ID NO: 582166 - DNA, 606 bp, Homo sapiens
  misc_feature (250)..(250): n is a, c, g, or t
ctatgaaggaaaagttggatctcctctctaagtcacaggagattgccacatctgcccatgaataactgtatatctgaagggctctcaacagattcaaatttgtctgtcatgtatacgtgcaaatcttcaagctgttgggacttgtacacgacacaaatcagttgtgtggatgggtcgtatcgaactcagaagggtataggtttgagacagcagagttcctactttcgccttggcatcattaagactctcntgccacgtaatgcactggctgtaactccgtgacagtgttattctgaatggctgtcttctacggttccgtttggataagatttgtgttctctgataatcagaggtgtaattcaccatagcatgacagatgcacagctccatatgctttaatagagtgtcagtgtctgcagagcgttctctacacagtgaatcagtacattgtgtcgagctttgcaatgtattcatagtgtgagtcagacaaggcaagtggcatgtcctggcagaaatgggcacatctgagatctgaatcattgggtagatgtgcccactgctcatgtcagctcccagttcaggggtatgcgtgggcttgtatacagg

SEQ ID NO: 582167 - DNA, 165 bp, Homo sapiens
  misc_feature (32)..(32): n is a, c, g, or t
  misc_feature (127)..(127): n is a, c, g, or t
gaaacattatgtatgaaatgatttttgtgtgntctcccatgttttcttctcaacaataagaaaatgttttactgacagcaagaggacgaggtcaagaacagaaaggatttggacttgttttgctccntgaaatttttgaggacattttaattctaatatttctga

SEQ ID NO: 582168 - DNA, 314 bp, Homo sapiens
  misc_feature (147)..(147): n is a, c, g, or t
  misc_feature (198)..(198): n is a, c, g, or t
  misc_feature (229)..(229): n is a, c, g, or t
  misc_feature (247)..(247): n is a, c, g, or t
  misc_feature (274)..(274): n is a, c, g, or t
atgatctggtttatgcttcagaagaagcatagtagcttctacagaaaataaatgatagaaggcaaaagagaaacatggcgagtattccactccagtgtctagtcaagagattacaagggccctggcatgaggacaacagtagaaatngttaaaagtgtactggattgcaaaatattacttttgggccagggcgccggnggttacacgcctattaatacccagcactttntggaggtgcagggagttncgagtaccagtcctgggccaacacgcntggaaatcctgttgaaaaatataaaaattagccgggccgt

SEQ ID NO: 582169 - DNA, 747 bp, Homo sapiens
cgatactatcggtatctcagacgtgaatttggtgtatttattacttcagcatgctggtaccattttggtgcctgcttggtttcttgatcggttcttatagtccagaacgatgttacctatgctttccttggctgaaggttacaggatccaaggcatgacattggagtttgataggagtacgctgtagcctgtgctgatgaagcgctttcctgtcaatttcccaagctaactcagtagcaaattctggctggtcagtgtggtccacaggatcagtagccaactgttctccatcaaactttgcttccactacaagcatatgctttggacgtttggggaaatgccgaccttctaggatggacacgacgatgagcaattggtcggatttggagaccatggttgcggtgagcggtccgggggcgaaggcggctggggggaagtgaggtccagttgagtcgcgggtaatccgggacccccggcgggacccccactgcccgcccccggtccctgatgcccggaccccgctccgcagccaggtcccaccgccgtctgctgcagcgcgcccggctcctctgcctcgggccgccagcccagatcctaactgtgccccgactcaaggaaaaagccacgctgcagccctgccagtctgcaagcagagacaagcccgccacccgaggaccttttgccgcctgcgtagccgcttttcaaacgcccgggcggccgcagcggccgcacgccgctcaccccgct

SEQ ID NO: 582170 - DNA, 234 bp, Homo sapiens
agaaggacatgtgtgtaggctcctgccgggatgggaggcagaggactgactagggacatccttgttgtaagagactgtgcaggcttccacttcctctctggctagtagctggaagacctctctcatgctgtgattgtggtagtcccagggggaatgggtggtatgagtgtttaggagtgggcagagtatgggagagcagtggtgtggcaggtcctgcgctgggatcccatggga

SEQ ID NO: 582171 - DNA, 856 bp, Homo sapiens
cgatactatcggtatctcagacgtgaatttggtgtatttattacttcagcatgctggtaccattttggtgcctgcttggtttcttgatcggttcttatagtccagaacgatgttacctatgctttccttggctgaaggttacaggatccaaggcatgacattggagtttgataggagtacgctgtagcctgtgctgatgaagcgctttcctgtcaatttcccaagctaactcagtagcaaattctggctggtcagtgtggtccacaggatcagtagccaactgttctccatcaaactttgcttccactacaagcatatgctttggacgtttggggaaatgccgaccttttaaggaatgtataatacaccctcttaagaactgtagtcccctgagtcctccagcaagacgtgtaaagggaattgcctccggaacacttctggaatcgcaggaagccttctaggatggacacgacgatgagcaattggtcggatttggagaccatggttgcggtgagcggtccgggggcgaaggcggctggggggaagtgaggtccagttgagtcgcgggtaatccgggacccccggcgggacccccactgcccgcccccggtccctgatgcccggaccccgctccgcagccaggtcccaccgccgtctgctgcagcgcgcccggctcctctgcctcgggccgccagcccagatcctaactgtgccccgactcaaggaaaaagccacgctgcagccctgccagtctgcaagcagagacaagcccgccacccgaggaccttttgccgcctgcgtagccgcttttcaaacgcccgggcggccgcagcggccgcacgccgctcaccccgct

SEQ ID NO: 582172 - DNA, 701 bp, Homo sapiens
  misc_feature (656)..(656): n is a, c, g, or t
ttttaggggccagggtgataaaacctcctaaaagttgacccgagcaatgagttttaaccaacctctgaagaagttcaggcctagtttttcaacccaaacatccaagtttttgaagaaggacagggcatccaaagcagaattgggcacatcgggtagtgccagcatgtgcagggtcccaatgtcaagcccgccattctagacaccagtttctgcgctctttcgggaccctagtagggaaccttgcggctcttcatcactcgtagagagaccctcgtcctgtatacccatggtgtggcagtacaggagccccacccgtgagcattttcacacatgtttgctccaagccggttcgaggatggtttacaaagcaatactttttgctccctaggattttcacgcactctcatgtgtccagagataaggctcgaatatatggtttccacagtacttcatagtgtataggccaagatacagcacagacttgctgtgaagggtctggtggtctgacacataggatcagccggtaacgggacctatggaagaagctcggatcgtagtcaccaatatgggtgtgggctttcatacattgcaaatccctgcatgaattgcttgagttcatcgtctcctctaaaacctgttctatgttccatcctttngatcatcatcagcatccgcagtatatgcaccataaagtacgttaa

SEQ ID NO: 582173 - DNA, 222 bp, Homo sapiens
  misc_feature (179)..(179): n is a, c, g, or t
  misc_feature (186)..(186): n is a, c, g, or t
atcggacaggctgctcacgtgcttgaatccgggaggtagaggccgcggcgagcaagattaagccactgcactccagtctgggtgacagagtgagaatctgtctaaaacaaaccaacaaacaaaaagagaaatatactgataaaactttccgaatttcacatagaactattatgcaatangggtccnccttttttttttttttttttttggggaccaaaattc

SEQ ID NO: 582174 - DNA, 581 bp, Homo sapiens
  misc_feature (75)..(75): n is a, c, g, or t
  misc_feature (141)..(141): n is a, c, g, or t
  misc_feature (160)..(160): n is a, c, g, or t
  misc_feature (214)..(214): n is a, c, g, or t
  misc_feature (222)..(222): n is a, c, g, or t
  misc_feature (232)..(232): n is a, c, g, or t
  misc_feature (242)..(242): n is a, c, g, or t
  misc_feature (244)..(244): n is a, c, g, or t
  misc_feature (258)..(258): n is a, c, g, or t
  misc_feature (262)..(262): n is a, c, g, or t
  misc_feature (265)..(265): n is a, c, g, or t
  misc_feature (306)..(306): n is a, c, g, or t
  misc_feature (310)..(310): n is a, c, g, or t
  misc_feature (323)..(323): n is a, c, g, or t
  misc_feature (332)..(332): n is a, c, g, or t
  misc_feature (469)..(469): n is a, c, g, or t
  misc_feature (539)..(539): n is a, c, g, or t
  misc_feature (566)..(566): n is a, c, g, or t
  misc_feature (577)..(577): n is a, c, g, or t
tgcttctgcttcttcccgcaccagagtgcggtgaagtatgggaccgggggggggaaaggaagggaaaccaaacanctaaaaacaacaacaaaaaacaaaacacaaaacagaacacactcacacacacacgaaataaaaccnggcacgggaaatgaattangactggaacccagtttcttttttttttccttttttaaaaaaatgggggcatggngggggggnaataaggtcnacctggcaangnataaaacggcaaangcanggnttccattggataagattaaatatatataagaccggtccacnggcnggggggggggttngggggggcnggaggggggaggtatttgtgctaaaccaacagaaaaaagggctggggggagagggggacccaaataaaccatcaacgggctgttctgtacagtgagggcttattaagaaaaagccgactgtttataaaagaaacggnggttggtttgtcttcggagcaggtggggacagaaggagtgtcttcgttgcagtggtcacatgtggggggnggcgggggtggggtggggagggcagtnggactggcggnggcg

SEQ ID NO: 582175 - DNA, 419 bp, Homo sapiens
atagaagcatcaagtaaaggacgtgatacatgtaactagccagacttggggtccccactatagaagtcagtcctggataatggacagtccaggcggcctgggaggacagggtaggagcgccagagtcctggaagcatgaggttcctagacctactggcatctcagagggactgagtttgcaggcgcaagtagaatgtagactcatcagcacttctaacaacacagctctaagcaagctggactgtgcccatctcttccacgggctccgcacatgaccacatcgggccttactgctcctcgggggcccacatgcttggtaaactctgttggaagcgcgtacctctggtgctcacttggttctctctttctcatccgataaggaacagctgaaatgccaactctttgagaccttcctctcc

SEQ ID NO: 582176 - DNA, 301 bp, Homo sapiens
  misc_feature (63)..(63): n is a, c, g, or t
cctggggcccccccccccccttcccccataggattttcccgtggggagggcctatattccccntaggggccctccccccccgggaattttgaagggagggtcccgggttccggttttttttacccggtgggttttccctcccctttttcccccccgggggggtttcgggagttgggcccttttttgtcccgttttcccccccccttatgggggggtaattggaccttttgttccccctgggggggggggggatggggccccttttgggttccgggggggatttccggggggccccccccca

SEQ ID NO: 582177 - DNA, 896 bp, Homo sapiens
ccgagcgaggggcatctctcggcgaaactggcacaagcgccgcacaaccgggggcgagagaaagccctacacaagaagcggaagtatgagatggggcgcccagagtgcgaacaccaagatggcccccgacggatccatcacagtccgtgtgcggggaggtaacgaagaaataccgtgccctgaggttggacgtggggaagtttctcgcgtggggctcagagtgcatgtacgtcgtaagaacaaggtatcatcgagtgttgtctagcaatgcatctagataatcgagctggttcgtaccgaagacgcctggtgaaggaattgcactcgtgctcgatctgacaggctacactcgtacgcggacgagtggtacgagtcctcactatgctgctgtcccatgggctcgcaagaagggagccaagctgactcctgaggaagaagagattttagaacataataacgatctacagagaaattcagaagaaatatgatgagaaggaaaaagaatgtcataatcagcagtgtcctggaggagcagttccagcagggacaagctgctatgcgtgccatcgcattcaagggccggggacagggtggccgagcaggatggctatgtgctgagagggcaaagagatggagttctaatcgttaggaaaatcaagggcccggcaaaggccaacataaagtcctagctgtggtcgttcaaccgaggtgagtaaaggtgtcaaataggtgaaggtgcccgaatagagacgaagggacaccacaaaaggcaagaacacaaaggagcgggaaggctctcgcaagtgatagcacagggggggcacgcaaccagaacgaggaaacccgcgaatgttggggaaagaagaggggcgcccataggacgacttcgttcaaca

SEQ ID NO: 582178 - DNA, 1186 bp, Homo sapiens
gccgattgttaatttcagtgatcgtggacctgtcgctgtcgcttgtacaatcgatattgactggccgtcgtttacatctgttgccatcccggccggccgaggccattgcacatctgcgaagatggcaaagttcatgacacccgtgatccaggacaacccctacaggctggaggtccctgtagcggttcccgagacagtttcgggatatgccctaccagccgtatcagcaaaggagatcggctacggaaaggttagcagactggacagcgagcccacataaccacagactaacacggtacacacaagtcaagctcactcctcctcagccttcggctggctgcgcaacgctccaatatgctttactttccaatgcacgcggagagactcgaaaacgctacgccctacccgagccctgagctaggcacataccagcccgccgccaacaaccaccacaacccaccggcccccttacccaacgccgcgcacacctccgccacacctgcaccacctctatggccacccacgccaccgcgaaccccccttccccgaccacgcaacgaaaccacaacaagcaactccagctcacgggaaaacccactgtgtctcggcaacggtagtccaaagcccactagccgacggaagaatcgcctagacgccgtaataacgcacgcctcgcccccaaaacaaccactgcaccacaaacgcaacgcaagtcaacccacaaccatccccaactttacccgcacccttggccccacccaaccaccacaaaggctaccccccaacgcaaaccacccaaaacctccacggcgacgaggcttcaagcacgccacggtagaaaccctagcagcgcaactcccaacgaccaaaaacgtccaaacaagccacacagccaccccccccgcgaacgtcaaccctaccgctcatccacgccatccgacagcgcgcatcccagcccaggccttgaacactcggcgccaaaacagctggaacacacgcccaagcagtaaaaaacatggcggcgcatatcttacctccattctaaagactttggcacacttctaaaccaacattccccacccatcacccattagctctcaaaagcctattattcaaggaaaagtcaccccatcctccgtgtaaccaacattgtgcacgcttgcgttatcgactggtgtagtgccct

SEQ ID NO: 582179 - DNA, 815 bp, Homo sapiens
  misc_feature (558)..(558): n is a, c, g, or t
tgcactaaggtgatgcctcttatattataagaggatggtgtttttgtagaggagggggtattatactaccacaccccacgtcgagccttagtgataagccaaagtttaatattccctccatattgcacaccccgcacgtaggtaaattatgtggttgttaaatgtatcacaacatcaggcggctagcacataggcgaggagaaaatttgttcgtgtctcccccccccccccgcgcgtgttaataacagataagtttcatggagagaaggattttttactatttcatccccccccctgctgggcaataaatttatctgtgtgtccgctgctggacggaaaaacccgcacgacgactttgccctgagcgtttttaatgtgggtggcgccccccccgcacacagacgacacggtacgcacacatatgtgatcacaccctcacataaggaagatgcccccgcgtttcacacgcggcgcacacgcgatactcacgcgccgatcctcgcccacatagataagtgcgtatagaatataaatgggagaacacacactctgtgaganctaatggtgcgagagaaaatagggcacgcaaataagtgggaccctgcagcgagaagacactcgagagaggggcgaggacacacactctctctttttagagaaatggggcgcaccactggatgatgtccagactcgtacaaactggtggtttgcacacaacgaaccctcgcaagcgttggtacaaaaaacgcgaaagaaattcattgggcagccacacaaaaaaatgagaggggagaacgccccaacagataggacga

SEQ ID NO: 582180 - DNA, 291 bp, Homo sapiens
ccctcgccctacctggcgtgctttgtgacagacagatcctggagtgcacggagtcacactggtctatcagtcccgacgggggctttggtcacatattcttcttgttattcacaggcccctctgactacagatactaccctcacagtccttccagactccacaacaacccagcttcctcttccaggacccgagggtgtcctggtccctggtctacctccccaccctcccgagctgctggaactacgggttctcctgctcctcggacgtgtgcttgcctttgtggctgcgtcc

SEQ ID NO: 582181 - DNA, 251 bp, Homo sapiens
ggtctacaagacgctacttcccctatcatagaagagcttatcacctttcatgatcacggcctcataatcattttccctatctgcttcctagctccgtattccctcttcctacacttaccaccgaaacttaccttattcttaccacttaaaccgttcaggaattggaaaccgcttgaacattcctgcccgccatatcctaggcctcatcgccctccaatccgtacgcatccttatacataacagacgaggtc

SEQ ID NO: 582182 - DNA, 388 bp, Homo sapiens
  misc_feature (34)..(34): n is a, c, g, or t
  misc_feature (51)..(52): n is a, c, g, or t
  misc_feature (62)..(62): n is a, c, g, or t
  misc_feature (104)..(104): n is a, c, g, or t
  misc_feature (199)..(200): n is a, c, g, or t
cagctttatagtttttaaaatattttagatattnttaactatgaacttctnnacatcactgntgccagattaccgacactgtcacttgaccaatactgaccctntttacctcgcccacgcggacacacgcctcctgtagtcgctttgcctattgatgttcctttgggtttgtgaggttttgtaaactggggtagggccnnccatgttttggtccactttacctcccggggaggaataaggggggggacccttcagcccctacaccagaattttttaaattgacagtgccagaatgggggggggtttttacattgatcttttgctaatgcaattagcattatgttttgcatgtatggcttaataaatccttgaatcataaaaaaaaaaa

SEQ ID NO: 582183 - DNA, 153 bp, Homo sapiens
ctgagacctgacgacctagagcgaaggctgattgagctccgctttagattgccagagacgctgctgcactcttaattcagtccgattggatccagtccggagcaagactccttgctttggttgagccaggcaggggccagtcagcactcggga

SEQ ID NO: 582184 - DNA, 327 bp, Homo sapiens
atacttagattttggtacccccaagttacaacaatctcaatgtattttggcccttcaatttggaggagggcaaaagttggaagtaagaagtattattttaagtactttcagtgctcaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttg

SEQ ID NO: 582185 - DNA, 206 bp, Homo sapiens
agagatagggtctcgctatattgcccaggctgttttcaaactcctgggctcaagtgaccctcctactttggcctcgcaaagtgctaggtttacaggcatgagccatcatgccagaccacaaagacattttctattaggccagtggatgttcggatcatctttaaacaacatcgaaagttgaattgctgacagtaatatggggatag

SEQ ID NO: 582186 - DNA, 234 bp, Homo sapiens
catgggcaggacagtccatccgcggaccaatgggagtgttagggtgccgccccatagcccccccgcctccgagccgagcagggggcggggtcgcgccagccgctccgcccatgctccgtaggcggcgctgttgcttgcaggggctgcggcggggtcgccccgagctgggagctcagcgcccggtctcccagcccgcgggcggggcacatgggctggctgaggattccgcggccg

SEQ ID NO: 582187 - DNA, 1559 bp, Homo sapiens
acatcaccaggagggcgaagctggacacggtgaggggggccccgggacattgcgcagcaaggaggctgcaggggctcggcctgcggtgcgccggtcccacgatggcacatgctggcccagtggatcttggtgctgtgagatgtgtgcccacatgtggacttgtgtgacagctgtatgcccatcacctgctcatgcccctgtgggcttggcttgtgcagaccagtacatgcatccagtggtgcagtcaatggtgcattggtgtgctgcagaacccagcactagtgctgagtgctgtggcatggtggctggagttgaattgagctactcagtgagggcaggattggttgcatgtgcatgggggttgagtggagctgcagcgtgagcgggctgaagctgtggcggtgcaacttgtgcacctaccaaagagccccggtgtgcccaagggcaggggcctcggcgtggccggctgcacgtgcagccggggcatcaggttgcctacaaacggtatctggggcttgggagacacggaggtgccaatggtgtctcccacgccatgggaggatgggaccagtaggccacaacccaagccgttgcgcggacacgcgcccaacgaaccggccaaggtggtccctgggtgagcaagttgacccacagcaagtgaccattgaacatgggtaccagggatgggtggaccgggagagcatgaggacacaagacagggaagaggcaggctggttccctagggcccatatcccttttgaaagcaacccgtatatagtgactttgggattggagtgtgacctggcagaggcgacacgcacaaggcaggggtgatcgatggtatagtcatatatacacagtatacaccttcacacgcggggcctgtgttcccggggcaacaaccgaccctttaattcgggcggcattgggcgcccttacctttggaggagactcccccccaaaggacaccaccccacgcagcagccatttgcgacccgggacacaattgggtctgcttaccaccccacaaggtcttccaaagggcccgtgggggcgcacttttgtgaccattcacagtgcagacaacaagataacagcacatctgcactacaaggctctgcgggccagaccttggacagttacttgcgcttggcacccatttacaacaacgaccgcacacactggcaacctatcacccgtagtgacctaccagggggaacctacaggggagccgctcccgacacgaggttgtcaacagcgcgacagaaggggaacaaccgaggaaaccgctacacttcacgagccgcgaaccacttacaacgagaaacccgcgagttcggaacaccagcaagcgggtcccacgggataagaacacccaacgcagacggaaacgcgtggcagcaaccacgacacatacaacggtgccccaccacccaggtcagcgccggcatcgggatgacacacagcacgagcagcgcagatcgatcaacgaagcaaagacaagagtagacactaacaaagccaagtgagcagacaacccaccagccacaccacgtctt

SEQ ID NO: 582188 - DNA, 406 bp, Homo sapiens
gaggatgcaccacgactgcaatgtgtgtctaaggcagagcccagcttatccgtgtgcacccatgtgccaataagacggtgggcaaagctacaaatggcaagagaaaaatgggactattaatgcgtgtggaaaaggccttaatagttaagtgacagctaaggatgtcatgtcttgggttagaattttcatttttagcaccgttaatgtattcacttaaatctatgttagcaccttgtctccaggcagaacaacaaaccatccaaacattttaaacattgggggaaacacgaaggggagggttaaagagagaatccggtaccgtggaaggagtggatttagatcacaagatccttgtcgatatccttctgcttgatgccgaagcagccggcccactcatccagggcga

SEQ ID NO: 582189 - DNA, 118 bp, Homo sapiens
ccaacgctgctcacaatagcaaagacatggaatcaacctaaatgtccatcaatgacagatcagactagaaagagtgtggtacatgccagagatcaacatataggaaagaaaaggtggt

SEQ ID NO: 582190 - DNA, 101 bp, Homo sapiens
ggcacgagatgccaccctctccgtaccatcagttggtagagatactgatgagacctattgcattgacaacgagggcctcttatgatatctgcctcccgcac

SEQ ID NO: 582191 - DNA, 897 bp, Homo sapiens
agcgtctgttacggcccggaattatgggatctccgcacaacaggtcggtgcatacgccatttgtgacgagtcttcgtcggggactggtctccactgggcctgaaggtcaggatcatggggcccaacatatacccctgggaacgaagcgaggagctctacctgaagcctaagtccagagaacaatcttgatgatgggccgcatacggtggtagacccatacgagagatgttgccgttgtgggaaacattgtgggcctcgatggcgcgtgtcgaccagcttcctggttgaagacgggcaccatcaccaccttcgagcacgacgcacaacatgcgggtgatgaagttcagcgtcagccctgttgtcagagatggacgtggaggccaaagaacaccggctgacctgacccaagctggtggaggggctgaagccggcatggccaacgctccgagcccatggctgcagatgcatcatcgaggagctcggcgacgacgcacactcatacgcagtggcgcccgtccgaagacatgcaacctgcgacgattctgccctgacacgggacctctggcaccgacggcaccaccgcactgccactcacaccaatccaacgacaatcttgacacccggctcggatcttccgcttcacccgccagcagaatcgggctccagtgcagacgatgatcagcaaccacgcttgcattcctggcccgatcttacccaaagttcccgccaaccaacacccaggacgtagcgagacacgtgcaccttgtattgcccaattgcaacaaacgggcacgacccggccccccgtctcccgctctgcaacagatgccattgggacccgcgtccggcgcaaccagtttccgacgttacacacgtcgcacttcaagcgagctgtgt

SEQ ID NO: 582192 - DNA, 200 bp, Homo sapiens
gctcaacagtgacagaggtaccttaggatccaagcacaattctgaacctgaaaacagaatagtctgtttatgcataaatcctaaaatattttcatttcacaccacttgtacccatgaggcaaaaaatttaccatagcagcacaaataggttaagtaccaggcaactgtgccacataatcaaagctttcaggccaaattca

SEQ ID NO: 582193 - DNA, 398 bp, Homo sapiens
tgagacagtcttgtgctgtcacccaggctggcatgcagtggcatgattcttggcttattgcaatctctgcctcccaggttcaagagattcccgtgcctcagcctcccgagtagctgggattacaagcagcctgtcaccacaccggataattttggtatttttagtagagacgaggtttcaccatgttggccagactggtctcgaactcctgaactcgggtgatccacccactttggcctcccaaagtgctgggattataggcatgagccactacacccagcctagttttcctttttcaaaaatgattgtgctataaggaatcacattaaaattattaaggaaggattcatgttttaaagttttctttcaggcatttttaagcacccttcaaaccttaa

SEQ ID NO: 582194 - DNA, 158 bp, Homo sapiens
aactttattcaagcatgacttttaccttctagaaatgaaaaaaatgacaatgaaagtattttcactaagtctgaaagaagcaaaaccttctcacccaaatcttaaaagcactctgatggtttggatgctctgtgatctgttgccctctagaagctaac

SEQ ID NO: 582195 - DNA, 99 bp, Homo sapiens
tcaagcttctaacgatgtacggggacatgttttgaagcagcaggtccaggtcactttgtatatagaattttgctgtattcaataaatctgtttggagga

SEQ ID NO: 582196 - DNA, 899 bp, Homo sapiens
  misc_feature (87)..(87): n is a, c, g, or t
  misc_feature (899)..(899): n is a, c, g, or t
ccggagcgtgggctagtggggcaaggggtcaccgagcgcggccgggcggaaaggggccatggccagtgcaggacaaaagttcccttnttgtgggcaccccggtgtgaccaatctttgagcaaccggttccccaaaggggtggcgacaggcaaaaagccctcacaaaaccggggggtttgggcacaaggcggttagtgagcacaccccttttgggggccgacgcaacccgcggggccaagggggccagaatttccggaggcgaaaagctggccccatcttgggccatatgggcccagcaccccccacaaaaaggcgggcattgtggtgggcagcagagcggtagagaacggtcccccagtttatatacccgctccgacacgacgccggccggggaggggggcgcgctgattaaaactgtttttacgcggtgtttattaaaccgtctttgtggtggccaaacagcagccgggctgccgtggggcccccccttttttgcgcccgcgtttcggggctcggaccgacatcaacgacacgcccgctttttaacaaacaagcgcgggccaaaacagggagaaacccccccggagggggggcaaacgggggacaaaacgccgcctcatgcaaaaccgctaaagggggcggaggccccccccagggggggcccacgttttaaaaaaccggcaccccccttttaggtcgtggggacgagctacatcgtcgtcggcgcacacacactgtacgagcggcaactgacccgcaggcggaccacggccgcgcacacaaccgcgggcgaggatattccccgccaccaccagatgattccttgtacggcgccggcgagccacaacgtcactgagacaccacgactgaggcgcgtcccaggcggcccacccaccctn

SEQ ID NO: 582197 - DNA, 190 bp, Homo sapiens
gagaaggggtcagtccgtaaaagggcagaaaagaattccaagtgtgggaagagctataaaaggaagaaacaggcctggcgcggtggctcacgcctgtaatcccagcacttttggaagctgaggtgggaggatcacttgaacctagaagtttgagaccagcctgggcaacatagtgagaccccgtctctac

SEQ ID NO: 582198 - DNA, 183 bp, Homo sapiens
agcagatgatcgagctcggtaccttactcttagctgtaatgtttaaatatttttataaggagatgtactcacatgttacctatgtaattaactacaaccggaaaaaaaaaaccgaaaaggctaaagaaataaattgctattcttcccctttccaggctccttgcagattaccaagcaaccccg

SEQ ID NO: 582199 - DNA, 112 bp, Homo sapiens
ggcagctgcagtggtgccttctggagaagagcagagatacagatgccatgtgcagcacgaggggctgccggagcccctcaccctgagatggggtggaaaaggagggagctac

SEQ ID NO: 582200 - DNA, 1121 bp, Homo sapiens
ggaatcaccatgggcggctggtgaccctgtacacagtatcctgaaaactggagggccttcaaggctctcatcgctgctcagtacagcggggctcagtgtccgcgtgctctccgtaccaacccacttccatttggggccaataaccaactcgcagcgccactgaatttctccggcaaagtttcctgtccgggcaaggtcccagacatatgagggtgatgatggattctgtgtgtttgagagcaaacggccattgacctagctagtgtgagtcaatgaggagtcatgcggggaaggtactccacaggcagcacgacccaggatggatgcagctggggtgaagcgtttgctcgagttacccaatagtaagtgtacccacaggcaagtatctggatgttccccagcttgggcatcatgcaccacaagcaaacaggccactgagaactgcaacaggacggaacgtgaccggcgaacttctggaggctgcctggactgcttaccttgaaagaccgagagactaattcgtggtgcgggcgacacgaggtgaccactctgcgctgcccctcagcaggttgctctgccacccctgtgcgagtaggctacgtcatgaaagagcaggggtatcctaaggagccctgtctattacgcgcacaaggggctattactctccgcaatgatcaagacaggctagaggtctcactaccaacctagacaatttgacactcaacggcccgccaagtataccgagggcatggaccttctgagcgaggaacacgctggacgacagcctgctggctgcacagacaacggcactgcggccccccaccccatactggcaacacgcccggagagcagcacagcatatccaggcgacgaccacggacaacccgcaacagcccttacacacaacaccagcgaaccgaaccagcacacaccggggcaacacagacagacaacagcgatgatcacaccacaggcgacatacacgacacgcacaacggccacgaacacgaacgaccccacaggcccaggaaccccagggacacggggacacgtaaggacaaacaaccacagggccagggcaaggacaccctgaccaactacacctgcacaggcacgcgcca

SEQ ID NO: 582201 - DNA, 258 bp, Homo sapiens
cggaaagcttttgcctaaaatgtattctcgaactcacgtatcataagcgtgtacggtccgcaggataggcaactactcatcttggtacgtttcgcaaagcgtatgtagacatcaaccaagtatgacgtaagttgctgcaggtgacttccaaacgtctcgagcgcctcagacacatgtcctcatcctttaagatgtcactaaaatgtcattcttcacctagtcccatctctgtttctgtttctgtgctcctgacctgtg

SEQ ID NO: 582202 - DNA, 1130 bp, Homo sapiens
cacgattggggtcacagccttctaccaagatgatggccaggtggagatcctcaagagtgcctgccatcaatgtcaaatgactccgtcaagcaagagactaagtctcgacaaccatcgtataggtctgcctggtgagtccctcatagtatggcatctaacgccgggccaccggatgtgatgatttggcggcaaggtagcggtggtatcaagctatggtgatgtgggcgcgggctgtgcccgagggtctgcggggtaactggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccatgtgtgtaacatggacactttgacgtggagatcgatgtcaagtggctcaacgagaacgccgtggagaaggtgaacatcaagccgcagtggaccggtatcggttgaagaatgggcgccgcatcatcctgctggccgagggtcggctgtcaacctgggttgtgccatgggcaccccagcttcgtgatgagtaactccttcacaaccaggtgatggcgcagatcgagctgtggacccatccagacaagtaccccgtggggttcatttcctgaccaagaagctggatgaggcagtggctgaagcccacctgggcacagctgacatgtgaagttgaccaagctaacctgagaagcaagcccagtacctgggcaatgtccctgtgatggccccttcaagccggatcactaccgatactgagaccgccaggtctgccgtttcaacctccagctgcttgtccattgcccaggcccaacctcatactcactaagagctaatggcaccaatttgtgactggttggtcaggtgtcccccatcgactctctgggggctgatacacttagttatggactctgatgcaggacgccataactgtccaaatgtggccgcggaaacagagtaccctcttaagccccggtcattgatgggaggtcccagccaaaggggaaccattgagctcaagggggacctggcaaaatag

SEQ ID NO: 582203 - DNA, 490 bp, Homo sapiens
  misc_feature (31)..(31): n is a, c, g, or t
  misc_feature (132)..(132): n is a, c, g, or t
gtcggcgtgtgacaacaggcgcccagcttcnacgcgaccctgctcgcgtcgaatcgcggcttccagatcgctcagctgcttcggctgtaatatgtcgctattccagccgaattctgtcagcatcagctcaanatccagtcctttgtcttccagcagaaatcgttctacacccaatgctgcaagatatcgttcttgatgtgcgctgcgacgcttgattttgacttgtggctggcgtgcctgtcgatgttccacccgtgcattcgatgcatcatcaccaatttccacagattcaactgcttgatctgcaggctggtcactggactccatgacgctatgaagctcttcgggaggctgattctctgaatgcgctggagactgtggcgacctaatttcgactcgcggggggctctctctcgaagcgctctcgtcggcttccccattaagtggagtcaagggtctctcatctggcttcaatcgtggctgcggccgc

SEQ ID NO: 582204 - DNA, 204 bp, Homo sapiens
cgcgagcgccacaagggatgcacccaccttggtctcgcaaagtgctgggattataggtgtcagccactgcacccagcctaagttggatctcttgaatgcaaaaaggttcaataggaggcaacagaaaaccttttttcttttatgccaggaacacaatacagtgctacctagaaccaacattattttatgatatagcgtgcattc

SEQ ID NO: 582205 - DNA, 559 bp, Homo sapiens
tctgttcttctcctacaggaatacatccctgtcctttcggttgtaactattactaaaactagggctatgcaaatgacctggttaccatgtaatgaaccttgtgtacttattttgagagaacaatatgtataggatatgttgaggggcagaaagaaagacatcaaaaactggaactattttaggtggcaaattgtaacgcaaaaaacaaaagtataccttattttgtatacgatgtacacttgggacagagttttctaatatgttgccaatgtttttgtagtgtcaccacaggtcttttctgaagtgtttttcccatttgttatagagtattaatgacttagcgtaattaagccctcaagtatgtgtgagagagcgcgtgtgagaaaatacaaagccatagatattgatttacttcactgacctgtgtaactttatgtctgggtttcgccatccaagatagattgttttatagagagtgtcaccaaagactttttccttccaatttatagaagaaaaaaaaaagaaattattaataaatgacatgacttttcaaaaaaaa

SEQ ID NO: 582206 - DNA, 1022 bp, Homo sapiens
gcgattcgtgccggccggtccggggttctccggtcccgccgtctcccgcaggagccatgtcggtcttcccggtagctttactttacacgtggacaatggctacttggagggactggtgcgcggacctgacggccggggtgctcagccaggccgagctaccgtcaaccgtggatgcaggtgcgagacgcgtagaggacgttggaagacgtgcatctgcagagcgactgattgatggtacacttgcctggccacaggaggctatcagctctgacggtgtcagttgcatcgagtgaccggctcaaggacgaagatggcggtgggagttccgccacgatgaggaacgcagtgcctatgagccactcgtccagacttccgtagacttcagttgactgtactagttacagtgactcggacgaagcgtgatcctgctcatcgacaggcatcgcgtgcatccgagtcgctccatcgcgtgagctcgtgcgccaagttgccaaccacgtaggcagcttcgagcatgatgggaggtccgtgaacattgctgcagacatcctgctgaggctctacgagaggccattctggtggacaggcctcttgctggcttatgtccaggatcggcatttcagagcaggaccttggacgagatgaacatcgagatcatccgtgaacatcctctacaaggcctaactgggagtccttctacaagttctggaccctacttgggcgggactacggttgatgccatgtggccctattctgggaggttcggaagcaggacgccgcgcccttccgtcatcgcctcaattcttacgggcagaagctgtcccaagagcgcctggcagggcccctattgcacccggaggggggggcaaacccgaagggccgtgggcacacttggtcggacagaagcgaagacagcgccacacacggcgcgaaaaaccggagcacaagcgcgcccacgagagggaaccacccagaaaacacacgcgaagcttagacacgaaaacagacgcagcgcatgacac

SEQ ID NO: 582207 - DNA, 454 bp, Homo sapiens
tcgacgaagcatgaggaggagtgttggcaaatacagatagaaaaagcacaaggcgcacaggtgccaatgaagatgaagtgaccaggaactgaaggggtcgtggttatgggtagtgggaaagggttaaagcagtggagtgtgagagtaagcagtggtcagctggggtcagtggcctagattttcattctgaatgcagcgggaagcctgacatgacccttgtacctccttcagggcatggaaaatggtttctaaggctcctacttaaagcttttcaagcatcagagaatcctcttaaaccagaggagggatatgatgttgacagagcaggtttactccaaaagtcggcttgaggtcaagtcatttaatcttcttactctatatgggatttggaacagaaagggaagaagcagagtcctcccatccatctgggaattcacccaggctgcttccggtc

SEQ ID NO: 582208 - DNA, 171 bp, Homo sapiens
tctgccgatgacacacagtcagcctccgacgagatgaattcaatctgtcaccagggaaatgcagagcccaagtgccacgtttacccaaatgtacggccacgagcgaaaacgtctgtccaggtctgcactggggaggacggtgtgggtgacaggcctcccatccactgtccc

SEQ ID NO: 582209 - DNA, 285 bp, Homo sapiens
aacgggtgatgcggttggtgatgaacaagatggccaggatgctgacactaccagacgatcagaacactgcccaacaggaggagacatgcaatatctgtatgcaggacaaccactctgatgagggacttcatgagcaacactaacgcatgcatgtccgactggctgaaatcggctccgcagacactattgatgaactgctcatgcgtattacgcactcagacgaacgtagccatgtgccataagcagcacatgtgacagatcatgatgcacttagcaaacttgcta

SEQ ID NO: 582210 - DNA, 172 bp, Homo sapiens
agactatacgcccctgcctgcaggtgctcacacctctcttcagtacacgctcaaatttggaacagagggaggacatccggctctaatggatgtctgaccgacattcacatacacattttactgcagactactttttgacacactttaccatgtagtagtgatatgcatgcag

SEQ ID NO: 582211 - DNA, 1872 bp, Homo sapiens
  misc_feature (1)..(1): n is a, c, g, or t
  misc_feature (282)..(282): n is a, c, g, or t
  misc_feature (305)..(305): n is a, c, g, or t
  misc_feature (426)..(426): n is a, c, g, or t
  misc_feature (637)..(637): n is a, c, g, or t
  misc_feature (1252)..(1252): n is a, c, g, or t
  misc_feature (1526)..(1526): n is a, c, g, or t
  misc_feature (1673)..(1673): n is a, c, g, or t
ntcgtcttgcttgttgtgatgtagctcctctgtcctgggtactcctcttgatggggaagtatgatgtttggcagtcacctcacatacgcagcacgtggctgggtttcatccatggcttcagtagccgtgtggtatttttctgtccggaagagagagctgcgctggacctgcttgtttggctcaaccgactgtatcggacagagtgttgtgtgtcctcgtggtagaaactctcccgcggggttggtttgcctcacacgtgatacggccactccactacgatgnacctccctgcctcgttgtcttcncgagaggctgtgttaactgatacttgccctaccttgcggtgtctcttttgcgcacgcctgtcgatgtgcttacatccggctcgggctctacttccagtgacgctcgctgtatctggatagngctcgatatgttgccgaccactcaccacattattgtgcggaccgtcagctattgtgtgttttcaagacatcgacacagtagcgtccacaccacagacgtcggttccgcgccaaatgtggttcggatatatgtccctgttctatccaatgggtgggtgggtatggcgcctctttgtcaccgcgcgttatatggttggggcggccgtgtgatntgggggggcacatgagccaactcaacgagaacgcccatcctggtggggcgcctgccacacagggtgtgcgtctctcgctgctgtgtgctcctctttttgtggagcctcctcctctctgggtcgtcttttttattagtgtgggcctctcactcggtctctcaccttgtttgttatatatatgacccactactatcgtttgaccatctatataccctacggctcaaaatgatcttgttgcggtagtagttgaattgtagtattgtattctctccctctctcggggtcctcctacctccactggggtctttatattgcttttcgtcggcggagagatgtatattcctgcacaattggtatatagtgtagtagggagagtaatacactttgtagtaagagaatagttcgtggtcacaaaactaggtccacaagggagagtctctgtgtctctgtttgagagaggaagaggtgtgaatatagtcttgtgtgcttctctttcacaaagcccccctctgtttgactctctctagatatagagagggagagagtgtgtgacgacacacaacagaggagagagagagttactacaacacagagatcctactctctcttttgtcngagcaacacagggtctctctgtgtcacagagaagagtgtctgtgccacacacaggcacacagagagtgtggagtagagagagttcacacactccctcttgagaagagtgtggcccacacacctctggtgtgaaagggtcgcgacacgctgcggacacacacagtgacacacagtgcacacacaggcgccacagtgcacacacatagaaataccacagaaggcacgcgggagaggagatccctcctcacacgcacacagggggccgcaggggctntgaggaccacaggcacattcaccgggcttatatgacccgcgggagatcgttgtcgggagattggtcgggaattcggggccacatgtcccggggagagctgttctgggaggtgtgcgggaattctggggccacatgtcccggggaganctgttctgggaagtgtgcgggaaaatggggggcacatacccacatgcctgccgctctgggttctctgcgctgaacacacctggtctgtgcaccctgtgttgctcacccattgagaaaactggagcaccttttgtaagtataataatagagaccctgtttcccattttaaatttatccaaaatggaattatcctttagaa

SEQ ID NO: 582212 - DNA, 436 bp, Homo sapiens
  misc_feature (436)..(436): n is a, c, g, or t
cgatgagtctcaagctgccgcccgtttggcagaaatcaacagcctgcaacagcgccagagcaacatcagcgccgcccagatccgcatccgtcatgatctgtgtatggcattgtccattgatgcggaggcattgcctttcgcaggcgaactcatccaggtgcgtaaggaggacgcacgcaattgggaaggcgccgccgagcggttgctacatggctttggcctcaccctgctggttccggacgcgcactacaaggctgtcgccacgtgggtgaacaaccagcagttgcagggtcgactggtgtacttccatatgcgttcacgcaatacgacgcatgatgcggcgttacatgcgcaggcgctggtacacaagcttatcatcaaaccggagttaccacactacacgttgctgcaacaggaacttcagcggagctgctan

SEQ ID NO: 582213 - DNA, 954 bp, Homo sapiens
  misc_feature (263)..(263): n is a, c, g, or t
gcgctgctattttcgcccgccgatattacagaacctcttgttagaggtgtttatgccggggcaattccccctcggtaccggcgtgttggtcccttcttgagggcacgcgcaagggtgcgcaattgtcaaggcccaagggcccgcgtaccattctggcagtggtatatcagctccatcatgtgacgtgcgctcgtgcgaaggaaagaattgttgtggcgaagcgcgcccccagactgtctagtagcgtacgggtgaagaaactnccatgtttgggtgtagaggcaggcgtccacccctgccgggacattgtggcgcgcaaatgcccgtgtggttttattgacgcagaggccacgtaaaatgagtgaggacaagcacaacctgccttgggagtggtcgggtagtctataccggagtggtgtttttatagctcccagcctttgtcgcgagaatgcgcgctgagaagttggtaatgtgtatccgcaacggtggggggagaaacgccaacgttgtgtggcgcaaaagccttccgccggagtgttttcttctaggcgcttaatacgccgctgcataggtcacgcccccgactcccttcggtgggtgaatccactcccccactgtgggatttatccgcgccgctgccaatggccttttttcttcctagtcgagcttgttgacactcactcctgggcgcccaagttcttcttaggggttatgcgcactctcaataagggtagataaagaatgtttcttgggtgctcgacccctgcagacaaaaaatgggtgtagttataagatgactctgggcggaaaaagttcgggtcacattcctcttggtgacacttcattggtatgaactcgcggaccggagatctaggcgcccaaacgcaaaggagaaggggcatttctttttatttcaacctacccagaacaaaaacttgtgaccgaaaaaaaaga

SEQ ID NO: 582214 - DNA, 246 bp, Homo sapiens
caacgatggtcctcagactactctgggaggtgaggcaggagaacctctgcttcccagattcaagcgattctcctgcctcagcctcctgagtagctgggattacagtcacgtgccaccatgcccagctaatttttttgtgtttttggtagagatgggggtttcaccatgtttggccaggatggtctcgatctcctcacctcgtgatccgcccgcctcagtctcccaaagagctgaggaccatcgttg

SEQ ID NO: 582215 - DNA, 100 bp, Homo sapiens
acacgttacatggtactgaaactttagagggactcctgcactctcagacatcacccattactgttcttttttttgttttttggagatggagtttcacgct

SEQ ID NO: 582216 - DNA, 1157 bp, Homo sapiens
gtccgccctgcctactactaaaaatacaaaattagccaggtgtgctggcgcagtgcctgtaagtccccggctacccaggaggctgaggcaggagaatcgcttgaacccgggagacggaggttgcagtgaaccgagcacttgcgccacggcgcatccagcgctggcgtgacgagtagagcaagactgacgtctcagagaaaacaacaacaagaccgcgagaagacccacaagacaaataacaaaccaaaaccaccattggggaaacgctttacgtgcgaggcccttcatgtcttctggtcctggcttcctctttacgctcctacgctcttactgagcacatgtttcaaagccccaattaggccacactgagcttttagtcctttgttgtatcaataccagcatacaacagatctccaccgttcacatcattcaccaccaccagcttctcgcacatattcccttccctcctcccctccaccacaccgccaatttcccgcaggaacacaccattcaccatttcctccaccccttgccgattcaaccctccgccaccagcccagcaccacgcacacgctgcacagtccaccaccgccaccctgtcgcccactgtcacacacggccctcacacctgcagtcccaggcaccaccccaagcagccccccacgcaggctccgacccccaacccctccctcccccgcctgcccacacaaaccaccagccatccagcagccacaaccaccggcacccccaaagcgactccacccctcccacaccaccgccctcagcacactcccctcccacctccccgcccccacaccacacccccccccaccccagcactccacgcacacgacagctccactcctcaacaccaccgcgcgaccactcacacacgcccacgaccctctcgcgccacgcaccactcaccacccccaccatcggcctcaccccccccctcaacccgcgccacacacaaacagcctccagcaccccacccacaacccccaccactgccgcaccgccgccagcgtcccccgccccagggcccccaaccggcatgcagccacgcctccaacaaacacgcagacaacccaaccacagccgccaccagcaggccatcccaccgaccgccccgacgacacatcgcgcccccatca

SEQ ID NO: 582217 - DNA, 406 bp, Homo sapiens
  misc_feature (96)..(96): n is a, c, g, or t
ctgtattgcccaggctggagtgtggtggcccaatcacagctcattgcatcctcaatcacccaggcctaagcaatcctccccccttgtaggtggggntacagctcccagcgcacctggctaaaattttttttttgtttagacggattttttatttggcccaggctggttccaggctccttggcttaaatggtcctcctgccccagctttccaaaggcccaggccaagttttagctttgtcccttgccctcatgccccaccaaaggttttataccctttaatgaattgactttcataaattggttttgttggtgggccagtttttttagctggaaattgttaattcctcctgaaatgttttttcctgccgtttcccttaacttattctcccataaaggatggttttgg

SEQ ID NO: 582218 - DNA, 223 bp, Homo sapiens
gagcaaagggcgctgacccgtggggcgaggtacggacaagatggacatgatcctggccttgagctgcgaccctctggccacatggtgtgtgtgtgtgtgtgtgtatgtgtatgtgcatgtgtagtgtgtgtatgtgtgtatctgtgtatgtgtgcgtctctgtgtatgtgtgtgtatgtatagtgtgtatgtgtgtaggtagtgtgtgtaatatattcgccta

SEQ ID NO: 582219 - DNA, 149 bp, Homo sapiens
cgccggactgtacaggattgacagattgatagctctttctcgattccgtgcacggtcgccactacgtgtcggccacgtggccggacacgtattgccgacacgtccggacacgtcccatcgatgaattcgagctcgaattacgtgtccgg

SEQ ID NO: 582220 - DNA, 701 bp, Homo sapiens
gcacgaggctcctgtcgaaataggctagtgatgaaggggggcaaaaaaaaacaagcaagttctgaagttcactctttgtattgcacccaccctgtagaagatggaatcatggatgctgcctattttgagcagtttttgcaagaaaggatcaaagtgaacggaaaagctgggaaccttggtggaggggttggtgaccatcgaataggagccagtagcaagatcaccgtgcacattccgaggtgcctttctccataaaggtactttgaaatatctcaccataataaattatttgacatgatagaactaatctacgtgtactggttgcgcgtagtttgctaacctagcatacagagagttacgaatttacgttacttccatgattaaccatggacgaacgaagaggacgcgaagacgacggagttacatttcatttatctggaacacttttgtactgagtttcttgaattaaaacttggtgaaccaatagcaaaaaagaacgtaaatacaaaattaggacacaatccgtgggttctcatttatccctggtggcccgggccacacgcggctttcgccacgtggcggcagtgggctcactagctggtgcccccagacccggtttgtcttcttcactgtgggttgacaacgtgccgagcttgccgcttgggggctctgttgttcgcttatccctggtccccgtaacc

SEQ ID NO: 582221 - DNA, 292 bp, Homo sapiens
ggccgacctgcgccgccgcgcgaccaaggcgctcggccgctgcacgcagaaggacaacatccgtttcgacgggctgtcgcgcgtgtcgcacgtgaccgacgcgaccgactggcgcgtcgaatacccgttcgtcgtgctgacccccgatagcgaagccgagatcgccggccttatcaaggcctgcttcgatgctcgtgccttgacctgtgatccctgcgctggcggtggcaccggctacacgggtggtgcggtgccgctcacgccgttctccgccgtcatcaacaccgaaaag

SEQ ID NO: 582222 - DNA, 131 bp, Homo sapiens
taccttacctccgccttagcttcatccgggctgctccgcacggactcggcctccgccttggcagtcccggtgctctccacggccatgctcagagccctccagctccaaaagtcccttggcgagctttctcg

SEQ ID NO: 582223 - DNA, 645 bp, Homo sapiens
accacgcgtacgcccacgcgtccggaacaaagaaaaaaaaaaaaaacacatttaccttaagaaaatacagacaaaaaacgaataaagtatgtgtcatatgctccatttggagattccaaatgcgggccggggcgtggtgggctcacgcctgtactctcagcttcccaaaatgctggaattcacaggccatgagccatcacgcctagcctactctctgaattcctcaacaagtccagaaggttgaccaaaaaagtctagaaaactgggcttacaagtccagtaaggggcacgtacttatcaacagcagttcccagatggttagcggcaccgtataatcgggataggacacaacgataaactcgtgacgcatatactgtattatacaacgtgacctatacccaacatacgtagcgacactcggtacaacctaagaactacgaacaaggtgcatactcgtgcgaagcatatcatcatactatatatagcaacagatctaaataaacaaccaacagtaacttagaatagcgagaccttacaataaaatataagggagcgccgcatccaagatcgcaagaaactgatagagtgacaccagaggaaaatcaacgtactattaacacacacatatccacatatgggaccaat

SEQ ID NO: 582224 - DNA, 728 bp, Homo sapiens
gaggaggaattgacaatgggcatgtcctacgtgaatgatgagcatcttccgaatctacattacagagaaaaacttagtgccggtgggagcacgcgcccagcgtgtgctccgtgaggcgccccgtaacatggtgcacctcaatgtgatctgcgatggctgcaatgggccgtgtggtaggaacccgcctcacacaggtgctccgtctgtgcagacctagtgtagttgtgtagcgtctgcgacggaacacgggcttgctgcgggggcaattcctagctcgcattcccctagcccttgttcgggcacctgtctgagggcttctcgccactatgccgctggtttcgcgggacggtgaatactacgggcccattttcggggtgtccgacggatgttgaagtgtcgtcctgccaggatagacctggagccgcacttttctcctcgtcgccagtgctgaggctctggcctggggccctggggatgaaactcacgttcttctggctgcactcggagggatccgggggtgtgcattttgcctgagagaatcgttggtgacaagtgttggccccgtgcccttggtccttcgtgggcttttgagcggttggtatcggctgtggaccacgggttgggcatggcaggcgcccctgactcccgggttctccagagagttccgagcactggacggagaagagccggttgcccgtccatgcaccgtgctggcctggccccagcaa

SEQ ID NO: 582225 - DNA, 400 bp, Homo sapiens
gcgcaggggttagcatgaggtgagttcgaccaaccggatgtattgggagggtctggaaggcccgttatggcagttgcggtcggtcagcgcatcgcggcgttgccggccgctccgcgggaagacactggtggtaatgcgacttaagacaatttagtcatgccgtcgctgcatcacgtcccgtcgtcgcattgccggatgatggtcttcttcgctgtccccaacgtctttcggacgtcgagaagtgaaaacgtctcctgggtctgatacttgggaaattccacgacgaaggacttctgcttgctcgcggccaaggcattgacgagctctctgaagtcccattggttctggcgtcgttcggctttgaactggcttccatcgagaaggaaggggtgttcttgcc

SEQ ID NO: 582226 - DNA, 140 bp, Homo sapiens
tgactggctgctcaacaacagaaattatttctcagttcttgaggatgaattcaagatcaaggtgcagtagattttgttgtggtgaggtacccccttcctggcttgcagatggtcaacctcttgctgtgaaggctatcagc

SEQ ID NO: 582227 - DNA, 891 bp, Homo sapiens
  misc_feature (384)..(384): n is a, c, g, or t
gggtacctagctgctagccggtgccttggaccctaccccctacgcttctacgttctactagccccaggagcccggcgggtccgggatctcccgtccgtgccggtgcggtgcgccagtcatagtaggctagtgggatgaccaagaagcaagcaacacaaaaggcgccctataacaacccaaaccaaactagcgaaagaagatactaactaagataaaccacaaaacctcgagagacaatatggtataccactcacagcaagtatgcccacaatcatagtcgatcatagacggaccatgcatttgagattggggttctaatgggctcggttatagcattaatctcgctaagcttaaattaagggacaagctccctcatgttagccnatcttaaatattgacccatgcgatcccctaccgaaaaatgctaggtgaacccaggagacgaacaacttctgagaatacggcactgcaaaaaactaaaacgcccaggatcataacggtaatgcaaactaaatggacgaaaaaatacaacaccaaaagcaaaaacttagggattgatgcccaaaaagaaattaagacaccaatcaagggacgaaattgaaaagcctgaagcacgaagaaagatacagcctttaataagagcgctgagagaaaaaatgatttaaattcttgcgaaaaacgaattggacgcaaaaaggccagattgagtaactataattgggaaccgcgagagttagatctacactaaaacataattgggcgcatgggtaccccaggcatttaaaagccattttgatcatccgctaaactaaacatgatcccctagagaaaaggcgttatggccccaatcctcaagaaatatcttcagtgaaaaccaacgagggccaaatc

SEQ ID NO: 582228 - DNA, 85 bp, Homo sapiens
cctactctctagggttattgtgaggataaaaggtgatttgtttacataaagtacctaatagtatctgggctatcgtaaaaaaaaa

SEQ ID NO: 582229 - DNA, 350 bp, Homo sapiens
ggatattcaaaactacgccatagaggcctacatcctgagggtcaggtacattggcggttgctgtggatttgagccctaccacatcatggcaattgctgaggagctggtcccagaaaggcgctttgtgccaccagcttcagacatggcagctggggaagtggtttggacatgcacaccacaccctgagttagagcaagggccaggaacgaatactgggagaatcttccgatagcctcaggccgtccatacagcccttcaatgtcatagccagatggctgcggagtgaccaaaggaacagtcgagctgatgcatcagactgaagccacctgagcagcagctggagctctctg

SEQ ID NO: 582230 - DNA, 151 bp, Homo sapiens
  misc_feature (127)..(127): n is a, c, g, or t
ggcatctccacagcttatagtttgataaaggcaaatacaccattgtgattatacactgatttccatcacctgcctttttactatcaactcttattagattaaaaggaaggtgatggaaatcagtgtntaatcacaatggagtatatgggca

SEQ ID NO: 582231 - DNA, 114 bp, Homo sapiens
gttgctgaggtactcagaggatcccttagcacgaattatcgcgccggtgctgcggtttctcggtgaggcggggaactctctatatcggtgatctgcgcgtcgatgccctggctt

SEQ ID NO: 582232 - DNA, 254 bp, Homo sapiens
gagttcccatgcttgaccgctgaatatccctcttaggaattccttgaggacagagactctattatcttatattttgtctttttctattatgttttttggagcctgtctcccaggctggagtacagtggcgtgatcttaactcactgcaacctccaccgtcccaggttcaagcaattcttctgccgcagcctccagagtagctgggaattacagacatgattcaccacacccagccagttatcattttttataat

SEQ ID NO: 582233 - DNA, 270 bp, Homo sapiens
  misc_feature (110)..(111): n is a, c, g, or t
  misc_feature (115)..(115): n is a, c, g, or t
  misc_feature (117)..(117): n is a, c, g, or t
ttgtttttttggtttttttattgctcccccaaatagaaatttagggcccccccccccctgtttccccccccgttttttttttggggggaatacccccttttaaggggaannaaanancccccccctttctccccccccctataccccccccccagggtgttagcttttggtttttggggcccggccccccgggggggttacttagggggttttagggttgggttttaaaaaaaaaaaaccagggggggtttgtgggcctttttcttttta

SEQ ID NO: 582234 - DNA, 233 bp, Homo sapiens
aggatcccccatcaaatcataggaaatgcaacagatttaataagaagttgatgcctctcttgtatatcgtgagctctggataagagcttcccagccacccttagtcttccttatcttaaacctgtcttatgctatttagcaagctaattggatttactgtcttgaaaaggcttcttgtcattgtcttctacttcacagttcttacttgtgtctcttttttttttggggccccc

SEQ ID NO: 582235 - DNA, 376 bp, Homo sapiens
cgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaggaaaaaaaatccggggatatggtcaatttcccatttcttggttaaccccgttttccctgattttcagcctgtagctatgggcctggggactccgggtcaaggtggccccccggggatgggcctaccaggg

SEQ ID NO: 582236 - DNA, 213 bp, Homo sapiens
gggccccccaaattttttttttcccgggggggggtgaagggatttccccccccttttttttagggggggggtcccgccccccgggggggcccggttccccgggttttttgggggatcaaattggggggttcccccgatttttttttttaggggggggggtttttacccggccccgctttcctttttttaaaacagaaccaggtttcaaattta

SEQ ID NO: 582237 - DNA, 127 bp, Homo sapiens
tagaggatcccccatgtgtctgagacggtgatctaagggccgcggcctcctccacacacacacacacaccagtggaaccaatgagaaccacgtagaaatcctcagaagcgtgcggaccatcaacctt

SEQ ID NO: 582238 - DNA, 334 bp, Homo sapiens
aaagggaaaaaaaagtttattggatttctaaatttaataaagtatttgcaacttttttacaaaaaaaagaaatttagtttccattttcattcttatagagcattgaaaaaacataattggtagaaaaaactgattgaaggtaaataaaaaaacaggttttaatttagtcggatattgcctaaccccaaaagaaaatccctaactcacttgcttataacagattttattttcttattttcatactgaactatgggggctattttggatccatcagggagggtttgtaatgtagtgaataaatgcattttgctaagaatccaggaaaaaagagaac

SEQ ID NO: 582239 - DNA, 551 bp, Homo sapiens
  misc_feature (333)..(333): n is a, c, g, or t
ttgtagtagtctattgcccttaatatcttcacccacatgtcctgtaccctgccctgaaccctcctcctcttttgttctgatctttgagctccctagagcccataattctttagagcaggtatgtcccgagtctgagacatgcccttatttgtcccaagctctggacatttctcaccccaaggcggatcaatcatgattaaatcactccaatagaacaactacaaccggttgttctattgggccgggagcagtggcccacgcctgtaatcccagcactttgggaggccaaggcgggtgaatcacctgaggtcaggagttcgaagaccagcctgnccaacatagtgaaaccccaatctccactaaaaacacaaaaatcagctgggcgtggtggtgggcgcctgtaatcccagctactcaggaagctgaggcaggagaatcacttgaacccaggaggcgaaggttgcagtgagccgagattgcgccattgcgctccaggctgggcaacaagagtgaaactccatctcaaaacaacaatagaacaactacaaccg

SEQ ID NO: 582240 - DNA, 102 bp, Homo sapiens
ctaggtggaaatgcgagtcacactcggtcactctgagtcctggctcagctattcacacctgagaggagtgaggactgggcgtcacacgtcggtcactctgag

SEQ ID NO: 582241 - DNA, 216 bp, Homo sapiens
cggcggggccgttattggtaataggcggagtgcggacgctatactacaccaaaaataaaaatattaagccaggtgtggtagtgtgcactgtggtcccatctactccagaggctgagtgtgggaggcattgcttgagcctgaggatgttgaagcttgcagtgagccatgagttgtgccactgcactccagcctatacaaccgcggaagcaccctgtc

SEQ ID NO: 582242 - DNA, 105 bp, Homo sapiens
ccatttagactcttaaggttggatttttgatgttgatcactcatctctaggttgaatttatcaaggtattatttatgtaataaacaccatgttttgttaacagta

SEQ ID NO: 582243 - DNA, 191 bp, Homo sapiens
taaccaaatgaagataatagagctgcgatggtaatttctatggcatctggcaagtgacataggactagtgtagtacaccctaaaccactgacgctagcacgtacgtattctatagatagaaacccaaggatacgtacatgcatgtgtatgccccgttggatatctattatacagagaaagactactatcca

SEQ ID NO: 582244 - DNA, 343 bp, Homo sapiens
aggctgtacatacgaacctccccaggttctaactggaactggtttcgcacacttggcatagagtccccagagggagccaggtgcccctgagctccgttcacactttgatgttttttgctctctaatcctccttagaaatcggaaatgtcttcctgtaactccaggtgctgtgtctcagtgtacgatttctgaccctgtccctgcagcaagattttgcagtgtgagtccatgacattctcatctttgcgtgggagccttgggtgaattgtgctctcagtggtgagtgggtgtggcacgggatgaccaggacaccatccactgtgggcctgagtttggggcactc

SEQ ID NO: 582245 - DNA, 1376 bp, Homo sapiens
  misc_feature (536)..(536): n is a, c, g, or t
gctgttccgtagtccaggtgtggcgtgtagaacgcaggttgtcggctgagaatggtagctgccgtaacattaggccggaaaactgtggaggtgggcaacagcacctcatctatcattcatggtcttagctcattcggatcacgatatgattctcagggtcatctgtccagacagcttagcgtgggacagtcgagatccgtagatgaataaggatggcacgtcgagtggacgatgacgatgagcaggaggttttgaagcacagagcagtgcttgggtgtaggtactggcgagacactggcgtcttcacctcttctaatgctcactagtcactcggggatcctatgtggagtacacatctagaccacagttatagcagacggctgaaaccagatgggggtagtcccaccccaggtatagccatactcctaacgcatatgttggagacaaaactttttggagggaacgtaggctcacagatacttatggtagaatacataacctcaatattcagatgggcaccccaatgggacacacangcaagaactccatgtatatcaacacatttcacaaatgaactccaaggggaccattgtaatcaacgtgtgcgtgactgtgatgacgtgtctggatggacatctgtttgtcctagccgtaggggtggtttcggggtcgaaccctctttggacaggccttgcgtatgatcgtgcccacctgaagactgtggtggcacagtatcccagaacgaaaagctttggaccccgtatccatagtgtcctttctatctaccatcggtgagagatggtttgcatttactaaaccttaagaatcgcgattccgcgttggttgtttgaccaacatccattagggtgcattttacgctatgcatgagagcgcaaatccccttgaacaaaggtccccatggaacccggaccaattaattgattggtgaagaagaatagggttccacacgggggacaggggttttcggcggccgaacttatcatcgccatgtgcacctgtgaaaagagcgtggtatgggattgagaaccacttggcacattcgttaacggccatagggtgctgtacaatgtgggaaggtatggccgcgaggtgtatagcgtttgagttcttcgcgggacactttggggttggaacaagcactccactgagacattgtgacaaggccggagagaaaaggccgtgacattcaattggccgcggttttgtgtgggacccccaccgaggaaatgttgacagggaatacacctctcgcgggatttagtgggacttgggcgcacgtgcccagagggcggggtaatctccaagagacgaggcgtttggacagcgagatctctcgctgaaggtggtgttacccc

SEQ ID NO: 582246 - DNA, 138 bp, Homo sapiens
taacaagcacatagctaaggatacagaccacaaatatgaagaggtggccaggaagctggtgatcctggagagaagagctggcgcgctcggagtgaaagggctagagcgctaggccgaagagccgaagccatgacagct

SEQ ID NO: 582247 - DNA, 1440 bp, Homo sapiens
  misc_feature (1029)..(1029): n is a, c, g, or t
atggtgggtggctcgtccggcccaggagtttggtctgcagggggcacgacgagcattgtggggggcgcgcctcatctcaccgtccgggcgaggatgcagcagcgtgtttccggcgcgcgagggggggggcgaaacaaagttgtggccgcccccccggtggttatcgtgtgttgtcgcggtggtgaggggggggcgctcgttgtgtccctccctgtgtgggcgacgccggtttttttttggttggtgcgccaccgagggggagtgggtgctccccgccacatggggggtgtgttgttggtgtgtgagccgcgcccctgccccaccggccgccaacgacggtgggtggggggagaaatagtggggggcccgcctcctcgcggcccccctccggggtgttgagataaatacactctggggcgctggtggttctgtccgcctctctggttgtgagcacccccggcgtgtggtagacaccgggggggtgtcccccccacgagcagagagaggtttcacacagcaggggggtcgcactctctttgtcgccaccgctctctctgcgctagcccctgggggtcccacgacacgccgccgctgtgtgtgggggagagtgtgtgtgcgcgcccccaccgctggcgtcgtctctcacaggagtgtgtgcgcgactctctctctgctcttgtccgccgcctcttctccaccgcccctgctgtgggtgccctctgctgtgtggagagacgcccgcggcgccacacagcgtgtcacacagcagagagaggctctgctgtgtgcggcactcgctgctgtgtgcgcgcacacaccccgcagccgccgctctctctgctgctgagagagtccctgcgtggggctctctcccgctgggcgcccccacacacgtgtgtgtggtctcccgcggtagtgtggttgctccaccgcgggggcgtccctgctgtgtgtgtctctcctgcggaggacgcgcgcggcggtgagaggggcagggtgtgagagagagagagaggcccagcagtgttnttacacgccgaggcgccccgtcgacgaagaatatatagtgtcgtcgcccctctcgacgagagaagagagatatatatagagagagagagaggtcgcgtgtgtgtgtgggagatatctctctctctgtgaagagagagagagaggcgtgagagagagagaagaagagagagagagagagaatatatataatataaccccactccctctcttgtggccccgccacccacacttcacacgctctcccccgcatatttcacacgctctccaccctcttaacgacacacacacacaccttaagactcttttgtggttaaaatgttttcaccctggggaaacacacgttttttccccaaggggccccgcgaaatttttccccgtatatttcccaagataagtccctttaccccccca

SEQ ID NO: 582248 - DNA, 852 bp, Homo sapiens
  misc_feature (102)..(102): n is a, c, g, or t
  misc_feature (125)..(125): n is a, c, g, or t
  misc_feature (133)..(134): n is a, c, g, or t
  misc_feature (142)..(142): n is a, c, g, or t
  misc_feature (149)..(149): n is a, c, g, or t
  misc_feature (160)..(160): n is a, c, g, or t
  misc_feature (310)..(310): n is a, c, g, or t
ggctgggccttggggagctgcgctcgggggcggacgcgggggatcatggaagctgataaagatgacacacaacaaattcttaaggagcattcgccagatgantttataaaagatgaacaaaatangggactanntgatgaanttacaanagaaaaatatncagctaaagaaggagatccaaaagctgtgaaacggagttccaagaggctaccaaagaattccagattaagaggatattcctgaaacaaaagatgaaattcttatcagtgtgaaactcctgagaatgacagccagtggtcaaatatctccntgtcgttcaagtgagctcgaaagttccttatgagatacaaaaggacaagcacttatcaccttgtgaaaaagaagaagtgtgtccaaaatgtggtaggcatgagtaacattcatgtaccggataaccggatgttaactctggggagtacggccaagccagttccattaaattcaggagtcagatccaggtttatgtagaagtttctaaaatgaaattcatgttactgaaattcctggaacatggggtgaagatcaatgagagacaaatagagctgagctttcaaagtcccgaaatgaggcggagaggtggaccgggtggactatgacagacagtcgggagtgcagcatcacgtgtggggattgaggtggtgccagaatttgaaagaagaaaccttttttttaaattaaactgccgaaaggtatggtttccttaaccggactcctcggaagtttcgattttcggacctctcaggaagggttgcagaggagggccacgcggacacgggggaaacacctcccggcacagggggaagaggaggcttc

SEQ ID NO: 582249 - DNA, 400 bp, Homo sapiens
tagccgacctacacagtgttaacaagtaaaacaaactgtaaggaaaagaaaacaatttgtaactaattaaactgttgtaactcatgagccagcctagtagtgaaaatgttatccatcctactaaatttctttgttttctgcatttataagcaagatcttaacttttaacttcagagcactgaccccatttctttggagtctgcttcccagatggccattcccagctttttccttgaataaactcttggcgtttttgttgttgttctgagacagggacttgctctgatacccaggctagagagcagagcagcaatcatgattcattgcagccttgacctgtcaggctcaagtgatctttccacctgagcctcccgagtagttgggactacaggtgcatgcc

SEQ ID NO: 582250 - DNA, 183 bp, Homo sapiens
  misc_feature (40)..(40): n is a, c, g, or t
  misc_feature (112)..(112): n is a, c, g, or t
ccaacttagcaactttggattcaggtttgaataagaaatncttcagcgtgtgtatttcggctacatcttcttctggcaatgacttccgctccttttcttcttatgtttcttnggcaaaataattacttccgcatccgccatgttaccctgcaccgcgttcgtgccgcccggtccacagccgag

SEQ ID NO: 582251 - DNA, 183 bp, Homo sapiens
tcccggcccggttttttttgggggggggggccgtttttttgggggcccttttaaaaaaaaaacccagggccccaggtgggggggcccccccccccctgggggcccgggggaaaaaaggccccccccccagggggggggccaaaacccacctttccgttttttgttcctggacaagggcccccg

SEQ ID NO: 582252 - DNA, 1171 bp, Homo sapiens
  misc_feature (108)..(108): n is a, c, g, or t
tcatacaggtgggtgtgctacagcgccgctttgtgtgggagatggtttgtttggtcgcccagggaaggtctgtcgtctggagccgaatatatttgtcgcctccgtgtnctctaacaatatcgcgcgggtgttgagggcgccatgttcatgggttttcatgccacagctggtggcacaggtttattgtggcccaagagccaagtatttgggggaggtagctcttttgctttgggggagtttccaagggtaccgccaactaatggtgggggatagaaggcccttctttggtattcagatgcgcaacgtttttgggcaaagctttcctgcgagggccccgaggtgtgcatcacaggacgggggcatccgggatttctgtccctcttgagcgagagccactgggtcgagagttgcccccggggggattcctgcctgttgtgggagcccctttgtgcattgttggccgccatgacattttgaccaagtgctggatgagacgggccccctgggggaaccttacacccccggaactcttaaggagaaggagtttgagctttgtggtcctcctcgagagcccactgttgggattacccaccagggctgtttgcccgaggccggaacattcttagaattcccacgaggggaatttaactggggttttgagatgttgggcgctcgtggtatcctctctcccaaaagtgggaaaaaatgtggctgaatttcacggcacgctttgaacagaatttcgggaaaggcccccgagttgcacactgtttacctgtgcacgattttgaggaaacagcacaacttcgaggagaagtacacggcacggagggatcacaatgggaaaggacgagactgaaggacaccttttattaccaccacgggccaagtctgagtcaacacaggggggccaatccacgggttaaccctgcaagactggttccacatcaggactcccttcgaacaccaagattgctgtggcaaacggaaaagtgtagacgcacttctccgaaaactgcacgggcataaccaaaatcaatacttttcctcttgattcttgtgggtaaacacagacagtttctgtgtttgagagatttcccgttaggggctttgtttgaaaagggactttcataaatccaaattggtattaaataaagctacatttttaaga

SEQ ID NO: 582253 - DNA, 695 bp, Homo sapiens
tgctggaaggactatgctgaacctccttaggcactctctaattagatgtcctagatcctcccaattcttagtccttttatacctgtttttctccttctcttattccatttagtttttcagttcatacaaaaccgtatccaggccatcaccaatctttctgtatgacaaatgtttcttctaacaaccccctcaatgtcaccccttaccacaagacctcccttcagcttaatctctcccactctaggttcccacgccgcccctattcccgcttgaagcagccctgagaaacatcgcccattctctctccataccaccccccaaaaattttcaccgccccaacacttcaacacaattttgttttatttttcttattaatataagaaggcaggaatgtcaggcctctgagcccaagccaagccatcgcatcccctgtgacttgcacgtatacgcccagatggcctgaagtaactgaagaatcacaaaagaactgaaaaggccctgccccgccttaactgatgacattccaccatggtgatttgttcttgccccacttaactgagtgattaaccctgtgaattgcttctcctggctcagaaagctcccccatgagcacttgttgaccccggcccctgccacagagaacagaccctttgactgtaattttcattacttcccaaatctataaaagggccacc

SEQ ID NO: 582254 - DNA, 473 bp, Homo sapiens
gttaaaactttagagaactttataaaatagaccataaaaattccttaaggacttttaagaacattgttttaaggacattgttgaggacagtttattgtaaaagattgtagatgcctgtacttttttcttcatcttttgcatgctgttggtggttaaattttgtgattttgtgattttttttaaaatttatttttattttttattattattttttgagacggagctcgccctgttgcccaggctagagtgcagtggtgtgatttcggctcactgcaaggtccgcctcccaggttcaggccattctcctgcctcagcctcccgagtagctgggactacaggcacctgccaccacacctggctaattttttgtattttcagtagagacagggtttcaccatattagccaggatggtctcgatctcttgacctcgtgatccacctgccttggcctcccaaagtgctgggattacagg

SEQ ID NO: 582255 - DNA, 678 bp, Homo sapiens
  misc_feature (224)..(225): n is a, c, g, or t
  misc_feature (227)..(227): n is a, c, g, or t
  misc_feature (229)..(229): n is a, c, g, or t
ctagatcgtgagcgccgcccttttatttgtttttttaacataaaatagaaactaactttatttctctggaagaagcaggtactgaatgccggagcagcaacttcgccaacaggctggtgggaaaacatggaaccgctgtgggggaattgggtggaagaggaagcactgatgtccctccagggcggttgcccttggttctccttccagccctggggccttgggcnntngntccccgtcagagaatggtctggcaccctttctccgcttcctgagccacctcagggctatttccaggcacaagatcctgaggccagccaagtcccattcaagtccatggtaaggccacaagtcacattctgcccgagaccccagttgctgccaggggccccctggaaaaaggcccagtcctagagaggtcccaccgggttgccggatccgcactctccctggtggcacaacaaaatcccgcacgtgcccaggttccagaccgtggttttcactcccagtctgtgtcaccacagggcagggccctgggggtacatagtccacaccacgaggccccgcccaggaaccagggccagaaggcaggtcatacccagagcctgcatggggaagccctcaagacctgtccttcacccggccctttccacatcttggcaggggccacgggactgaacc

SEQ ID NO: 582256 - DNA, 388 bp, Homo sapiens
attcgtggtgatgatggaaaaaccgtgtaaaggtaggtcaaatgcatcacatttacacttgaaaacagccatattttaggctatatagattataactcaacaaagctacttttaaaactgtcccgtcaggctgtagagaaattaagtctgatttctgtaagtactcactgagtgcttgcaggtaccaggtgcacagcaagggctcagtaagtggcaggcagctgggagccacttggagcagacaggtggaatgaagttaatacctgacagaaagatgcagaccttgataacatccactttcaattaaagacagtgaggaggagtaggaaaggtttaaaaaaacaaaaacaggcccagcgtggtggctcacacctgtaatcccagcact

SEQ ID NO: 582257 - DNA, 259 bp, Homo sapiens
  misc_feature (17)..(17): n is a, c, g, or t
gactcttgacggatccnctcacccgcgtagtggtctcgttgctggcatgaaagtacagctgggcaacactgcactgatggaagctgcggcgtgaccaccaaggtctacaagaacgtgcagagttgttggcctttgaagctcagcgatcatctatctagcagttgacggggtcttggcaggattactaagcggtcttcagacccgataaaaccggcctctaaagaaagcagtcaccaagcttacggttgctaacgtacaa

SEQ ID NO: 582258 - DNA, 412 bp, Homo sapiens
caatagcaactgaaatgtttacgttttggtgattatatcaacatcaaagaaatgcaaatcaaaaccacaataagatgccatctcacaccaatcagaatggctattattacaaagtcaaaaaataacggatgttggcaaggctgcagagaaaagggaatacttatatactgtttgtgggaatgtagactggttcggccactgtggaaagcagtttggagatttctcaaagaatttaaagtggagctaccatttgacccggcaatctcatgactgggtatatacccaaaggacaataaataattttacacaaaagagacatgcacttgtatgctaatcacagcactgttcacgatagcaaagacgtggaatcaacctgggtgtccatcaatggtggattggataaggaagatgt

SEQ ID NO: 582259 - DNA, 511 bp, Homo sapiens
tgcactgtacgcggtcttctggctacactgcatgggcgtctgtcgtggctcactggccgcgcatcgatcttgcgttcgtccattgggcgacatgtatagcatttggatgagctgaagcagcgtgattacaagaatcctgatagaaccagatgtaatacccttgaatcccgtatatgtagtagcaccaggtgatggagtggctccagtgactctattgaaccctacaacacatcatgagtgcagatattctaggcatattggtcacgaatggagacggatggtgcacaagttatgcttgttgatcttcatagcactttatgtattaactgacgctacttagtgggcaagtagtactacgtaaaatgggttgtggtttgaggttgaatgcttctttaatgaatagactaatcatgaatgaatgaggtccagttaatgtagctatgctataaagtccaccaaatgaatgggattctatccagtaagatccgtgtccaatgagtagccttgtgga

SEQ ID NO: 582260 - DNA, 911 bp, Homo sapiens
gctcggctgtgtctctttttgcgtcagctcgtccctgccacaacggctaacacatttctatgactgggccccgatctgtctgcctcgggctccagtgaggatctcctcatgaagcttgaggcggaaccaccaggctactcctttgtagagattgcacatgaaagctctggaggacttgtggcgtggaccttctaaatcaaggccgagagtctgggtctcctacacaggtggacggcccagcacagggagtggccgctggagtctaaacgccctgcctcagctccaaggccgaggatagaccagtgaatggcctgcttgcgcgctgctccgcatgaaggtaacactcctgtgttatgtagaggtactcctgtgagacacgattattgtattctcgaaatttggctttttcatctgttgggtccaccatagtctcccttgcaacctgggttcattgtcccgcacctattgctgtgatccctcctcctgcatacggtaaatgcgtttcttgatagttcctctgagcttcttctggagctttccagttgggcctgcacagaggacctgctcgagctgcttcgtttaccctgtctagagacgcctggtgctgtctgcgataaacccttgattcttctccgcagcttgcttggtgtagccctgttgctaccggcggttttacgtatggcctctgtatgtcgctgcagacgttgcgcgagtgctctccctttacagggctgtgtgctggaggaaggtatgccggtgcctgtgggcatcgtggtgtgggccggtctgtaccgtaaccccagaacctttacgcatgtcgcgttgtcgacttggggcggtcgtgagggtgggtcttgcccgcccctcttttggttgggcttccttggtatagcctgcgggaaggggtagac

SEQ ID NO: 582261 - DNA, 180 bp, Homo sapiens
tctggatgcaatgtgtctccagtgagggatagtacaggtttcacggatagaagtttgtcaggtagtctaaggaagaactcgttccccttctgattctaagcctcctttctcacgagggtcatagagaaaggccactggcccgtgggcaaagaaaacaatcctcctctggagggttgggga

SEQ ID NO: 582262 - DNA, 201 bp, Homo sapiens
acccgcagcatactaacaatcagtgaagaaatgacacatattacactgtttgcatttacagaaaggtgctcatttcgtgctgcatggcttaactcacacgctttatacttcctaaaaaaaataaaaagttttttttttttgggcacttactcctattttttttaaagatatttttttataaaagaattttgggcggcccga

SEQ ID NO: 582263 - DNA, 985 bp, Homo sapiens
  misc_feature (32)..(32): n is a, c, g, or t
  misc_feature (693)..(693): n is a, c, g, or t
  misc_feature (864)..(864): n is a, c, g, or t
  misc_feature (959)..(959): n is a, c, g, or t
cacgcgtcggcggacccggaagtggcgccctnggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggccaccccctgcatgtcatctcaagtgcgctgcatggtccagtttgtgggacgggaggcnaagtacagtggtgtgctgagctcccttgggaagattttcaaagaggaagggctgctgggattcttcgttggattaatccctcacctcctggggcgatgtggttttcttgtgggggctgtaacctgctggcccacttcatcaatgcctacctggtggatgacagcgtgagtnacaccccaggggggctgggaaacgaccagaatccaggttcccagttcagccaggccctggccatccggagctataccaagttcgtgatggggatncagtgagcatgctgacctaccccttc

SEQ ID NO: 582264 - DNA, 607 bp, Homo sapiens
gcatgctgtatgtactggacacagtgaggcatcttcagtgtgcacccatttatcgggatggcctcaggcgagatagggtgtgacttcaagtccggtagactattgactggccggtccttatacagtaaattctcgtctctgtggtcaactttactagctgtaaggcacagtcagtagcttaactgatgttcttctacatttgaagagttctccgtagtactactttatggatctgaactgaagtcctgtagaatatcagtgtcctgtacgtactgtacttactagaactgcgctagctatatgttagatactgtcggtaagactctacgattgcgctactcatactgacaatgtcctaacttacatatactcattcgttcatgaccctcctatgatgtgagttctgacttgcactcttgaggactcggacctgctaggctgatgagcctagaggtagattctccggccgcttacatagcacatgttacagtgccaactcgactgcgtatagcagcacactgtggcacagacgcgcacatagctatctcgtaggtgctacgacgcgtcatggtaacgatccaagccttgggcctttcaccttggctcc

SEQ ID NO: 582265 - DNA, 377 bp, Homo sapiens
gaggattcgtgactgattcagagagtccttcagctaggtctgtaaggaactgacgagctggggctttatcgtccctgcatttgcaatgcccctcccgcatttcaccccgtattaccgcctgtaggaatgtggaaactttcagccaaatagcgcagtcatcccataacggaggtcacctcacccaccatccacgggagtagacatggcggcgattcacatcggcatttccggctggcgctacacgccctggcgcgtggacttttaccccgaagtgctgacccaaaaacgcgagtggcagtttgcgtcacgcgccgtcaacagcatcgaaatcaacggctcgttctacgcgctagaagacccccaagcgctacgccgaa

SEQ ID NO: 582266 - DNA, 236 bp, Homo sapiens
gccttctattgtcccaggtgcacccacgggtctctgaacatacatcctagttagcttgctcccgcatcccgagcagcatttgagtctatatagtttagaaatagggttcatttgagccagcacactccctagcttccctatttgtagcctcgtagcactatggagtagtccactagtcctattacctagtatcccaagggctcctatctctagagacttcccagtctctcctgtat

SEQ ID NO: 582267 - DNA, 225 bp, Homo sapiens
gacggttcctgagacacccgattccacagatcaggacaactgaggtcgcgtcccccgcgcaggtgcacagtggaaggaccaggactgctctatgcagtggagtctttggctacagtcatcataggtcggagcgacacccggtgcgtcttttgaatgagcaccatgggattgtagctggcgggcacgagcagggcgctggcaccgtgtcgggcttcaggcggtggt

SEQ ID NO: 582268 - DNA, 839 bp, Homo sapiens
accagcatatgctgaggaggatgtggagcaacaggagctcccattcactgcacggtgggaatgcaaaatggcacaggcacttcagaagacagcctggcggtttcttacaaagctaaacatactcttaccatatgatcaagcaattgcaaccttgttgatttaccaaaaggagttgaaaacttacgtccacactaaaacctgtacatggatgttttagcagctttactgctaactgcgaaaatttagaatcagctaagatgtccttgtgtaggtgaggggctgaacagatacattctgacaatggaatattatttagtgctaaaaagaaatgctttatgaagccatgaaaagacatggaggaagctgggacgtatattgctaagcaaaggaagcaaatctgaaaatcctatatactgtatgattcccaatatgtaacattctggaaagggcaagactatagaacagaatacaagatcagtggttgccaggggtcagcaggcaggaaggaatgagtgggtggagcacagaggattttcagggcagtggaacaactccatatgacgctgtaaagcaaaatcatgtccttacacatttgttaaaacccaatgactgttcaaggccaagagtgagccctaatgtaactatggactttgggtgactggccaagagtgagccctaatgtactatggactctgggtgactagccagagtgagccctaatgtaactatggacttcaggtgactggcaacagggagcctaatgtacactatggacttcggggtgactggccaagaagtaagccctaattgtaactatggacttgggtgaattttaacca

SEQ ID NO: 582269 - DNA, 105 bp, Homo sapiens
accagtagtcagtccccttgtagttagtgggatatttgatactggttagatcatacttgtaaattttaatgctttgtgtattggtttgaaaaacagtgaaatggg

SEQ ID NO: 582270 - DNA, 303 bp, Homo sapiens
gccccaaaataaatactgaattgttccatttcattaaaattttaaaataagtgaaattaatctattgctgttaggatggtgattacctttcgggaggacagcaggacagtgattaggtggggcacagggagaataagcttctggggttactgataatttcctatttcttgtccaagaaatgtgtattctgcaatatgttaatcttatgatgtatcattgagctgtatacttataatttgtgtaattttctgtacatgttacatattaaaaagttcaaattgaaataaaacttcttaatcagtt

SEQ ID NO: 582271 - DNA, 1238 bp, Homo sapiens
  misc_feature (500)..(500): n is a, c, g, or t
tgacgccggtgcagctgggggggcccgggggccctggtggccctgggatggggaacctgcggtggcttcctgctggaggtttcggcagtggcatactggggccggggtctgcggccgtggacggggcctggggcctgaggccgctggagctcgcgggaggcaaggccagaggataaaggagtggatgcccgtaaccaagttgggccgcttggtcaaggacatgaagatcaagtcctggaggagatctatactctatctccctgcccattagggaatcggagatcattgatttcttcctgggggcctctctcaaggatgaggttggaagatatatgccagtgcacaacgcagaccctgtgccgggccagcgcaccgagtgttcaaggcatttggtggctaatcgggggactacaatgggccatgtaggacgtgggtgtacacgtgctccaaatggaggttggccaccggacaatccggtgggggccaatacatcgtaggcnaagcatctcacatacgtaccccgttagccgcagagggataactgggggggaacaaagaatcggaaagcccacagagtgttcccttttggcaaagggttgacaatgggcctgttgacggcatcctagtgcgtaggaacgcctacattccgcttgcaccccaaggtggcactagggcatcggactccggaaccttgtgccctaaaaaagctggctccttgatgggcgtggtaatcgggatagactggggtaacaacttcaaggcccgaggggcttaggattgggcaacctcatgggccaaatttttggacaaggtgccaccttttggattgcccattatctaaaagacctaacagggtaacctgagaccccgtggaactttgtggaaggcgcgctttgattcaaacaaaggttatcccctaaataggggagttcaggtgggcaaccttggtaagagaacccaaaaccaagaagatctttggtgggaggggactaagggcctcagggttgtgggtaaaccaaggtggttttaatcccgggaacaaaatggtgggtatcggggtgaaaacaaaaaataaagaaaagagtggggtaattgtgggtggacacggatatagggaggagaaatagatgacagcatttaaagggagaagggccctattattagaggctcaagtagagaggtagtaagaaagagaatagcgatagaaaggaggagagaagaacaagaaaataaagaaa

SEQ ID NO: 582272 - DNA, 425 bp, Homo sapiens
  misc_feature (65)..(65): n is a, c, g, or t
  misc_feature (73)..(73): n is a, c, g, or t
  misc_feature (96)..(96): n is a, c, g, or t
  misc_feature (110)..(110): n is a, c, g, or t
  misc_feature (112)..(112): n is a, c, g, or t
  misc_feature (159)..(159): n is a, c, g, or t
  misc_feature (183)..(183): n is a, c, g, or t
  misc_feature (198)..(198): n is a, c, g, or t
  misc_feature (204)..(204): n is a, c, g, or t
  misc_feature (309)..(309): n is a, c, g, or t
gctgcctgacccgaggaggacctgcacacaccctgctgacacgagcgcttatcaagctgttaccntctggttncttgctttgccagacagaattangtcccagacagtgnantgaattctataaagccggttctcctccttctgtgacctgccaccagnaaccacccaggggatggagtcacngagttcacaggcgcntctggnaggttctcatgaccagcccttgagactaagaatctgggtggcctaagctggattggattaatcacccaacgcctcatcatgggaccactgactgccaaaaccctnaaagctctacactcttggggtgtgagcagaaacagacacgtgcttaccactgctaacaggcatcagtaaatactatttaaatacatgcttgatcatcataagacattaaagatgtt

SEQ ID NO: 582273 - DNA, 113 bp, Homo sapiens
ggtccgatatgtgcatacatcaacgggcagatccagtccctccgacggcctttacagtctagttgggaagggagcgacaaatgtacaagcaacaagtatggtgcacaaggaaa

SEQ ID NO: 582274 - DNA, 1112 bp, Homo sapiens
ggacgcgtgggtcgcggacgcgtgtggtcgagccacgcgtgcgcaagtgcaactcattgggaagagcggtgccaagatcaacagaatcaaatgagcagtacaaggtgatcgcgtgcgcatccctcctgacagctgaagaactgagcaatattgatccgctatcgaggagggacccagagggacgtgcagtgaggtccaagctgagagctgcatggagcttgcatctcgcatggaaaatgagcgtaccaaaggatctaatcatggagcaaagatttcatcgcacaatgcatagggcagaagggtgaacggatccgtgacaattcgtgacaaattcaccagagagtcatcattaacgtgccagacccaggcacaaaaaagtgacaatagtccagcgtcacgaggaccatacgaaatgcaggtggaaaaactgcacaaaaagacatgcagaagatggtggctagatctaggtgtgacaactagctatacaagtttcaggtaccgcatcgtaacaaacagtaacgcctaggaatatcatctgggaagggagcgcgcaaaccataagacatgagccgaggccgcaccgaccaaaccaacatacccgacgctgtccagagagagaatacgcagacacgagaccagtgaatccatcaacaggcaaagcagagacaaacagccgagacagcccagacacaggatccagacgcaatccgaaaagaaactggcgaaaaaaataaaccgaaggcaagaaggacaacaagacactgacaaagcagggcacaaacgccggaaaggacacaaagagccggaagaaccacgcccatcagggacaacagaagagggaacaagccccacataccgcggacaggacggaggacacccaagagatagaaacaaagggagcccgcactgcgaaacggcgacaacaggcaaagacaacacaaagcccgctaacaccggaggagcaaggacaaaaaacggatgaccccggtaggacccagtcgcgaacgaagaacagcacaagcagcgcaaaaacatagcgcgagaccaacgaagggacacgacaagggggggcagactgacacgcagacagtgagagagagagcacacgtacc

SEQ ID NO: 582275 - DNA, 344 bp, Homo sapiens
agaggggtgggttgttgcaggctgcctagcaaagcgcccaccatgcttaggttaaatcaacaacagccgggtgcagtggcccacacctgtaatcccagcactttgggaggcctaggcgggtggatcacgaggtcaggagttcaagaccagcctggccaacatggtgaaaccccgtctctactaaaaatacaaaaattagccgggcatggtggcacacacctgtagtcccagctactcaggaggctgaggtgggagaatcacttgaacctgggaggtggaggttgcagtgagccaagatcacaccactgcactccagcctgggtaacagagtgagatcctgtctc

SEQ ID NO: 582276 - DNA, 290 bp, Homo sapiens
  misc_feature (116)..(116): n is a, c, g, or t
gacttcctggacatgggtcttcggcaaatacatcagaggaagatgccttgaacctgttgaaggacacaccaagtcttctcacaccacactgtacttgggtcacatctcacaaacanaagggcccttcagactcttagaacacctgttgcagactttaaggtacagctgaccaggaatacttctccccgaaagtggacagcatcctagatgcggacagctttcccaagatcacagatcaagacttttctgccattatgaaagccttgtgctttttgcttttttcctcttga

SEQ ID NO: 582277 - DNA, 362 bp, Homo sapiens
cactgcatttatttattaaataaaatatactcgagaacgtagtaacacatcttctacctagaatgagaaggaaaaaaaaacacaggctgatagggccaggacagacacattttactttaatgtaagaggtaagtatataaatcagatgcccatagtgtaattttaattttcagatacacatatctggggctgagataaggtcttcgggtagtaataacctcagaagactataaaatttggcagtatattatccctggctcagtggcctacttaactgttctaataaggacccagcagtacaacaataactcggctctaacaaaacaaaccagccttaaagaataggtaaggcacattcacac

SEQ ID NO: 582278 - DNA, 996 bp, Homo sapiens
ggacgcgtgggttgcggagcgtgggtcgaccacgcgtgcgatctactcctcattgtacccattctaatcgcaatggattcctaatgcttaccgaagaaaaattctaggctacatacaatacgcaaaggcccaagttgtaggcccctacgggtactacaaccttcgtgagccataaaatcttcacaaagagccctaaaaccgcacatctgccatcaccctctacatcgaccagccccgaccttagctctcaccatcagctcttctacctatgaacccccctccccgataccccaacccccttggtgaaccatcaactaggcctcctattgatacgtagccgagctctagcgtagccggcgactcgaatcctctagatcagggtgaagcataacacttcaaatacgccctgatcaggcagaccctggagagaggaagaacaaaacgaggtctcatatgaagttcaccgctagacatcataactattatacaagattactaataagatggatccttataagcatgtccaccctatgatcacaaccaaagaaaacacctctgataactcatgaatccaagacccaggcgcaaaatctgatagctcgacaacagtagcagaagaccacggaacccgcttcgaacttgcgaaaggggagacagaacaatcgtaaggctaacacaattgagataggaggaatgaccctggccctcatccatcgtggccgactgccaccaccgttatacgaacaaccacccatcacaccgccacaacaaaagagacagaagggacgcacacactacagtacgacaagttcggcccccaccacgcaaacgccgtgtaagatcagcacacgcgtcggccacgacaacccaataaacatccgaaccacacagaagaggcaacgaaacgacacccctacaaaaagacgcccaccggcgcgaccataagcgaacgaaacagcaacaaaagaacccaccacaaacagtgcaacaactcct

SEQ ID NO: 582279 - DNA, 929 bp, Homo sapiens
ggttcgttgggggaaactggatacgatgaacggtgctggaatgcagagtctggagggagcgtcatcggacagctctgaatcggcgtcccaatggtgccagagccgatcaccgatggtggtttgtgcatcccctcttacgtgctctatatcgacttcgctcgcggcagaagctagatcccgaagattgctgtggctgcgcggaactgctacaagagtgacgtaagtgtggcgctatttactgggtgagatcagccctggacatgatcaaagactgcggagccacttgtgtggtcctggggcactcagagatgaaggcatgtcttaggggagtcggatgagctgattgtggcagaaggtgtggccaggctctggcacagggactcggagtaatcggcgtggataggggagaagctagatgaacgggaatgcgtggctattcactggaggaagaggttgtttccgagctagacaatgggtcatcgctagtagtaagctgtaaaggactggagcaaggtcgtcctgtgcctatgatgcctgtctgggccatcttggtactaggcaagactgcaagacaccaataaggcccggatgtacacgacagaagctccggaggatggttgaagtcccaaagtctcgtgatgcggatgggctcaagagcacccggtatacttatggaggactctgtgactggggcactctgaaagagctggacagacagactgatgtggatggtaccatgtaaggtagaggaaccctcacgcccaaatcagggaagtatccatggccagtattagcccagtatttcctaaacttctgcaagccaggagaaagggccaaaccattaatggcttcccgaaattcgttagagagacaaggcatacgagcacacaaaggttcataggtaatacaaacattgtgcaggcagactc

SEQ ID NO: 582280 - DNA, 158 bp, Homo sapiens
actgcatgctgctggtcgtctctacaggtatccccctgtggactcagcggtgtagcgctgctggctcggctaatgaaactcccgagaataccggacaacgtgggacattggcttcgggcgcgctctaccgcattctgccactgatttggaagttactt

SEQ ID NO: 582281 - DNA, 285 bp, Homo sapiens
ttgagcaggctgatgctactggacccagtcgattttccttctttttttttgtgggaaacggtctcgcttggtcacctaggcgggggtataggggtgtagaacagggctcactgcaacctagacctccgggactcaagtgtttctcccatctcagcctcccgagtagcggggataacaggcttgtgccaccacacccagctaatttttggtattttaagcagagacaggatttctccagtgtgggtcaggggggtcttaaactcccaacctcaagtgatccgcccg

SEQ ID NO: 582282 - DNA, 356 bp, Homo sapiens
  misc_feature (85)..(85): n is a, c, g, or t
  misc_feature (351)..(351): n is a, c, g, or t
tgggaggccagggcaggagtatcattggaggttgggagtttgagaacagtctggttaatgttgagaaactgcatctctgcgtggnatacaaagtttagcagggcacgggggctcacacctgtaatcccagcactttgggaggctgaggcgggcacatcaggaggtcaggagtatgagaccagcctggccaacatggtaaaaccctgtctctgctaaaaataaaaaaattagccagacgtggtggcacatgcctgtaatcccagctactcaggaggctgaggcaggagaattgcttgaacctgggaggcggagtgcagtgagctgagattgcactactgcactccagcttgngcaat

SEQ ID NO: 582283 - DNA, 235 bp, Homo sapiens
  misc_feature (28)..(28): n is a, c, g, or t
cttcaggagaactatgcaggaggagtgntgcactttttactccaaccactaccacagctgcagaactattcaagtctttgaataattacttatcaggaaaacagaattggtcattttgtgttgatatattcatggaggaagtggctgccatgactggacagctttatgcttttactacttgagtcaaagaagcagctcctgaatctaattctctgaagatatacagactgctgag

SEQ ID NO: 582284 - DNA, 900 bp, Homo sapiens
  misc_feature (192)..(192): n is a, c, g, or t
  misc_feature (202)..(202): n is a, c, g, or t
  misc_feature (204)..(204): n is a, c, g, or t
  misc_feature (209)..(209): n is a, c, g, or t
  misc_feature (360)..(360): n is a, c, g, or t
  misc_feature (375)..(375): n is a, c, g, or t
  misc_feature (406)..(406): n is a, c, g, or t
  misc_feature (410)..(410): n is a, c, g, or t
  misc_feature (428)..(428): n is a, c, g, or t
  misc_feature (436)..(436): n is a, c, g, or t
  misc_feature (447)..(447): n is a, c, g, or t
  misc_feature (463)..(463): n is a, c, g, or t
  misc_feature (568)..(568): n is a, c, g, or t
  misc_feature (865)..(866): n is a, c, g, or t
  misc_feature (869)..(869): n is a, c, g, or t
  misc_feature (874)..(874): n is a, c, g, or t
gcgccattccggtgctgctatatttgtagtaagattctatattgtgcagaacatcatggatgatgttacagctttcctgctgcagcagtgacgctaagtaaagaggtgcatataagatctgtgtggatggcaactcatggcttgttgtcttctgacgccccccggcgatgtgaagagtctgccatgatgagntggtggtcancnatacnattccacatgaagtccagaagctccagtgccccaagattaaaactgtggatatcagcatgatcctttcagaggcgatccgtcggatccacaatggggagtccatgtcctaccttttcagaaacataggcttagatgactgagttttccttntaggaaaactccccngagggccaaactggaaacagtaagagtgacntgcntcggtgggatggatttcnacaggaanccgtcatgctntgttccctccctctcnccctgtaacctcacttcttattgatctcctaagaagatagaccaactttttatgtcggttgtggggtgttgtgtgagtttggggagcaatttttataaaagaaanactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtnngtntgttnttctaaactttgtgtttgtcagtccc

SEQ ID NO: 582285 - DNA, 1182 bp, Homo sapiens
ggagaggccggcagccacccagtctcggggtgagcacttagctcccccgacccggctccgcaccctgtcctggggtgtgctcctagaagccctcagaccccaacaccctggtgctcccacactggaatgcctagctgatgcccctagtgatgtgacgcaggacggacggtggcagtcaggcttgaattgcccactggtgctgcactgtgtgtgccccatgcagcaccgatccgctgactctctagaccagctttgaaccgtacatgtgccaccctagaatgacaagcaacaatagttggactaacgagatacaagagtatgatagaaaaaacacacacgagcagcgagggaccgcaaagaaacaagagaagagagcagagagaagagagaaggacaaagaagacacagcgagccgatagaggacaaaagagaagagaagaaagagacaacaaggagcaagacgaagagcaagagagagcagaatagaacaaaccagagaaggacgagagaagaaaagacagcaatagcagagaggagaagacaacaaaaagaaagaagaagaagagaggagaagaataaagaagagtgatgagcagcgagcaagacagaagatatagagatagaacaacgaagacaagagaagaaaaggagaagcagaaagagagaggaagagaagaagaaggaaagaaaggaagcagagaaaaaagaaagacagggcgaaaaaagaaagagtgaacgacgcagacgagagacagagagagacaaaggagacagagagagaagagaagagccaggaacagagacgagcgcgagagagagagcgaggagaggagcagaagaggagcgagagaaaggcaccatacaaacacagaaggagaaggcgagagaaaagaagagaggaagaaaggagagaagcagaggaggagagagaagatggctgataatgaaggagagcggagatataaagaagagagaagtggcgaatgaagagggaggagaaaagagagagagagggaagaagagtgacggcagaagaaagagagaagaggaggaggaggagcagaaggacaaagagaagaggagagacagagaaggcgaaagaaggagatcaagaagaaaagagaagaggaccagaaagaggaacacgcagtgtagcagaggagtgcaagaggagagagcagg

SEQ ID NO: 582286 - DNA, 121 bp, Homo sapiens
tccactcagctctgatgtagctggattaacaggcatgcaacatgtcccactcattttattttttattttttgtaagagatgggtttcaccatgttgtccaggctggtctcaaactcctggg

SEQ ID NO: 582287 - DNA, 147 bp, Homo sapiens
gacctaacaaaatattcgtggccacacgccggacagatagccacaggaaaaacacacaaagtgtcaaatgaacgtaaaaaatatagggagggtggaaaccaaaaaaattttcccctcaaccccaaaaaataaaaacccacctggata

SEQ ID NO: 582288 - DNA, 514 bp, Homo sapiens
  misc_feature (44)..(45): n is a, c, g, or t
  misc_feature (64)..(64): n is a, c, g, or t
  misc_feature (95)..(95): n is a, c, g, or t
  misc_feature (97)..(97): n is a, c, g, or t
  misc_feature (136)..(136): n is a, c, g, or t
  misc_feature (327)..(327): n is a, c, g, or t
cgatgatagagatgagaatgacatcatggttaggaaaatagatnnggaaccgacaatctggttngaatcctggctccaccatttactaactatgncnaggggctcaactctctgtgcctcagtttattcatgcatnaaatggggataaaaacagaacctatctcatagttacgtatagggttcggcaggattaaataattcaataaatacaaagtgatggaacacaataaggtctatgtaagtgcccactattattatcacaagtcatgggcatgggtgacagccacagtcagaccatatcttccaatgtcttatttgcaacatggnttaagaggagtggtatatgtggtaataacagcaaggaatattaagtgctttatatgagcctggttccatgccaagcacttaacatgaattagctccttaattattaacactagagatctggtattgagttcttatgcccattttgtagaaggaaaaaccaagattcagagaaatgaactgacatgtc

SEQ ID NO: 582289 - DNA, 363 bp, Homo sapiens
cggagtcgttcctgaacactatggcgtttgtttgtttgtttgttttgagactggggtttctttctctctgtcacctaggctcgagtgcagggcatgatcacggctcactgctgcctcgacctctcaggctcaagtgatcttcccacctcagcctcccaagtagctgggaccgcaggtgcacaccatcatgcctggctaatttttaaatttttggtagagttggggtctatgttgcctaggctggtctcaaactcttgaactcagacaatccttccatctcagcctcccaaagtgctgagattacagatgtgagccaccacaccatgattgcattcctggataacacgttcgcgagggggatcc

SEQ ID NO: 582290 - DNA, 191 bp, Homo sapiens
  misc_feature (102)..(102): n is a, c, g, or t
  misc_feature (157)..(157): n is a, c, g, or t
  misc_feature (166)..(166): n is a, c, g, or t
  misc_feature (186)..(186): n is a, c, g, or t
tctggttcccaggtctggtaccagtggaggacgtcagatccaaaggaaccttgagcagcaactgaattccagtgctctgctgagacatcaattagcattttnagcataagggcaatttgaataaaattctgtggattgtttgagaattctctaggtngaattaggnagtatgggtaggaattatcntaccc

SEQ ID NO: 582291 - DNA, 819 bp, Homo sapiens
agcggggaactgctgcagcgtgcgtgccgcctgccggaggaaccttggatccccgcgtgctccggtacaccccggtgcctcgccatggctgtaccatggctgcactgaaggatgcatggatttgcagacgtctcaaggaggccttctccctctttgacaaggatggagatggcactatcaccactcgaagggagttggggacagtgatagagatccctgtggacagaacccctctgatgcagagctgcaggatatgatcaatgatgcgttggatgcagatgggaacgtggaccatcgagcttcccggatgttcctgaccatggatggtccctgaaaagatgccattggaccgactgatcgaagtgaggaggacgatccgagaggtcgtcccgtgatctatttgacaatggcatgtggaagtggctactagtcatactgcgcgacaggagcatgccgctcacgatagatgatcgcataccctggggtgagaagcttgaccagatgatgaagttggcatgatgactgatcaggcggaaggctgatcagtcgatggaggatgcgccaggtcaagttatgaagacgtgagtagcagatgatgactgcaacatgtgaatggccccccggggcaagctggactgagtgcccggttcatctgtgatctctctcgttcatcgcgcgcgcactctctcttcaagcatgtcccctgtgtaccccggttctagcaaacaccaattgattgactgagaatctgataaagcaaccagcatgaattgtgtcccgggacctttcatgacataaaatattctcacagtagttcga

SEQ ID NO: 582292 - DNA, 259 bp, Homo sapiens
gccaccacacccagctaacttctgtgtttttggtggcgacggggtttcaccatgttggccaggctggtgtggactcctgacctcgggtgatccacccaccttggcctcctaaaatgttggtattacaggcgtgacacctgcaccccgccttcaatttttttaaccttttttttcttgagtttatcttcagttgtgaatattcatttatatatgtaatggattctagtctttttggccgtcatgtcataggtgtacatgc

SEQ ID NO: 582293 - DNA, 122 bp, Homo sapiens
tgcccgacgtgctgtcgcgccgatcacgacccagatctccaaggacacgggcgccaccctggtggtggaaaaccgtcccggcgccgccggcaacatcggtatcgcgctggtcaagcgcgccg

SEQ ID NO: 582294 - DNA, 339 bp, Homo sapiens
ttgttgctggggtgcatatgcttatatatgaatgtgtccaatcccccccccctccccgttctgtcccccattcaaggaatgacattctcagtcacccagagccatctggcctaccctctcaggaaatgggttgtcctgtagagttctctacccttttaaaggcaaaagtattgtgatgcaatactatcttaatgtccctatctgtggtgtgtgtgcacttgctgtgaccttcccagtagtccctccatgacagaaaacactcccatgagtctcgagggaaagccaagaataaatgtcactccagaacacattttttagcaataaaatggtgtcaaatgt

SEQ ID NO: 582295 - DNA, 222 bp, Homo sapiens
ccaggtaaggatggagacggagactaaatgaagacccttggctcaaagcagtaggctggccatggagaaaaatcaacaaccagaaggagcatggagtctggattcatttctccaggcttaagggtttttaagctacacttctctaacatctttaagtgaaattcttacttcccaaaggaatggtgtcaatatgtccttacctcgtgcgggggtacggagctc

SEQ ID NO: 582296 - DNA, 257 bp, Homo sapiens
tccgtctctactgcggtttgggtgaacaatctagggcgtgagaaaggttgacataagagagttgggaatcgatatggggtacaggtagtttatgccatggatgtgtaaattagaaccatgaagtgacaatgtgcaaatacaaaaaaaagaggccaggcacggtggctcatgcctgtaatcccagcactttgggaggccgaggtgggcggatcacgaggtcaggagatcaagaccatccgtggctgacacgttgagac

SEQ ID NO: 582297 - DNA, 111 bp, Homo sapiens
ttacaatcccacgatcacccaggtctgctcaaggaccctggggtgggaggcaaggctcgggctggtgctggggcacctgcagtgggtatgtggtagtagtcggggttgtaa

SEQ ID NO: 582298 - DNA, 160 bp, Homo sapiens
atggcgtaatggctgctcagtgtggagttcgggtgccgtgaagatcggcgactacggcctcgtgaagatcggcgattatggtatggtgtttcggcgtgtgcagtgaagatcgccgatcttcacgcgtgaagatcggcggttaggaccttcggcgtgtgca

SEQ ID NO: 582299 - DNA, 1297 bp, Homo sapiens
cccgccctggcgcccgccccgcggactgctgccacctacacacacctggcaaacacgccccctctcctacccaccgcaccgcaacctccacctaccaccacgccctacccgcgcgcactaccgcgccccgcgcgccccccctgcgcctgcgcccctcctcctcctaccaccgcacctacccacacaccctcccctgcacacaccccgagcccctggccgcgctcacaccctggccccgacccccctacccggcacgcctcctcacacagccgcccctggcgcgcctccgccgcgccaccccggcccccagcagcgcgccgcgcccgcctgcgccgcgccacgccctaacctctctctcctgggctcaagggcccctcgcgcaacacccgcgccgccgctcctcctcaacgcccctcgcccctcctctcgcgcacgccctggcacaccgcccctgcactctgctcccccaaccaagccaacggcccgctgactcacccgaacgaaccgcccctaacacccaccccggggcaccaaagctaaccctctcctacccccccccgccgcgcgggctgagccagcccgggctggcacacggctgccacgcggcggcgccccccaaccgagaccgcaccggaccgctcccccagcacaccgcacccacaccgaacgcggcctctcacgccccgaaaccgcgcccaaccggcacacacaacccccctgccaccccacctccgccacacacacaactgcaaccccaccgctgaaccaacgccccacgcgagacggggctacccctgaccaccggaccaaccagcgccgcggccacccacccagcataggccccccacgacgaggagcgtcgctacccacccggcacctcagcaggcacaccatccccgcctcacccccccaccccatcacgcacaccccaccaccccaacccccaccgacccactccccgcgcaagcacccccacaggcccacccacgcccagcaacccgccaccagcgaacacccgcccgcacccaccatcacccacacccccaacatcccacacccactcgccgaccgccccaccccccccactgccctccccgcccccccacccacaggccaacaccaacacctcacacacacacgcacaacccacaccgcccccactccccacccccctccgcccaccgtcacccccccccacaccagcccgcccaccacaacaccaccgacccccgcccactcctctgctctactagagtcccccccccacaccacccagtagcaccccccccaccccccc

SEQ ID NO: 582300 - DNA, 438 bp, Homo sapiens
cacccaggcgcacttctggctgaaggggggaggtgttactgaagcttgggcactcatgtgtgtgccctccccagtcccctatcctagtgtggccagtctcattaggcagccattgatcagcctggaacttggctgtcattagtgacttgatcctggtatgacatgcattctgcgtattaggttgctcgggtattttatttccttggccacaattcccatagatccccatcttttcgtatcgcctcagtctctcaatcgatctcttttgtttaccacgtgctatcacttagtgtgagtcaagaagtgcgcctgggtgccacccaggcgcacttctgcacccaggcgcacttctgggagatggtcgagaagaagaagggagtctcaggccagaaggatggtggtcagacggaatccaatgaggaaagcaaagaaaatcga

SEQ ID NO: 582301 - DNA, 382 bp, Homo sapiens
ggggtgcctgcctccatttcctgttcattttcagctggcctgccaggagccaacggggagcctggcgggaggcgggggtgcctaaagctttcaaaaagtgagagccccaacctgaggagtggacagggaccaggaagtgggggaagggaggccaggaaaaggtggatacaggagacccttttcttttcatttcagaccctagaggggtccccagatggggacccaagacccagccagccccctggatggcccgggcaagtaacaacctttttgtggttcatttgagggcccggtgagagttaccgtcggcctccccgggcctcccccctctttcatgtaaggggccaggtgttagtttttgaagatatttgcaaattataca

SEQ ID NO: 582302 - DNA, 674 bp, Homo sapiens
gaaaaaaacagataaaccagccatcagaataaaaaactttggggcttcaaaagacactatcaaaacagtgaaaagacaacccaacagaatgggaaaaaattgtttgcaaactataaacagtaataagttgcttgtatctagaatatataaagaacaattacaactcaagaataaaaagacaaatagcccaattcaaaaataagcaaaggatctgaagtagatatttctttaaaaaagatatacaaatggccaataagcacataaagaggtcctgaatattattagccatgggagaaatacaaatcaaaaccataatgagatatcacttcatgtctgctagggtagctttaattaaaaagtcagatgaggccgggcacggtggcccatgcctgtaatcccagcactttgggaggctgaggcaggtggatcatgaggtcaagagatcaagagcatcctgaccaacatggtgaaaccccgtctctactaaaaatacaaacattagctggtcatggtggcatatacctggagtctcagctacttgggaggctgaggcaggagaatcgcttgagcccaggaggcggaggttgcagtgagctgagatctcaccactgcactccagcctggtcgcctgagtgaagatcttgtgctcacacgacacacacacaacaaagggc

SEQ ID NO: 582303 - DNA, 148 bp, Homo sapiens
atcgcgtgcagagaaacagatcggccccagcagcgcgttaaggctttagtctcccaggaaaacagaagagccagcctgacaaagaggtggctggaggattcagagtcgctgtcaactgctcacagaggaggaactggtgtcaggggct

SEQ ID NO: 582304 - DNA, 137 bp, Homo sapiens
  misc_feature (1)..(1): n is a, c, g, or t
ngactctagaggatacactcgctattcatcggcacctcgctattcatcggcacctcgctattcatcggcacccccccgagtgttacagcccccccggcagcagcactcgccgaatcccggtgccgatgagcgaggtg

SEQ ID NO: 582305 - DNA, 319 bp, Homo sapiens
  misc_feature (33)..(33): n is a, c, g, or t
  misc_feature (43)..(43): n is a, c, g, or t
  misc_feature (77)..(77): n is a, c, g, or t
  misc_feature (82)..(82): n is a, c, g, or t
  misc_feature (120)..(120): n is a, c, g, or t
  misc_feature (164)..(164): n is a, c, g, or t
  misc_feature (172)..(172): n is a, c, g, or t
gaacggcctgtccaaagatcctctctcataggnacagcagaanagctttttacactttaaaaaaaaaaagacagaanagaanaggtcgaaatttcttttgggacaatatttaataagtgntgatcaggagatgcatcagtagcagcagcctatagcaagagctnataaatgnttgtgcaaattagcactctgctccccctctagtaaggatactagtagcacaacctcttccccccaccccgccccgccttttggtcgtccatccctgtccctttctggccctcttcctgtagcccaatctcaggctttcctctacctg

SEQ ID NO: 582306 - DNA, 834 bp, Homo sapiens
  misc_feature (700)..(700): n is a, c, g, or t
gggcagaggttgggaagatggcgtggacgaggctgggcgcagataggctggggctgcggccaggcgtggggtgcgttggtgggcggtcgcagtctgcgaggagctcactgcggtcctaaccccgccgcagatcctcggacgcaggtttaacttctttattgcagctaaaaaatgcgtgattcagaaaatgcacccaggtaatggttgaacctcgtagatgatcagacccaagggacacaggtggtgaaggctatacaagagaagtgctttgattcctcctgtggacgaagcagtcttttgatctcttctccctctatcgctataaggagtcctcataaggacctttatttgtttagcatgtagggtttacagggttgtgcttttggatcagctgctatttgggcaactatgaagtcagtgaaagtccagggtccacgatgttattttgaatggtataataatgctgatgggttggatagtgataagatcagaagaaggaacggagattgcgagaaaggaggtatgaactacacgttgggtggaataacccgtaagttgactgtgccagtcggatctgttgaccgggctatgagtacgcctggtacacactgttgcattgttactcctggcagatgggcatgagtacactttcttcttggcaaagaggtacaattgatcagaatatatgcaccattcgaantccgagacctgcatgatggtccttgtgtaacgtaccgatatgttgcatggtcgaatcagttccatgtctatcgtcctcccttattctcacatgtgcgaagtgaatatgtatggtctcgtggagcttctcttcca

SEQ ID NO: 582307 - DNA, 114 bp, Homo sapiens
tatgctgatggcatatagagtattctcgaggggatcttggtgactgttctgactttagaagcacttcctgtggacgatggagggccctgcctcatcatactcaggcttgctgat

SEQ ID NO: 582308 - DNA, 317 bp, Homo sapiens
tgcatggcacggcgttgaggcggtgcttttccttttctcattggcggaagccgccgccgtctaggcggcagaggcgtccgcttgcttcaccgaaggagaacgagaagagaccccctttcccttctgttgcaggcaatggaaagggcaggtttggggtgaggaggaagcaacgtgaaaaaatcgacgacggccgcattgatggccatatcgatgctcattggggcgggagggacgtacgctggccttcagttggcggaccgcccgatggaaggctcgctttcgacgattgtttcgaatgagccgtccaagtcgacgaa

SEQ ID NO: 582309 - DNA, 347 bp, Homo sapiens
agagatatactaagtcgcgttgagacagctgcacatgcataaccgtctacaaaatgcaaaataggcgatgtgtgcacgctctagatccagcactcggaggtgagtggagaacgctgaaccgtgagtgaggctcagtgagatgagacggtgcactgactccagctaggttgacagattaggctccgtctcaaaacacacacacacacacacacacacgaaaagaggttgacgaataaggtcagatagaccatcttaggcttgagggttacaagagtggcaataacatatgtcagttcttacagtatctccttaatcacatctgtaaggactgggtacattaaaaacaa

SEQ ID NO: 582310 - DNA, 140 bp, Homo sapiens
  misc_feature (123)..(123): n is a, c, g, or t
acatacgactgcaaatatccttcaaaaccaaagaaatttctcaacaacaaaattaaggctgggcaaggtggttcatgcctgtagtcctaatgcttcgggaggctgaggcaggagaatgtcgtngaacccagagaggcgga

SEQ ID NO: 582311 - DNA, 160 bp, Homo sapiens
cgcttcacttgttggtctctgcatacggtacgaaccagtgcaggggtcaagaagcactgaccctgaacctgggaggcggggcacactgcctaacactgttctctgctgcacgccccatgtatcaccacgcgggaagcaaatgggttaacaacagatcctg

SEQ ID NO: 582312 - DNA, 679 bp, Homo sapiens
  misc_feature (1)..(1): n is a, c, g, or t
  misc_feature (72)..(72): n is a, c, g, or t
  misc_feature (100)..(100): n is a, c, g, or t
  misc_feature (107)..(107): n is a, c, g, or t
  misc_feature (109)..(109): n is a, c, g, or t
  misc_feature (129)..(129): n is a, c, g, or t
  misc_feature (138)..(138): n is a, c, g, or t
  misc_feature (145)..(145): n is a, c, g, or t
  misc_feature (153)..(153): n is a, c, g, or t
  misc_feature (156)..(156): n is a, c, g, or t
  misc_feature (160)..(161): n is a, c, g, or t
  misc_feature (170)..(170): n is a, c, g, or t
  misc_feature (181)..(181): n is a, c, g, or t
  misc_feature (186)..(186): n is a, c, g, or t
  misc_feature (190)..(190): n is a, c, g, or t
  misc_feature (193)..(193): n is a, c, g, or t
  misc_feature (195)..(195): n is a, c, g, or t
  misc_feature (200)..(200): n is a, c, g, or t
  misc_feature (223)..(223): n is a, c, g, or t
  misc_feature (234)..(234): n is a, c, g, or t
  misc_feature (252)..(252): n is a, c, g, or t
  misc_feature (273)..(273): n is a, c, g, or t
  misc_feature (275)..(276): n is a, c, g, or t
  misc_feature (300)..(300): n is a, c, g, or t
  misc_feature (302)..(302): n is a, c, g, or t
  misc_feature (359)..(359): n is a, c, g, or t
  misc_feature (526)..(526): n is a, c, g, or t
  misc_feature (560)..(560): n is a, c, g, or t
  misc_feature (668)..(668): n is a, c, g, or t
nggaacttaagttcacttcactgcaaagtgacctgagaacaccctctagtggaaattattaataaaacaaanaccatgcgcctaattcaccttctgatanaagaatngnttttaaattccccaaaaaanggaaaaaanaaaaaanaaaaaaanaanaaannatctttaanaacacaaaaanaattntcanaangnaggantacccacccatgcttagtacccngactgccaaancacattccttcctcaganactctgactttaatatattcnannaaagggagaaatgtcgtggggggngngacttgtccccttaaattttgggcagactgcctgctggtgccagaatgatgccaaanacatagaaaagtcccagcaggaggttgagcttggcagttctctggggcagtttgttgaaggcctggcttcgaaactgtctctcaagggagaaggccatgggaatggtaagcagggggagtgccaggctgagggtgcgagtgtgtggccaggatgctgaagaccaggnagggcagggagagcagtgtgttgtagagaatgtnggagaacgtggggccgatgaggatggccagcgtgacgataccagcctcccggtcggactccatgtccctggtgttgttggaatggagaatggcctcggtgctgagggngagggggatgg

SEQ ID NO: 582313 - DNA, 1856 bp, Homo sapiens
  misc_feature (276)..(276): n is a, c, g, or t
  misc_feature (500)..(500): n is a, c, g, or t
ggatggagaggagacggatcagcctaccggtaggtcgaccgctcctacgtgtcctacaggggagaggatggtgggggtgccttgtgttctcctgtgccgccgttcgtgggtctcgtggccgcctcgtcctgtcctctggtgtctgggatgtcctcctctcctacctactccgaacccggtgtgagtactatactaccgcatggccttgggagtcagctcgaactgcgtaggctttcaaggtggaacggcgcgcgcgaacggtggtaggactgctgnctatgaatggagtgcaatggagtacgccatgcatagtagtaccgcgggtttgggactcgaggcgtaactattccgaacgcaaacggttgtctggctatggctggaaaccatgctagagaaccaaggacgtctggctgtagctgccgtctggaacacacagggctcgactggggtcctacgggcaagctcgcgcataccacagcgctatggccacgatacgaatnctatgcaagagtgtgagaagggctagaaggcagaaaggtgtggtgccatagcagtgcgtgcagaattgcagagtttcaaccccgtatcaacaagtcgtccaccggaacatgggaacggggttcgccacgcagggggaccgagagtcactggcacgaggcaggagaaccactgcgagttgcgagccatggtttgagagacggtgcgagccaaacgtcttcaccaaggggtaaatgggtacaccatcttccacattttccgtagaaatgtggtgataggcgccacaaggcccgggcacgtacagacacacagcgcggtgggtggcatgcgccctccataaggataaccaagggcaagaggccgagcgaattcgcacaggggccacactccaccttgtcgcccctccagttaccatagggactccctagggagggggaaggggaacaccgatgaccggcaaatcgggcattgggaaggggcaagggtaaggtaaccccgtggggtctctcttattggccaagcgcgacatcgaatacccgggtggaaaagaggaaaggagcaaaggggaaccgaggggcaaaacctcccccaaaggaacgcaaagtgcgtgggtcccccgaaggctagagcccagaggcatccgcacggggatgcgagaggcgttgggccgcgattgtgacccccaccgacccatttaacctggtcaccctgaggaaagggctgcccctggacaaagcgaagaattcccacggaaacgaccacatacacggtagagcgcaaaatggggcgaagactgagcaacacacaataagtggaccagtgacaacacggcgtgaccaaaagggtggagagcccggaaccacaacatgtggccagggaacgcggtatcaacagaacggatacgcccagctaccggcccaattgcggggaaggggagtcacacgcgacacacgagagcgaggtagccaataacgggtggacagccgacccacccgttaggtcgccgttgtagaatgcgccgcagaatcactgggcaaacaagcgggagggaaacccaggcccagggagaaacaacagatccccgacgaaacaaacctcatctcgcgcaaacaaccaccgcgagcacacacagatggcgaacggaaccacatacaaacgaggcacgagcgaacaacaaccaagagcaaaacaccggcacacgcacgcagcacagtctgaatacaaacacagagaactgatcagatgagagaacaaaccaccgccacaaccaagtcggcgaggcccgcagcggacgagtacacacgactagcatacgacaaaacgccacatgagttcagatcgcatagaacgccgcagtt

SEQ ID NO: 582314 - DNA, 853 bp, Homo sapiens
gtgcgctgcacctcgaatcgggttgtgaccgaaatgatatagattgtgtggccgtttcgtgcaaaaactcggggatgctctgccggaggagattcgggagcccgctctgagagatgagcagtatggacttttgaattagttgtgcaagagaatatcagaaattaattgggcaatgcttggtcaggaagttttcagataattgttcttatgtgagttctgtaacatcaatagtagattgaagatacagtttgagtgataatctatagttatgagtatagacgcataagaatgtaagcagttattccaaaaagatcttggattgtgtcatcaataatacataacaaggcagagaataagaagattgctgaagcaagtactcatccctgtctgtagccatccactggacctaaaatatgaccctgatccagaccccttcatatggaaacttgtgaacaatgccgacggggaacactgtggcaatagggacgagtcagtgaaggtcatgaagtcctgtgactctgtattaatttgagcaaggagagggatctgcccgagttctggcaggatgcagctgttattcagacttcagaggattcagacaagaagtcttgttcgagttgtccatagggataccgaggatgtaaatctgagaagtttattgcacagattggaaacctaatcaaaagagaatgctttcaggtaaaagctctgacatggtactgaaaaagagagaaattaaagatgtccccagatgaaatggggttcattggggcaagaaattaattgttcatggaatttcggctggcttgggggttggaataggggctaaattgattaagtattaactggaaga

SEQ ID NO: 582315 - DNA, 725 bp, Homo sapiens
  misc_feature (666)..(666): n is a, c, g, or t
gcaatgtgaaggccaaaactaactgaggggccccttttccgagtgaatcccctatcactccgccttttctgcaaaatcgccttcttactcctacgccaatctctgttcaacctcgacaactccacctaattcctcttggccctaggtgtccttgtagtgtcgctgtagctctgtcagtactttgcaagtttacggtgaagctgtctgtctggtatctccttacttcatgctctggtgctccttggcttcggttctcgtcaaacatcactgtaggggcttggatgtgtcagtgaagcgtgaggagagtctcatggctatctctttctcagttggttgatagatatgttgaaaacatcttggcttcagggaggggttgcctgcaggcctgcacttgaggtggccccaccaggagaagcatctcctaaggatgatcttttctgatgcctagaggcctggttcttggggtgaggaagagggaggtatggacatgtcttaaaatctcatatctccttaccaaggctcccggttgggtggatcgtatgtttagaggggcttaggatagtcagcgtgctgactggggtatagaaagaaaattcagatgtccttagcctagcccttgtagtcagaatcaccatggtacagcaaagaacagagtgatgggaaatntacatgagatggctggagtctgtattctgatttagactcaataaagtttttggattgaa

SEQ ID NO: 582316 - DNA, 126 bp, Homo sapiens
tgcagatgtatctccaggcttagcaatccagtttttgtttcttgtttttcgtttatttgtttattagtgatttttgagacagagtctagttctgtcacccagtctacagtgcagtggcgtgatctt

SEQ ID NO: 582317 - DNA, 479 bp, Homo sapiens
ggctcggccccagttacacagctgagcagtatccatcatatattatatatatgacacatatatacatacttatatacatatatatacacacacacacactatcgtatatacatatatacacacagcagtttatccattcgttgataggcatttgggttgcttccatgattttacacttgtgaattgtgctgctataaacatacatgtgcaagcatctttttcaaatgacttcttttcctctgggtagatatccagtagtgggactgctggatcaaatggtagttctactcttagttctttaaggaatctccacactgttttccagagtggctgtactagtttacattcccacagcagtgtaaatgtgttgcctgatcactgcatccacgccaacatctactgtttttttatttttttattatggccattcttgcaggagtaaggtggtatcacattgtggttttgatgtgcacttccct

SEQ ID NO: 582318 - DNA, 326 bp, Homo sapiens
gctgtttgaagagacgactcaagggcatgctctacacctacctgacgtcatgtcgagtacttggaccaccggcggaagccagccagatcacccagcagtccaccaaccagagtcgcaatcccgacaccaccaaccagacggagtttgagcgcgtcctctgagggccggcgcttgccactagggctcttgtgtaaatactcttctgctatgtgacttgcatcgtggagacagggccatttgagtttatatctctcatgcatattctatataattccccaccctgggctctgggagcagcccgctgagtggactggagtggagcattg

SEQ ID NO: 582319 - DNA, 106 bp, Homo sapiens
tccatttttatctggggctgaagctttggcactatgctttttacattaggaacgactgagcaggctcaggctaatctcatctgcattaagctgggcaagggcaatg

SEQ ID NO: 582320 - DNA, 421 bp, Homo sapiens
cacgaggggcgatggtgtctgatcggggtaccacctcagtgaagcctgtgcggtccccggtggggaggcagtcatcgggggtcatcctcaggtccagcccctcctgcttccacaggacgtccatgatgctggatcatctgcagggtcaggatgtcctgccggaggtcatccccgttcttaaagattatgcccattctggcgccgctgtgtgcctccgcgttggtgtacatgatccacaggggcttcatcttggattccatgaatgtgtactgctccacgcagacttcaatcagcatggtgctggggtcgagtggggactgtaggtggtatagggcctctaggtatgtctcctgccgcatgcacttgtgcatcatgtccttggtctggggcttgggggtcttctgagagctcaacttgacga

SEQ ID NO: 582321 - DNA, 1085 bp, Homo sapiens
ttccacgcggccgtgtttgtccctctgtggcctttttttggtcgcctcattggccgcgtgtgtccgcaaaaaaccggcggtgggcccgggtcgggagtttcccgggggaagtgtcgctgggccccaggcggtgcccgaaaatgtggtgtaaccccttcccctctggccccctttgcaaggggcgcccgtttctggccccctcctgtgtgtgccctcccgggcttacaccaaggtgagtgtgaacggccaggtcgcggttacggctccttcagtgctaggcctttttgcccctccccgctggcccgtatggcccgatgatgggcgccggaatgtaacccgagggatagcaccaattccacaggcccaccacacacccaccgtggtcccaaaagggcctttcggatacgggataatccctatttagttaccctccgaaagtgttgtttgtcttctccacggattttgttcctgagccccttttagccacctccacgccctatgcccctctatcgcccccccactttaggagggcacactgggccccccacacacggcactcacccccgccttagatttcccgctatgagaggtgcccaccgtcgcttaacaccactccgctatttatctcgccactcacggagttatttcacattcaccctgaggcctcacccacatatgttttataatatgaaaaccacacccgcaaaccccacacattataattcacagcccaccgtggccttatttaccacaattttaactcgggttcttctattttaaccctccctaccacagccctccacgagtaactttcgaagttctccccttcacccacttttccgaccggcaattctacggctcacaaacttttttgtaaccacacacggcttccccggacttcaccgtcactctaattggctcaaactttcctcacctatctgcttcaatcccccacactaatattttcacctttaacacatccacaaacactcacctttggcttcgaaacccccccctgatactggccttttgtagatagtggtttgactatttctgtatgtctccctctcttgatgagggtctta

SEQ ID NO: 582322 - DNA, 389 bp, Homo sapiens
atgtattgaggacagaaaacatagaggctgcctcagaccacatgcctagtttagcagattatgtgcatttgtgagggacattttgtggattccttaaagataaccagtggtgggttctgatgggaatatattccctcatctggactaggccaattggaagcagtctctttcagttcacctccgtacagcacaagttgttcctgctcatgacctcattgtaggaaaatgagaattgtggtgctggtgactttcatgtgtcttgggaggcttgaggtgttcaacatcgttactggcatccccttacgcaaacctcctttttttaaatgccaattgtacatctacattaattcatctatgccaacttgtgttttcatggtttgttttttaca

SEQ ID NO: 582323 - DNA, 434 bp, Homo sapiens
  misc_feature (9)..(9): n is a, c, g, or t
  misc_feature (172)..(172): n is a, c, g, or t
  misc_feature (394)..(394): n is a, c, g, or t
  misc_feature (422)..(422): n is a, c, g, or t
aggttagtncccttagttccccatgttaatatttttaatatgtcctaaggagtgaaggaatgccctgatgaaatttctttcctaggtctgcctactaatcagcacttttatatcctcatcctgaaagataggaagattttaaaagataaaaacattttaggctgggtgtggntgtcacgcctgtaatcccagcactttgggaggccaaggcgggtggatcacccgaggtcaggcattcgagaccagcctggccaacatggtgaagccctgtctctactaaaaatacaaaaattagccaggtgtggtggcgggcacctgtaatcccaggtactcaggaggatgaggcaggagaatcacttgaacctgggaggcagaggttgcagtgagccgagantctgccactgcactccagcctgggcaancaggctccgtct

SEQ ID NO: 582324 - DNA, 711 bp, Homo sapiens
gtttcccaggctggagtgcaatggcataatttttggttcaccaaaacctccaccttctgggttcaagtaactctccttagtagctgggattacagggctgcaccacacacctggctaattttgtatttttagtagagatggggtttctcccattgtttggtcaggctggtcctccaatcctcccttgaaccctcagggttgggtcttgcctgctttgggcctccccaaagtgtttgggggtttcaccagggcattgaagccccaaccttgtttggccccttggggggcctttgggaaaaaactcgcacaacaaacacaagggggccccctttatttgtgcttatcgtgtcaacaaaaacgggggggccacacacacgggggttttatgcgccttcccagaaaaaggcacgccccccgttgattaaaattttgaccccaagcgaagtttaaagctttcccaaggttaacgtttggggcaccggaaggaaaaaaccccggttaagcaaaaggcttggtttgaaccaaggcacaattggcttggcggccaaacaggccccatggcgttaaaccaaaggggttcccttccccaaaacttctccacgtcatttcgacacaactttctgtggtcgctgatcaaactctcatcacgcctgcggggaagcctaatgtctgccatacctaagacacttctttcgtctttgttaacaaaag

SEQ ID NO: 582325 - DNA, 402 bp, Homo sapiens
aaacgatgatagagcttagtgagcaaggcagtcaaaagcagaggaaggcgggtgcagcagcatcatgcctgtgtacccagcacagtgggcagctgagagaaggagggtgcgatgagcccaggagttcaaggtcggcctggacaacacggaccccatctctacaaaaaataaatttaaaaaattagatgggcatggtgatgagtgcctgtagtcccagcaacccaggaggctgaggtgggaggatcccttgagctcaggaggttgaggctgcagtgagccatgatcgtgccactgcactccagcctgggcgaccgagcacgactccgtctcaaacaataacacaccacaaacaataggtgaacattccttataactccaggttgggctcagccgacgggacgg

SEQ ID NO: 582326 - DNA, 425 bp, Homo sapiens
  misc_feature (1)..(1): n is a, c, g, or t
  misc_feature (8)..(8): n is a, c, g, or t
  misc_feature (60)..(60): n is a, c, g, or t
  misc_feature (274)..(274): n is a, c, g, or t
  misc_feature (316)..(316): n is a, c, g, or t
  misc_feature (366)..(366): n is a, c, g, or t
  misc_feature (385)..(385): n is a, c, g, or t
  misc_feature (393)..(393): n is a, c, g, or t
nattcggnacgaggggtttcaccatcttggccaggctggtcttgaactcctgacctcatnatccacctgcctcagcctcccaaagtgctgggattacaggcacgagccaccgcacccagcccatagtccctttttaaaggcactggtgtgggccttctttttttttttttttgagacgagtcttgattgatctgtcacccaggctggagtgcagtggcactatctcggctcactgcaacctccgcctcccgggttcaagtgattctcctgcctnagcctcccgagtagctgggactacaggtgcccaccaccacgnctggctaactttttgtatttttactagagacagggtttcaccacattggntcctgaccttgtgatccgnccgtgttnggccttcccaaagttactggggatttacaggg

SEQ ID NO: 582327 - DNA, 136 bp, Homo sapiens
cattgacatgctcggagttccctctgtgtcatcgaccgcctctcactgactagttgactgcatcgatccacactgtcgtttcctggtcgccacacccaattccttgtctggctatcatgtgcaagtctggcgacgt

SEQ ID NO: 582328 - DNA, 701 bp, Homo sapiens
gtgctggggagactcccatgagtaccgcctctgccagttgccagactgccccccagggctgtgcccttccgagacctacagtgtgccctgtagcaatggccgccctgtgcctgggcacccagaagacctaccagtggtgtgccctttccatggggcgcccaacctatgtgcgatccttcaacgtgcctggtctgaggggcatcgcctttctatccactagcgttcggaccgctgttccttggactggctaccgcctgtcagctccgtggtgcccaggggggtctgcgtggctggccgctgccttagcgccgtgctgtgatggggttgttcgggctctggggtgccctcgtaggtaccgactgtggtccgtctgtcggaggctgctcaacgactcgtgccttttcgtgcggcgcgtgtttcgtgacgccggtgccttcgctgggtactggaagcgtgaccctgatccccgagggcgccagacacatccgcgtggaacgacaggagccgcagagcacctgggcactgatggggggcgatgggcgctacgtgtcttaagtgggcactgggtggtcagtccaccaggacctacgaggtcggcggcacgcatgtggtctacacccgagacacagggcccaggagacgttgcaagcagccgggccactcccatgacctgctcctacaggtctcctgcggagccaacc

SEQ ID NO: 582329 - DNA, 276 bp, Homo sapiens
  misc_feature (215)..(215): n is a, c, g, or t
  misc_feature (245)..(245): n is a, c, g, or t
tatcggtagaagtcgtgctggcgggcgtgggccaggtgggcaccaccaccctctaccccaccgcggtcatctcgccgggcaatgacggctcgcccattggcacgctgacggtcaacggcaacctcacgttcggcgaaagcaccatctatcgcgtgcacgccgacccggcaagcaccgccagcgaccgcatccacgtcacgggcgtggcctatctngacggctccgtggctcacgtcggccccganggcaactatgcaccgcgcacgagcgggtacc

SEQ ID NO: 582330 - DNA, 233 bp, Homo sapiens
actgcccgtgggggggcggcagaatcactgtggctccaggtgggagtcttctgctgctttatagtccagaagcccactatgctgaagaatatgttagagactgatgtatttctcgggggagagatggtaggtcacgctgtgcataggtaaaatatacatatatatgatgcatctaactgggactatggggagagagccctccaaaagacctctgagcctcagaggcagactga

SEQ ID NO: 582331 - DNA, 618 bp, Homo sapiens
  misc_feature (38)..(38): n is a, c, g, or t
  misc_feature (214)..(214): n is a, c, g, or t
ccagtccaccgtccccattgtgggcatagtgctgggcntggcgttcctaccagtgtggtacatcgaaactgtggtcgcctctgtaatgtgtagaggaaagagctcaggtggaaaaggagggagctactccaaggcggcgtgcagcgacagtgcccagggcttttatgtgtttttcacagcttgaaaagcctgagccagttgttttgtgagggantgagaagcaggattttttcacgcctcccctttgggacttcaagagccttgggcatttttttttgcaaaggcacctgaaggggtttgggtccctgttagcataatgtgaggaggtggagagacagcccacccttgggtcccctgtgacccctgttcccaaggtgacctgggtttcctccccagtcattttttttgttccaaaaaggtggggcgggatgtttccatctctgtttcaactttagggggcctggggggcaactttttacttccctactgaaaataagaatttgaaaaaaaatttgttttttcaaaaatttgctatgagggggtgagggattaattaaaaaaggcaattccgggaatttgagagggcaaataaagacctgagacccttccagaatttga

SEQ ID NO: 582332 - DNA, 432 bp, Homo sapiens
atgaccaccaatcacatgcctatcatatagtaaaaccagcccatgaccctaacaggggcctctcagccctcctaatgacctccggctagccatgtgattacttcactaccataagctcctcatactagctactaacaacacactaaccatataccaatgatggcgcgatgtaacacgagaaagcaccataccaaggcacacacaccacctgtccaaaaaggccttcgatacgggataatcctatttattactcagaaattttttatagcagattatgagcttttacactccagctagccctaacccccaaataggagggcactgcccccaacaggcatcagccctgtaagtccctagaagtcgcactcttaaaacagatccgtatgactccgctcaggaagtatcatcactgagccaccatagtctaataga

SEQ ID NO: 582333 - DNA, 239 bp, Homo sapiens
ttttttaaaaatgaaaaggtttataatttccctccagtaaaacccccctttttagggtctagtctgtgaattttgccaaaggcagggtttgggaccccatcgataggccggttttgccccccgggccattcccctcggttccttggttcctctcttttccggcccccaagcaaccccgggggttttcgggccccctggttccttgcccttttttttaaaataaaattttttaaaatcta

SEQ ID NO: 582334 - DNA, 116 bp, Homo sapiens
tcagctcggcctgattcaccttcacatttacagtatagaaaagcacactccatgagaattcacgtgtggtatagggtggtatatgggtgtgtatatgggtggtatggtggtatagt

SEQ ID NO: 582335 - DNA, 165 bp, Homo sapiens
cctcaaggtctccccaaagcagtgactactcacagcaagggcattggccctctaggggcagaagctgcctagttcttacctgaagaaactcctactgacaggcagatcacattggccctatagcaggcagtcaggctagtgggcacacacaagggcccctcttca

SEQ ID NO: 582336 - DNA, 806 bp, Homo sapiens
tctccaacaaaagtcagactctcacaccactcacgctcttatgcagggtgctccaccagcattatcttattccaacctcaccttggggtaagccacctctcctctctccaggaacactcacaaactcgtcattacttatgtcaactatttttctccttccatatgttatattcttttgtgttacactcgcacaattccagccgagaacatattttttttcacacgccccccactcactctcacacaagaaaatagaaatgccttactctctttctgaaggaggagaggtatttatgttcaagaaacttcttcttgtcttatatagacaaacttagccaggacactccacccatttctactactctagtcttcccacacacacacacaattttgtcgtcactcgcgtacagaatttaagatctcacttccaatttttttagtgacacacacacacgcaccctcttgggctctctctatcttcctatatattaacctacacacacaagccattacatttttaatcctcacactcaacttcgaaggtatgatatcgtgctgccactctcacatctatttatatataaaactatctatcactcaccccactgcccaccttattgttcctatgactcccttctgtataaataatggagaataaaatgtggtagtaactactctttctattctgcgctctcttgtcttagaagtactattagaacacaatattattgtttcttatataagtactatgaaaattaatagatgcaaatcaataaacaaccaacaaatacaatagaaccaaaaca

SEQ ID NO: 582337 - DNA, 191 bp, Homo sapiens
tggtgcgatggatgccagactccagtgaacccacaacggatggtgaagtgacgagagctcggtggcctccatcctgaacttgtactcacacctccgtgggtccctgcatgtgacacgcagggtcatgctgcacccagtggcagtggccaggctcctggcgccccatggccccccatccagtccggtgttct

SEQ ID NO: 582338 - DNA, 317 bp, Homo sapiens
  misc_feature (20)..(20): n is a, c, g, or t
  misc_feature (82)..(82): n is a, c, g, or t
  misc_feature (184)..(184): n is a, c, g, or t
  misc_feature (193)..(193): n is a, c, g, or t
  misc_feature (206)..(209): n is a, c, g, or t
  misc_feature (219)..(219): n is a, c, g, or t
  misc_feature (227)..(227): n is a, c, g, or t
  misc_feature (230)..(230): n is a, c, g, or t
  misc_feature (240)..(240): n is a, c, g, or t
  misc_feature (248)..(249): n is a, c, g, or t
  misc_feature (270)..(270): n is a, c, g, or t
  misc_feature (272)..(272): n is a, c, g, or t
  misc_feature (274)..(275): n is a, c, g, or t
  misc_feature (280)..(280): n is a, c, g, or t
  misc_feature (293)..(293): n is a, c, g, or t
  misc_feature (295)..(296): n is a, c, g, or t
  misc_feature (311)..(312): n is a, c, g, or t
agaacctattcatttttggnttgtgtttagcttaaattttatcattaaattaaggggcccacaacaaaatgtgttgccagcngccatatcccaagcccctgcgtgaagaatgttttggctgctatttcaacctaagggaacaacgtttgacctcagtcaccttaaaatgccagtgtgggcagangattttttnttcctcacaattnnnnaccaaacggnaccccctnggntcttgagggncctatttnngagaatcttcatatatgcgangngnngccanaatggatacgttngnntcagttatcattgcnncccag

SEQ ID NO: 582339 - DNA, 279 bp, Homo sapiens
  misc_feature (199)..(199): n is a, c, g, or t
  misc_feature (212)..(212): n is a, c, g, or t
  misc_feature (257)..(257): n is a, c, g, or t
aaaggaatatttatccctttaaatgtattcagaaagccagcactttggggggccggggcggatggatcacctgaggtcaggagttcgagaccagcttggccaacatggtgaaaccctgtctctgctgagaatacgattggctggacctagtggcgggcgcctgtagtcccagctgctagggaggctgggacaggggagncgtttgaacccangaggcggaggttgcagtgagccaagattgcgccattgcactccancctgggtgacggcctctgtctc

SEQ ID NO: 582340 - DNA, 226 bp, Homo sapiens
  misc_feature (2)..(2): n is a, c, g, or t
cngtggggcatgggtgctcggaccacttatggagtaccaagatctatggatgctcaagtccctgatataaaatggtggactatttgcatataacctgtgtacatcccggtattatttaaatcacccctagatcacttataatacgtaatacaatgtaaatgccatgtaaataacctgttatactgtcattaaggaataacaacaagaaaacagtacatgttcagtc

SEQ ID NO: 582341 - DNA, 200 bp, Homo sapiens
tacgtcaacggactcagcagatgcgtatgatccgtggcatgggctcattgacattacaaatttgcccctctacaatgtacccacctcatgctagcctcactaaactggaattactcctccgacgagaacattgtccttaaacctcgtgtctgattttagaactggcattgtagaacttggagtctgatttagaccttgtt

SEQ ID NO: 582342 - DNA, 266 bp, Homo sapiens
  misc_feature (117)..(117): n is a, c, g, or t
  misc_feature (145)..(145): n is a, c, g, or t
  misc_feature (158)..(158): n is a, c, g, or t
  misc_feature (170)..(170): n is a, c, g, or t
cgttagtgcgtgaaacaccgaacttggactggttgattttgactgagcgcatggtaacgtagcctcgatgcttccggctgattggcggagcggttacagcaacgtctggctaggacncaagcgtcgttatcaggatgaagctgancgggatatacctnagttgcttgcanctccggcgcaagtgcgttggctgagcatggagccgctgcttgggcctgttacccttcgaagggttgttcatgatccgttactgccagcgctgggta

SEQ ID NO: 582343 - DNA, 1136 bp, Homo sapiens
  misc_feature (1)..(1): n is a, c, g, or t
  misc_feature (14)..(14): n is a, c, g, or t
  misc_feature (37)..(37): n is a, c, g, or t
  misc_feature (487)..(487): n is a, c, g, or t
  misc_feature (1128)..(1128): n is a, c, g, or t
naactgtgattggntcaattttaccataccgaaagantaaattcatttgagcttttacctacgcctttgctttttgttaaaggaagaattcaatgcaatgtgttcagaaagttacatttaaatcgttaataaagagaaaaaggaagagaaagagaggacaccattccgacacaaacgtttatgtgattttagccattacaacagtaattcagaaatatctcaaatgttacattgatgtcatcaatattacaaaaaaggaaaaaaaagtgacaggcaacagtgaagagcaccagagacccagcgcacacctaaagtagaccatgcttctttccttccactgccaggttatcgtcccgggaagccccccaccccctcgctttcctcctccgctttccctaacccgtctcgcgggggcatctacgcctcgtcctcgccctcctcctcctcgaactccccttgttcgtcggccgtggcgtcctggtactgntggtactcggacaccaggtcgttcatgttgctctcggcctcggtgaactccatctcgtccatgccctcgcccgtgtaccagtgcaggaaggccttgcgccggaacatggccgtgaactgctcggagatgcgcttgaacagctcctggatggccgtgctgttgccgatgaaggtggccgacatcttcaggccgcggggcgggatgtcgcacacggccgtcttcacgttgttggggatccactccacgaagtagctgctgttcttgttctgcacgttgagcatctgctcgtccacctccttcatggacatgcggccccggaagatggcagccaccgtcagtagcggccgtggcgcgggtcgcaggcggccatcatgttcttggagtcgaacatctgctgggtgagctcgggcacgtgagcgcccggtactgctggctgccccggctggtcaggggcgcgaagcggggcatgaagaagtgcaggcgagggaagggcaccatgttcaccgccagcttgcgcaggtctgcgttcagctggcccgggaagcgcaggcaggtggtgaccccgctcatggtggccgacaccaggtggttgaggtccccgtagtggggggtggtcagcttcagggtgcggaagagatgtnatacaggg

SEQ ID NO: 582344 - DNA, 1136 bp, Homo sapiens
  misc_feature (1)..(1): n is a, c, g, or t
  misc_feature (14)..(14): n is a, c, g, or t
  misc_feature (37)..(37): n is a, c, g, or t
  misc_feature (420)..(420): n is a, c, g, or t
  misc_feature (445)..(445): n is a, c, g, or t
  misc_feature (462)..(462): n is a, c, g, or t
  misc_feature (465)..(465): n is a, c, g, or t
  misc_feature (468)..(469): n is a, c, g, or t
  misc_feature (477)..(478): n is a, c, g, or t
  misc_feature (484)..(484): n is a, c, g, or t
  misc_feature (487)..(487): n is a, c, g, or t
  misc_feature (493)..(493): n is a, c, g, or t
  misc_feature (501)..(501): n is a, c, g, or t
  misc_feature (503)..(503): n is a, c, g, or t
  misc_feature (507)..(507): n is a, c, g, or t
  misc_feature (547)..(547): n is a, c, g, or t
  misc_feature (558)..(559): n is a, c, g, or t
  misc_feature (566)..(566): n is a, c, g, or t
  misc_feature (580)..(580): n is a, c, g, or t
  misc_feature (586)..(587): n is a, c, g, or t
  misc_feature (1128)..(1128): n is a, c, g, or t
naactgtgattggntcaattttaccataccgaaagantaaattcatttgagcttttacctacgcctttgctttttgttaaaggaagaattcaatgcaatgtgttcagaaagttacatttaaatcgttaataaagagaaaaaggaagagaaagagaggacaccattccgacacaaacgtttatgtgattttagccattacaacagtaattcagaaatatctcaaatgttacattgatgtcatcaatattacaaaaaaggaaaaaaaagtgacaggcaacagtgaagagcaccagagacccagcgcacacctaaagtagaccatgcttctttccttccactgccaggttatcgtcccgggaagccccccaccccctcgctttcctcctccgctttccctaacccgtctcgcggggggatgtnggggtcgtggtgggggtcgtggtgntggggctccccttgttngtnggnngtggggtnntggtgntgntggtgntcgggcancnggtngttggtgttggtgtgggggtgggtggagtgggtgtggtgngtgggctgggnngtgtggnggtggggggggggnttgggnnggggcgtgggggtggggtggtggggggtggggttgggggggtgctgggtgggggtggtgttgggggtgcgggtggccgacatcttcaggccgcggggcgggatgtcgcacacggccgtcttcacgttgttggggatccactccacgaagtagctgctgttcttgttctgcacgttgagcatctgctcgtccacctccttcatggacatgcggccccggaagatggcagccaccgtcagtagcggccgtggcgcgggtcgcaggcggccatcatgttcttggagtcgaacatctgctgggtgagctcgggcacgtgagcgcccggtactgctggctgccccggctggtcaggggcgcgaagcggggcatgaagaagtgcaggcgagggaagggcaccatgttcaccgccagcttgcgcaggtctgcgttcagctggcccgggaagcgcaggcaggtggtgaccccgctcatggtggccgacaccaggtggttgaggtccccgtagtggggggtggtcagcttcagggtgcggaagagatgtnatacaggg

SEQ ID NO: 582345 - DNA, 738 bp, Homo sapiens
  misc_feature (1)..(1): n is a, c, g, or t
  misc_feature (14)..(14): n is a, c, g, or t
  misc_feature (37)..(37): n is a, c, g, or t
  misc_feature (423)..(423): n is a, c, g, or t
  misc_feature (434)..(434): n is a, c, g, or t
  misc_feature (438)..(439): n is a, c, g, or t
  misc_feature (442)..(442): n is a, c, g, or t
  misc_feature (444)..(444): n is a, c, g, or t
  misc_feature (447)..(447): n is a, c, g, or t
  misc_feature (454)..(454): n is a, c, g, or t
  misc_feature (457)..(457): n is a, c, g, or t
  misc_feature (463)..(463): n is a, c, g, or t
  misc_feature (466)..(466): n is a, c, g, or t
  misc_feature (499)..(499): n is a, c, g, or t
  misc_feature (515)..(515): n is a, c, g, or t
  misc_feature (573)..(573): n is a, c, g, or t
  misc_feature (577)..(577): n is a, c, g, or t
  misc_feature (591)..(592): n is a, c, g, or t
  misc_feature (596)..(596): n is a, c, g, or t
  misc_feature (602)..(602): n is a, c, g, or t
  misc_feature (615)..(615): n is a, c, g, or t
  misc_feature (617)..(617): n is a, c, g, or t
  misc_feature (692)..(692): n is a, c, g, or t
naactgtgattggntcaattttaccataccgaaagantaaattcatttgagcttttacctacgcctttgctttttgttaaaggaagaattcaatgcaatgtgttcagaaagttacatttaaatcgttaataaagagaaaaaggaagagaaagagaggacaccattccgacacaaacgtttatgtgattttagccattacaacagtaattcagaaatatctcaaatgttacattgatgtcatcaatattacaaaaaaggaaaaaaaagtgacaggcaacagtgaagagcaccagagacccagcgcacacctaaagtagaccatgcttctttccttccactgccaggttatcgtcccgggaagccccccaccccctcgctttcctcctccgctttccctaacccgtctcgcgggggtatttatgncttgtcctcgntctnnttntnttngaatctnccnttgttngtnggccgtggtgttttggtattgttggtatttggntattaggttgtttatnttgtttttggttttggtgaattttattttgtctatggtttgttggtgtattagttgtnggtnggttttgtgttggnntatngttgtnaattgtttggagntntgtttgtaatagttttttggatggttgtgttgttgttgattaaggtggttgttatttttaggttggggggtgggntgtggtttatggtggtttttatgttgttggggatttattttatgaa

SEQ ID NO: 582346 - DNA, 1164 bp, Homo sapiens
ggtggcgtggagtggcgtggcgtggcggggtctcgcgtgcgcgggcgcgcacccggagctgtggacggagagtgcctccctctggcctcagtttcctcatgttgtagtagcggagcatggccctgtgacctgggcccccgagactgcccgtgcaagctcagcgcagcctgttgggcctcagcgactgggacgggaccaaggggctcggggattctcccttgccacggcctggttgcgtgactgaccctcctgttcccagagccacccagcgcaggccgggatgttcgtcctggttggaactggtggacaccgtccgggatcgcgcccttgggcaagtttgagagcgaagctcaacgactccaattgcccagaggagcttgaacaagaagttggccaacaaggtcgtgtacaacgttggggacttctgcatttgtctgtttgatatcaaccaaattggaggatgccctattgtattcccttgggggatggcgcaatcaacgagaccaaacggtcttctcgtagggcttcgttccggatagaccatttctcattcaccccgcagaagtcacgctgcacgacagggcaagggcaaagttctcgaccgaaagccggacgcagggttgtagcggtgtggggagtaccgcacacggggcaggacacgcgatgcacaacagaccgctactaacgttggacacaacgggtggagtgaagaatcccggatacccggagataggttggacggaacgcagctttttagattgggagagagtaaccgccagaacaagagggacaaaatacacgcaaattgagcacgccggtaccaggtatgagtgaggcttgtcaaaaagaatgagaggggctcgccgaaccacaccagtagtaggggagatccaacatcaagggtgaaggccaggactatgggcgcattactcattccgttggttgagaccctgagacaaagttaagcccgattggggagttcggagaaaggtatgggacccgtttccgacgaagacttctgggagaacagggtcggtaatagcccgggtcagcaaaagacaaactcgaagattcgagggccgaatgagaagaggagaaagatagagagcagagatggagcccgatacggcaactggacaggcagttcgccgacacggtgtacca

SEQ ID NO: 582347 - DNA, 430 bp, Homo sapiens
  misc_feature (2)..(2): n is a, c, g, or t
  misc_feature (13)..(13): n is a, c, g, or t
  misc_feature (20)..(20): n is a, c, g, or t
  misc_feature (41)..(42): n is a, c, g, or t
  misc_feature (91)..(91): n is a, c, g, or t
  misc_feature (99)..(99): n is a, c, g, or t
  misc_feature (134)..(135): n is a, c, g, or t
  misc_feature (149)..(149): n is a, c, g, or t
  misc_feature (190)..(190): n is a, c, g, or t
  misc_feature (197)..(197): n is a, c, g, or t
  misc_feature (211)..(211): n is a, c, g, or t
  misc_feature (224)..(224): n is a, c, g, or t
  misc_feature (243)..(243): n is a, c, g, or t
  misc_feature (246)..(246): n is a, c, g, or t
  misc_feature (252)..(253): n is a, c, g, or t
  misc_feature (262)..(262): n is a, c, g, or t
  misc_feature (282)..(282): n is a, c, g, or t
  misc_feature (285)..(285): n is a, c, g, or t
  misc_feature (294)..(294): n is a, c, g, or t
  misc_feature (339)..(339): n is a, c, g, or t
  misc_feature (347)..(347): n is a, c, g, or t
  misc_feature (370)..(370): n is a, c, g, or t
  misc_feature (375)..(375): n is a, c, g, or t
  misc_feature (378)..(378): n is a, c, g, or t
  misc_feature (387)..(387): n is a, c, g, or t
  misc_feature (405)..(405): n is a, c, g, or t
  misc_feature (424)..(425): n is a, c, g, or t
cnccgatccttgnggtttcnggtgaaatctgcacatccccnnttttatatccgttccctaccctgtaatccctaccacgtgcacttgttcngcggtttnggtctcttgtttaattgcacacaagtaatactacnnggtaaccagaatcnggtgtgaatgcgttgagatttttttactgttttgcatgatnggaaatngagaaagaatacgnataaagatagagnggcataacatcaatgcagngtnggaagnnggctcccangggctgacatggtgtgagcntgncggtgtgtnataggttctcatccctgcatagatgcagtattcttagttagtagnaaaacctnggttagtggtttaagccttgtgnggaanatngatcttaangggaaagagtatattggnagttgtcaatatagcagtnntagct

SEQ ID NO: 582348 - DNA, 482 bp, Homo sapiens
  misc_feature (29)..(29): n is a, c, g, or t
tctgcccgggtggttgttcgagaaaggangtttaaattccctcccttacagattttaccctttgggtttatttaaaaaggggttggcctttaaaaaaaattttttttaaaaattttccaggatgggggaaaatgggttttttaaacaatttaaacagtccaactgtttttgccattgggggggctttgaaaaccccttgtgttgccccccgaaggggcctgggttataattaaacccctttttgccctggacggggggtaataaaaaaacacctgccctaaagttaaaacgtgggcaaaaaccctgccggtaacattaaatgggaaggcgtttggcattaaactataaacccgaaaccagggggggccggccccctttcccttaagagacttattcccccttcatgccgagtataaaaaagcggaataatgagctcccaccgtaccttgcacgcgccgtagacatacccgaatgatcccaat

SEQ ID NO: 582349 - DNA, 129 bp, Homo sapiens
  misc_feature (79)..(79): n is a, c, g, or t
gtatgtgggtgattagaggaatcccaggaacagcggttcgggggggatgccttcattactgaggatttgtattccaggnctcgagctgtgtgcctcgcccctgaataactagattatcttgcttccctg

SEQ ID NO: 582350 - DNA, 375 bp, Homo sapiens
  misc_feature (83)..(83): n is a, c, g, or t
  misc_feature (92)..(92): n is a, c, g, or t
  misc_feature (107)..(107): n is a, c, g, or t
  misc_feature (124)..(124): n is a, c, g, or t
  misc_feature (206)..(206): n is a, c, g, or t
tatgtcagcaggatcttgtactacctggttctgctgctccatactcgcagtggagttgggccagtgctcctaccacgctgccncatcatctnctggatctgggccanctgcatgcattagcgcnctttggtctcctccaggctgttctccagggatgctttcatgctgagctgggactgcagctcaatctccaggttctgcatggnagcttcccgtggagaacatgcctggaggctctgcaccagctcgcttgttggtggccacctcgcggttccagctcctctgtctatggtgaagaacccatttcctcggcatccttgcggttctactctggcatcttctcatactgttcacgcatctcgttcagaatgcggc

SEQ ID NO: 582351 - DNA, 343 bp, Homo sapiens
  misc_feature (23)..(23): n is a, c, g, or t
  misc_feature (87)..(87): n is a, c, g, or t
  misc_feature (129)..(131): n is a, c, g, or t
  misc_feature (181)..(181): n is a, c, g, or t
  misc_feature (246)..(246): n is a, c, g, or t
  misc_feature (257)..(257): n is a, c, g, or t
ctgcaacctttctaaaccctgtnatatagatggtccaatgaggaaacagactgaggtttgtttgttttttgtagagatgggactgtnttgcccaggctgatctccagcttctggtctcaagcaatcctnnnacctcagcctcccagcactttgggaggctgaggtgggtggttcacatgancccaggggttccacaccagcctggacaacatggcgaaaccctggctctacaaaaaattacaaaanttagccaagtntggtggtgcatgcctgtggttccagctactcgagaaggctgaggtggcaggattgctttgagcccagggaggcagaggttgcagtg

SEQ ID NO: 582352 - DNA, 938 bp, Homo sapiens
tggtcaggtacgaggctgggtggtaatcggccgagggagcgctcgggctgtctgcgtgaccctgccgcgtgcaggtgtcgctggccggctggagctgggagtgaggcggcggaggagccaggtgatggaggagccaggaatgtgcagttggtgggaagtccagcttgtggtccctgagagctgtgagaaggagatgcggctgctgctggccctgttgggggtgtcctgctgatgtgtgccttgtggcctccagtcttgtccctgtgatgtgcctctgaggaagtggatgcttgaagccctgccatgtgctcccagcctggagcatgcaagagcatgtgagctgacaagtagcccttgggcatgctgtgctgtctgtgcttgtgtgtgctgggtgctagagcagatggtgaggccaccatgtgtacaatggtgatgtggcagtctgccatgtgcaacctgcttggcctgtgtactggtgtggcttgggaatggggcctagactagcagatttgccagcatatcctacgctgagtggatgcttggccgagtaccatacatgccatgtgcacataatggctccatgatcgtcacgtgcagaaatctacagacttgataacaatggttgactccattgaagctccaggaaaagatgatgaagaaccccaaggaaccaataagggaacccctagaataaggacaggaaaaccaccaggaagagaacccgatacttggaaaaaacgacacaagggcatggagaagaaactgggtgaagaacctgaggaggaaaacggcaaggtacggatagaaaagtaggaaggaaccaaggcaacaatacgagtggtagtatgacaggctcatgtggaacgggtagagggaagaaggcaaaagaggagacagaaggagacgagtccatgcaaggaaagaggaggaaaggtgag

SEQ ID NO: 582353 - DNA, 252 bp, Homo sapiens
ccagctaatatattgtgatgggaggcaagaggctgggcgtgtctttcggacccttaagagggagaaccgggagcttcgggggctgcttcagtgtgcttcagggagcagccaggggggcagcacccggtgctggaggcaccgagagaggaccctgtgcttccagtgctggaggaggctccccagaaatcctgttggccttcgaccacagtccctcaggggcttgggttcagaaggggaaggggattggagggc

SEQ ID NO: 582354 - DNA, 154 bp, Homo sapiens
agcgttttccctctgtgcagatctatctctgtgtccaagtgtcctctttttataaggaaaccagtcataatggacccacctgaatgacctcattttaacttgattacctctgtaaaaaatgtatttccaaataaagtgaccttatgaggtattg

SEQ ID NO: 582355 - DNA, 602 bp, Homo sapiens
gcactgggtgcagcaacaagggcaattgacaggctctgagtgtccagtggcatgccagaacaggtgacacagagcagggcgctacagctcactagagacacgactcagtggagtgccagaatccgacactcaaggttgttccgtgtgggcatggcatccgtgaatgtgtgcctggtgagtgtgtccatcagcgtgcactcacagctataccgaatgagtctagctggcatagcgagtctcatcaccccaagattacacaatcactgtcgtccttgatgtagtcttgtgtagcactggtagcggctggactcagtaggagttgcttagagcaactcctaaaaacgtttgggtgcgccacatagctaccaccttatggcacacagaccattatggaagcaaagaagccgcgacaggttagacactggaagatgaccggccccacaacgggggagagcagagatataacatgagcagacatgactgcaagaccattgaggaagcactaccgagcaaaatcccatataggggcaaccccacatagtggacacacaagaccgaagacgacatgagcagtgcaactgagaaaccttcacctagtaccg

SEQ ID NO: 582356 - DNA, 182 bp, Homo sapiens
tgcacctcctgcaggtaggtggccacattatcgagtgatcccactatggctgggcttctccttgacgttcaacttctgactttcaatcttgacatctcctccaccaggcttgtgctatgatgtaagccttagagccacacttggaggagcacttagagatgtccactttcttgtaccgaatc

SEQ ID NO: 582357 - DNA, 1044 bp, Homo sapiens
  misc_feature (31)..(31): n is a, c, g, or t
  misc_feature (66)..(66): n is a, c, g, or t
  misc_feature (82)..(82): n is a, c, g, or t
  misc_feature (119)..(120): n is a, c, g, or t
  misc_feature (127)..(127): n is a, c, g, or t
  misc_feature (175)..(176): n is a, c, g, or t
  misc_feature (194)..(194): n is a, c, g, or t
  misc_feature (222)..(222): n is a, c, g, or t
  misc_feature (250)..(251): n is a, c, g, or t
  misc_feature (258)..(258): n is a, c, g, or t
  misc_feature (261)..(261): n is a, c, g, or t
  misc_feature (275)..(276): n is a, c, g, or t
  misc_feature (301)..(301): n is a, c, g, or t
  misc_feature (316)..(316): n is a, c, g, or t
  misc_feature (328)..(328): n is a, c, g, or t
  misc_feature (341)..(341): n is a, c, g, or t
  misc_feature (352)..(352): n is a, c, g, or t
  misc_feature (354)..(354): n is a, c, g, or t
  misc_feature (359)..(360): n is a, c, g, or t
  misc_feature (363)..(363): n is a, c, g, or t
  misc_feature (366)..(366): n is a, c, g, or t
  misc_feature (371)..(371): n is a, c, g, or t
  misc_feature (383)..(383): n is a, c, g, or t
  misc_feature (387)..(387): n is a, c, g, or t
  misc_feature (470)..(470): n is a, c, g, or t
  misc_feature (475)..(475): n is a, c, g, or t
  misc_feature (482)..(483): n is a, c, g, or t
  misc_feature (489)..(489): n is a, c, g, or t
  misc_feature (503)..(503): n is a, c, g, or t
  misc_feature (518)..(518): n is a, c, g, or t
  misc_feature (523)..(523): n is a, c, g, or t
  misc_feature (528)..(528): n is a, c, g, or t
  misc_feature (557)..(557): n is a, c, g, or t
  misc_feature (684)..(684): n is a, c, g, or t
  misc_feature (855)..(855): n is a, c, g, or t
  misc_feature (858)..(858): n is a, c, g, or t
  misc_feature (958)..(958): n is a, c, g, or t
  misc_feature (963)..(963): n is a, c, g, or t
  misc_feature (997)..(997): n is a, c, g, or t
ggaaaaacaagcaccatgctcctgccggcantcccggtgggaacatgccaaacagccggcgatcgnacccagcccacctgtngtggaggtcccttccttctcaggttacagaaataaanncgtgtanttcttattgttagcactaacatcaccagaaatactgataagcgatagnnaagtcaggacagacagtnaagtagtacttcgcacactcccaaactnagggaggccctataaccttaaggagggnncatttgntanacaaaagcactatnnacgagtccagggatgatgtagccanaagaataaataaggngaaaggagaccntagaattcatgtnccttacgcctnanagcgnnganccntgggnagctggttggtntagnatctacgcagaatatgtacaccttgttgggagagatgggggcagcccaagaaagctcctcagcgggctgaagagggagcaagntgggntgagggnngttttnagttcatgctgcantatgaagagggaagntcttnagtcnagtgcgctgcagggtgggaaagcaacaanacggacaccgtcccaccctcaacccccccactggcacagggtcacacaatctgggtcaaagaaatagtggggcccttgtggtcatcaaagcgatccatggtcttgaggctgaggatcatgtgcaggncataggtgaagatgaagagcatgaacagggaggtgagcagccccatccagatgccgggggagaagaagctggcacagtcgctggcgtaggagaactgctccccattacgttgaaagcctggatctggaagtcctgaagcatcatctgccagggagagggctgcgtgcgggncangaagagactacccttcttgctcaggctgctgacatactcgcagtggaaggagtagatgctgggccctgtgacctgggaagcattgaagtaggcgacgggncattnctgtggacttcgagcgctccatggtacaccagtnccgggcagaactgggtagaggcggttggccagaatgaacttgaattt

SEQ ID NO: 582358 - DNA, 537 bp, Homo sapiens
gtcgctctagaggatcctcgcgtgaccttctgctctagtggacggcaaaagcactcacattccatatctgggactcaaagcttacaggctcctccaagatcccttgtgcaatccagactgtgatggtgccacgtgggctgcctcttacaacgtagaagagactctgaccattctgcgatatgcaaccgtgccaaaaaccataatgaacaaaccaagggtcatgaggacccaagatgcctccttcgagaattccaggaagagattgctcggctcaaggcccagctggaaaaaacggtccattggtaggaggaagaggcgagagaaagcggagggaaggtggtggcagtggtgggggttggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggac

SEQ ID NO: 582359 - DNA, 796 bp, Homo sapiens
  misc_feature (796)..(796): n is a, c, g, or t
tgctgatggtaagcatgtcatttctgagctgttctatacggaggatccgatggcaggaaactgaaaaattctgcccgactgtcctgtgcatagaacttgggaagtacgacccctctagccctaatcgagatcttcacgagactgtactcagcctgcaattgcactgtgacctcatatgagatgctgagccagatcgtccctggagagattactatggacattgtgttatgagccaaaataaacctaaatgcaagcaggttttcttattcgagttcaaaatgggctgcaaagcagcagagacaacttgcaacatcaagagtgcatttggcccaggaactgctaatgaacgtacagtgcagtggtggttcaagaagttttgcaaaggatggccaggcgcagcagctcacacctataatcccagcactttgggaggccaaggcatccggatcacttgaagtcaggagttcgaggccagccaggccaacatggtgaaaccccatctctactaaaaataaaaaaattagctgggcatggtggcatgcacctgtaatcccagctactcgggaggctgaggtgggacgaagcgcttgaacccaggaggcagaggttgcagtgacgctgagattgtgccactgcactccagttgacagacacaagactccgtctcaatttacaacagaaacgacacgaacacgaaagacagtttttggcacaaagggagctttagaaacccttgaagattgaatgagcattagtgaccggggccatggcgaaagttggaccaattgaacccaan

SEQ ID NO: 582360 - DNA, 902 bp, Homo sapiens
  misc_feature (396)..(396): n is a, c, g, or t
  misc_feature (902)..(902): n is a, c, g, or t
tcaaatttacaaattttttttataaaaaccaaaacaagggttaaaaaagtccttacatttccaaccctgcctggggtgttgtggggtgggggatatagatataagtctccagaaagaggtgctcaactctcctcttccctggcaaaggacacggcgaggtcagaaggcaggcctcttgcctcttttctagccctgcctactctccctccgagtgtaagtctacaatattgctggctaaggaagtatttctcataggcacaagaaagtggtgtggaccatgtgggaagcgcccaagaagtcgtgcacttttcttctcaacatctctaacgaagaaaactctccaagactgtggtctctatctcgccccctttagaagagctctctctcgtggagccncctacccccacatgtgggggaaactctccccccgaggggggtgtgtggtcgcggtcgagggacatggacccgaggaaagagctattcaaggccccctatctgtgggggcaataagtagatgctgcctcgagacaccccaccctgcaaacctattatctctgtataaaagtggccctcttatgtgaggtgaaacaccccatggaaaggtctcagggacctccgagggggggaaaactatctccacaaagtttagtccggcgagacgcagcggggtagctctgtgagacaacagggagaaaaaacctctcctgtagcaagacagaccacgcccccggtacattctttctctcctttggaccccatttatggcgccactcatttgtcggcgctctataaaaagagaactagacaacaatttactctatggtggacatatacttccccccgagatttcctcgtgaaaaggcgctataaacatgttgagaaaacctcccaaacggggaagn

SEQ ID NO: 582361 - DNA, 116 bp, Homo sapiens
ggctcggtaccaatcatttcaaaatctggtcaatgctgacttaactatctatcacctcaaaaacaaacaaacaaacaaaaacctcaaaatgtccccatgtcattgggtcctttata

SEQ ID NO: 582362 - DNA, 154 bp, Homo sapiens
gcgtgtattgggtgggtgtgggtataatactaagcttgagatgatatcatttacgggggaaggcgctcttgtgaagtaggccattatttctcttgtccttatcgtacagggaggaatttgaagatagattgaacaccgaccgtggattactccg

SEQ ID NO: 582363 - DNA, 153 bp, Homo sapiens
ccgagctagctctagtgtctgaatgttcaagctcataatgcttttccggagcaccgtccccgttcagcctttggagttttacggtgtgttaaaatggataccattaagttaagagtccaagcaagatcagtcccacaataagatagcgtcggg

SEQ ID NO: 582364 - DNA, 621 bp, Homo sapiens
ctgtcagtcgctctgaaacactcaaatacacctaacggcctgctaccctcttactcctcgctcacatgttagttgtcggtgatgctcacctcttcccccagtcccccctttcttaaaattcggagaggacttcctccctgccctcatcaaagtaacaacggagcatctctgctctgggtatttatgtaccggtcttagctcctctatgaaagctgagtgtacattctttaggaacagaaaaccacagctgtctagttgccataattatacaattatgttccaagggtctaacatatagaaactgctcaatcaatctgttaaacgagtgtcaagcaggtgtgactctgtgtgccacagggcaagcgcagagaggaggcttactgattaaatatgtgcatctctattacatgcacgctaaagcttctttcactgcagcacaaaagacatttttaacagcacctgattaaagaaaaacttacgcaactccatggggagcatccggctgtaccaagaattccaagggtactttggcatcatctataaatcctttctcaggatcggtcacttcctataaaacataaataagaatatccagattgaataaggaaacacactttattc

SEQ ID NO: 582365 - DNA, 321 bp, Homo sapiens
cagacggatcccgtatataggtgagccagggtgaacctagggatgtggcagtgtatagtaggtgcgcagatgataggggaacggagcctacatattggtgtatcatgagtgatgtatgtgcctgcgtgcatgcgtcatggctggttgcctcatcgggtgatgatagccaaggtggggataagtgtggtttcgaagaagatataaaatatgattagttctgtggctgtgaatgttataattcaggcagcattggtcagggcagattagtatagagaggtcagagtttttttcgtgatagtggttcactggatacgtggcgtt

SEQ ID NO: 582366 - DNA, 1537 bp, Homo sapiens
  misc_feature (179)..(179): n is a, c, g, or t
  misc_feature (243)..(243): n is a, c, g, or t
  misc_feature (1537)..(1537): n is a, c, g, or t
ggtaaaagcaacagcccattacccctagcaggtgccctctcagccctcctaatgagctccggcctagccatgtgattttcacttctcattctataacatgctcctcagtactaaggtcgttacttagacccaaggactacgtagcccatatttaccgaattgcattgcgccgctgcatngtcacacgacggcagcaatagcagcctacccgaagggctcactcgaaaggacctaggctgtccngaaagaaaggcacttccgtatagcgggatcacatccctaggtttatatctaccgcttctagggagaggatctgtcttctcagtctctggcgaggaggcagctatctgctccttgatgacgcgatattttagcccaccgtcccgacgccggtaaggctctccgtagcgcacaccggcaagaaatttaggggaacaggtgtcacacgtgggcgctgccccctaaagcaaagggactatagtcagcgacacgccggtttgagagaattgcccaccccattaggacgatgttcgcctcgagtactactcctaggaggcgggagaccgaattcgcggcatagttcagtcctaccgtcgaggtccaccgtgaaaggtaagtcctagaacttctggacccctttgggaaggctttcgagccccatggaacggttccgtacagtcacggatgaaacaaccataccccctggaacacagcggccagagagttcaacgttcactacagagcccgtagccttggcacgtgtaagttctgcacctaagagtgatatcgttattccgttgaggcgctttaactcccttgagatttctcataagcgcggcggtgcggcctacacggagaagatcgcgtgccaagcaaagcgtgaggcaatcttcggacacggattcgttgctccccgttttttgcgagcccccaccttgttacctccgttgagacgcgccacgatttgcgttacccgcgttgcgtaccatgactgagatcaccgacttgcgggatacggcgccaatcaaggggggcgttatccacaaactggtgcagccattctgccaccaggtttccacatttatcagttcacggcggtcgtccacgacagcgtattgtaccctcatcccaacgttaagttcacattggctctttcgcgagttcctctggacgccccaacagtctatcaacaattagacttctctccgagccctatttttaggcaatgttcccctaaacaccaccctaaggttccaaccttctcttgtggtgggcacttctcctctgcaaaacagttgccgtgcgccctgggtcggtggagtcaccgtaggggaacgagttgtttgtgggtcacggcaactcgcttaggagcaacattgggactttaaactctatgcattggcgtacattggatacttccgccgaattgcgtatattctggcacttgaagtgggtgctccctctagaacagtagataggccagagcgcaacaacagggcagaccccacacaagcagacaaacatcgcgaaagatacn

SEQ ID NO: 582367 - DNA, 392 bp, Homo sapiens
  misc_feature (9)..(9): n is a, c, g, or t
  misc_feature (20)..(20): n is a, c, g, or t
atacctacnccctgtgtagnctaattaatttaaatattcctgtgttttacatccaatcctacaaggagtttttattgctttgatgaaatccctccctcccccttctttcctctcatctctccctttctccttctcctcttaaatgattctctggctgaacaattttctattaatagcattttgggaggccgatgtgggaggattgtttgagcccaggagtttgagactagcctgggcaacatagagagacccttgtctcaaaaaaaaaaatataggccagatgcagtggctcacacctgtaatcccagcactttgggaggccgaggcaggtggatcacctgaagtcagaagttcgagccagcctggccaaacatggtgaaatcccatctcta

SEQ ID NO: 582368 - DNA, 234 bp, Homo sapiens
  misc_feature (221)..(221): n is a, c, g, or t
aagatcgccgtgcgaaacacaacgtgtcgcaacaaccagaaaacttgacccaacgatggtgggaatggttaataagaagaagaaggttgtgaagccgggctataagcgtcaaattaagtcagctatccaacgggaaaatcaaatggatcgtcgtattgccaagcgtgaagaaatgcgtgcagtacgtaagtcaaataaaaagcgcggcggtccctaaaccncttgtaatgataa

SEQ ID NO: 582369 - DNA, 985 bp, Homo sapiens
  misc_feature (193)..(193): n is a, c, g, or t
  misc_feature (436)..(436): n is a, c, g, or t
  misc_feature (595)..(595): n is a, c, g, or t
agcggatctcgcgatgacctctgtgttggaagagttggtgctaatggtgggctggtattcgaccgctatgcgcgtccctgcatcgcctggctgcggtccaacctgaggagcacggcttggctatacgacgaaaaccgcgatgacgtgcctgtaagggtgtctgacagagcgcgcgtggatcactcaggcagcntcgactgcaggaggtcgcattccgcccacgcaaggaggtggatgcagcatggacttaccgatcacctctggggcgcatgacaggtgacgttagcgaatgaccctcattcgcggatatcacgtgaccgggcgacaaggggcactccccaggcctgacgcgacgatggatgttctacgtaagccgacatcattgcgatgccgagccatagctgaagccgagaaagagtggtcgtcttagaatgangcgacgacgtgatgcggtgcaaactagtcaccgcaaggccgggtcggaatccttgaagcattcttgctcccgtggtgctcaaggagacgggggcatgtatcccgaagcactcccctccgttgccgtgcacgaataggagtcgcctgaccagcccacaanttgcgtgcctgcctcccgtggattgtcccgcgtctgggtcgcgtcggtcgctgtgccaaagatatggagacctttccccccatgtgtggacgcactttggccaaggcggggcaagggtagacctggacgcacccgcattggatattcgccacgaaacggacttaagattgagaacgtaagcttgccctatgatgccacctctcagacgccagattgcaccaaggccctttctatgcgcgccccccttttggcaaaagacccccgtggggagcaaaaacagcgccgaaatgtgcgttggcttggaagaaccgccttggaataagcccagattgggtgcaatactgccctaagaggcccttggcccggaagaaccctgtggaaagcccccag

SEQ ID NO: 582370 - DNA, 1461 bp, Homo sapiens
tccacggaaattaaaatcaagggttaaatgtcctgtaacgaaaacttctccgagagggaaaaccaattctcacagcagaggccaccgagaggcccccactgtggaaatgggtggtggatgcctcaaggctttggaagtgtggcacccctcgggcggcccgctttgggggcaggtgtgcggccgtgtgtctccccggccgtgcacgcggccatctcccaacacaaatggggtgggaaagccaaaacgcggggtcgcaaaaccacaaaacaagggggagaccccggtggtgcccgcgagaacccacaaggccttaccccacaaacaacagcggggaaacccgcccatcaggcctctccacagggccaaggagatgtgccccacacccccgcgagggcccctcgtgtgtggcgggttccggtaacatctacggtgaaaaagaaaagcttctccggaaattgtgggccgctctggggcgtggagtgtgcggcgtgtagtgagagtgacacccctctccagcgtctgggccccgccccccgtctcctctcgggggcactccgcgtctccaccctctccgtgacacactgtgggtggccctccccttttattacgacccccatgctgtgtgaacgcgtgtgccccccccgcgggttgagagagcctctctctaacaagcgtcgagagaaagtgggagagagacactctggtctctctcccgcgcgtgtgcgacccttatacacaacacgcggccgcggcaaacttcgaagactctcaagctttttcccgaagaccctccctgtgtgaaagccccccgtgagcgtccccccgcgacacgaggggggcacaaaaaaacccaccggggcaccacacaaagaagctctccgcggaagatcccccgggaaggggagcgcaactgcaacaccccgcgggctgccacaccagaggaggctcccccacccccgtctgtcgtgcgggtgagacaaaccactccccccccacctccagagcgaggacagctacccccacgggcgaacacaccgggcgggccgagcagagcaaaccactcatcaggacagaggcaccaccaacagcagcaagacccgcttgcggacaccacaaccaacacccgcgaggccatcatcacaagcggaggaagcaacaccacgcccacactccggcgagcgcagaggagcagaagaaacacacaacccacccacaccaccacctggtgtccacacaacagatgaacacaaccgccacgtgagcggagcaccacgccagagcctccacacacaaacgagagagctagagcgacaaacaacgagccagccacacacaacaacacacaccacgcacgcgcccactgcgagcgagcaacaagcaacacaccacgccaccgaggcccacccacaaaagcaaccacgagccaccacgatccacacgcaacacacgcaccccccaccg

SEQ ID NO: 582371 - DNA, 113 bp, Homo sapiens
actctgcaggagtccttgtcaggagagagaactggcagagtacaaagtgtacaccaacacagcaattgaactaaaattagtgaaactgcttttggttacaagggtctaaagat

SEQ ID NO: 582372 - DNA, 399 bp, Homo sapiens
cacactcaaatacctgagtggcttgaatggtaaagtgggttgggcatggtggcttacacctgtaatcccaacattttgggaagcctaggtgggcagatcacttgaggtcaggagttcaagaccatcctggctaacatggtgaaacctcgtctctactaaaaatacaaaaattagcagggcgtgatggcacacacctgtatttccagctattcaggaggctgagacaggagaatcacttgaacctggaggcagaggttgcagggagccaagatccgtgccactgcactccagcctgggcgagagcgaggctctgtctcaaaaataaaaaataaaaataataaattttgcctaaagcagatctgggcccaccccaaccccgacacggatagggtaccgagc

SEQ ID NO: 582373 - DNA, 375 bp, Homo sapiens
  misc_feature (18)..(18): n is a, c, g, or t
aatgcttctattgccggnaagttcagcacctgtaaaagcagccccttcccgtttcactgtggctgcattttaattcttattttttaaatgtttagcttaaggccgggcacagtgactcacactataatcccagcaatttgggaggctgaggcgggaggatcacttgagcctaggaattcaagaccagcctaggtaacatagtgggaccctatctctacaaaaaataaaaaattagccagtcatggtggcatgctcctatagtcccagcttggagattgaggtgggaggatcacctgagcctaagaggacaaggctagagtaagccctgatcccgccagcaccccagcctaagtgaaagagcgagagcctgtctca

SEQ ID NO: 582374 - DNA, 959 bp, Homo sapiens
cccttcaaagggggtactggaccgtcccgcaagtaacgcccgggtaaggccacaggggagggaccccggggcgcccaaaatggtaggcacctaacggagtaggacagccaaggccgagtcgattcttgagagccgccccagcggcatcaagctcccggggtctagcgccaactctcaggtggcccacccgagaccccgggggcaccaccctagtcccccgcggggcccctaatttcgctccggacaaggtgaaaagataccatccgggaccagaaaactcgccaagcggcaggcacaaggcgcattggagggaaaggaactgctcgcagaaagcagaaggtggttcatagaacagccacagcaagatgacaaaaaacggcagttctccttaaagaagttaggggtaaacgaatatctctggcatagaagaggtgaatatgtccactaaccaaggcacagtgatccacatttaacaaccctgaagttcaggcatctctggcagcgaacactttcaccattacaggccatgatgagaccaagcagctgacagaaatgctacccagcatctttaaaccagcttggtgcggatagtctgacttagtttcaggagaactggccggagctctgcccacacacaatgctgtggagtggagaaagcaccacttgctagctggcagaggatgatgatgatgaagttccagatctccgtaggagaatggcgatgaggcttccaagaatgaggcaaactgaactgagtcaacttctgaaaggataaaacctgaagaagttactgggagctgctatgttaatattatgactgctttttgaagaaattttggtttatggatctgataaaatctagatcctctaagtacatttcaagcccaagcccattggacactgcagctcttttcagtttgcgcttatacacaactcattcatgcttagctcatgaagcc

SEQ ID NO: 582375 - DNA, 197 bp, Homo sapiens
aggtggctattgtataatacgcctccacagtcattctcgacccccttacaaaatacatagcctacccctatcctatgttactatccctattaggcatcattatgacaagctccatctgcctacgacaaacagacctagattcgttcattgacacttctcttcaatcagccacatggcgccggacgcctggtgttatc

SEQ ID NO: 582376 - DNA, 112 bp, Homo sapiens
gaggtagagaggggagagatgagtgcactgaaggtcattttttggatagagctgcccaggacttgttggatggatttggaccatagatgtgaccaggaggggagtataatag

SEQ ID NO: 582377 - DNA, 144 bp, Homo sapiens
ttttccccccccccgggtttttttggaaaccccccgtttgggaaaaatttttgggggccttttttccaaatttttccccccccccttttttttttaaggggaagccccaggggtttcccaaaaaccctgggtttttaaggttta

SEQ ID NO: 582378 - DNA, 390 bp, Homo sapiens
gaaagaaagaaaagaaaagaaatatatcataagtacttgttaaaagaatgaaaataggctgggcacagtgctcatgcctgtaataccagcactctgggaggccgaggtggatgaatcacctgaggtcaggagtttgaaaccagcctggccaacatggtgaaaccctgtctctaccaaaaatacacaaattagctgggtgtggaggtgcacgcctgtaatcctagctactcaggaggctgaggcaagataatcgcttcaacctgggaggcgaaggttttggtgagccgagataggccactgcactccagcctgggtgacacagcaagacttccgtctcaaaaaaaaaagaatgaaaataaatgagctaggtacctaccatcacaagaagtt

SEQ ID NO: 582379 - DNA, 129 bp, Homo sapiens
tacccatataccaccactgatccaggagccaactcggctgagagaggagaggatcttgggacaagactgcagttgggaatgcatggacaccgatttgttcttattccttcacttttggggaaaactctt

SEQ ID NO: 582380 - DNA, 238 bp, Homo sapiens
ctcatggaggatgtagcaccatggaggatgcatggaaaactagtgatatctgaagagaagttggtgcatgtgtaatgacaattttctagattttctcgttattgtattctttaagagacagagtctgtgctctgttgtcgcaggtcgaagtacagtggcacagtcatagttcattggagcctcaaactcctggtcttaagtgaccctcttgcctcatcctccatggtgctgacatcct

SEQ ID NO: 582381 - DNA, 845 bp, Homo sapiens
  misc_feature (215)..(215): n is a, c, g, or t
  misc_feature (224)..(224): n is a, c, g, or t
gggaggccgggtccactcgtcgggagtcgtgcagcatgcggcgtgtgtgcggcagtggtagtggtacgggacgtgaggggacgcggcgctggattttcaatgcttggcggctgtccgtgctgacggagccgggggtggcggtggtgcctctggccgtgacgaggacgaagtgtccgatggttgacttcattctacttctgggaccaacgaaggantctctggantagaccactagatgctttagatagatcaacagtcatgaggcatagttcgtataatcgacatggtatctcgcaggagagggatgcgagacattacgcgactgttgcgatccacgagacacaggcacgatctagaagcattgctacgcaagcagcaggaactgggcaaattgtcaactgctgatggtaaagcttttgcagatcctgaggtactccggagactgacatcctcagtcagttgtgcactgggatgaagctgtctgctgtcactgactacggcatgaccatgcagagagaacagccacaatgcaggacaagtggacactcgcagtctagcagtaagcttgattcagatggggatgtcaatgctgtgcgctaaattgctagatgaaggcaacacagtgtcactgatcatgcagaatgactggacgagaagactgtcgccctaaggtcttcgtacaggcacgcttattatgacttgtaacaccatttgattgcattggctgattgtgttgctacaagtaggaccaatcttacagcaagtaatcggatgatattccaattccctggaatgggtacgcctaccaggtggaaggttaattagcataatcgcgacaaataata

SEQ ID NO: 582382 - DNA, 150 bp, Homo sapiens
agcacgattaataaaacaggtctctgttcttgtgggttggtaaaaaatcagatggttgtagctgtgtggtgtaatttctgaggcctcgtgttctgttccatgggtctctatatcgtgtttgggtaccagttatcatgcgtgtttgtggta

SEQ ID NO: 582383 - DNA, 341 bp, Homo sapiens
atcaagctgcgtttaataaatgctctccatcaccaggccgggcttggggccttgcaacagatattttccattttccttccttcaacaatgaacacctgagcaaagatcctggtctccaactaaatgagctcctcggagtagttggaaagttggaaacgtgtccagcacagaaggaatctgtgcagatgagcagtcacactgttactccacagcggaggagaccagctcagaggcccaggaatcggagcgacagagaggtggagaactgggatttgaacccccgccatccttcaccagagccccatgcttaaaccactgtggcgttctgctgccctgtcgac

SEQ ID NO: 582384 - DNA, 230 bp, Homo sapiens
cctgagaaacttattttttcctttccctcattgcttctggatgactctcaacactgagaagtatatacacttgacccacaggtttgaaatgctctgccacccccaagactgcaagaccaacccctccacttcctcctcatccttaacttacctaaaatgaagatgatgagaatgtacaccttgatgatgagccatttccacctaataaatagtaaatataaaaaaaattt

SEQ ID NO: 582385 - DNA, 1177 bp, Homo sapiens
  misc_feature (162)..(162): n is a, c, g, or t
  misc_feature (283)..(283): n is a, c, g, or t
  misc_feature (301)..(301): n is a, c, g, or t
  misc_feature (394)..(394): n is a, c, g, or t
  misc_feature (452)..(452): n is a, c, g, or t
  misc_feature (459)..(459): n is a, c, g, or t
  misc_feature (495)..(495): n is a, c, g, or t
  misc_feature (522)..(522): n is a, c, g, or t
  misc_feature (709)..(709): n is a, c, g, or t
  misc_feature (760)..(760): n is a, c, g, or t
  misc_feature (803)..(803): n is a, c, g, or t
  misc_feature (815)..(815): n is a, c, g, or t
  misc_feature (827)..(827): n is a, c, g, or t
  misc_feature (832)..(832): n is a, c, g, or t
  misc_feature (838)..(838): n is a, c, g, or t
  misc_feature (846)..(846): n is a, c, g, or t
  misc_feature (893)..(893): n is a, c, g, or t
  misc_feature (910)..(910): n is a, c, g, or t
  misc_feature (955)..(955): n is a, c, g, or t
  misc_feature (1014)..(1014): n is a, c, g, or t
  misc_feature (1142)..(1142): n is a, c, g, or t
aagccagaaccatgaacccgtaacagtggcctgtctcagggcctcctaatgcagctccgtgtgctagcgcaggtcgatgttcacgttccatctcctataactgctaccttcgatacttagtgcgctacgtaagccaagcatcacttaagccgactaatagcnaaggtggattagggagcagatagttaacgacagaagaaaaagctacaataccaaggagggcggactcacactggcgattcctgttcctaagaacagggccgtctctagagtactaggagcntaagtccaatatttgtantgtacgcctccatgcaatgcttattattgtcctatcagctaggcgcaattgtgtacgtagaagtcacgtatattacaacaccaatctcaaagnctctataagaccctcacatagctccccacactacagacataagtcgatgtgcgtcacnctggcgntcccgcgccacattatagagctaagtctacaactcnggtctaaatcaatcctctctgtcagtnagacgtttcgtctaatcttccctttagataaacagcgagatcacagggataattggaccaattctgtcgatctcgaaaggggagggctatatcgacagttccaaacctttggaaggctttcaatctcaacctatggatcttgagaggtgaagaaaatagagcaatatcccaggaaatatactcatantacttacacttgttccaacgggacccgacatcggcggtcttaactttaacnataatgtatctataagctttgggcggatcgttcggtaagtatnttgatcccgcangtcgcgctaaanagaanggctcnctacaagnaaggtaaacatatgcggacagatacatacctccttctacaaaccganatttatcgcgcgacacngagccacttccttaaccgtgctatccggaagcaaaattgaactcnagataaaggtcgagcgacaggggccttcccaaacgcgtgaccgtgtcaaccggatccantctaatttagagcgttcacaacggtttttccatccaacgaaaatcattgggtgatcaacaaccgggcgcaaacagcacggtgttttccacacttttatacattcccctaggaggtccaaactctaggngatttcaaaacacgcgacaccctgcggggggctct

SEQ ID NO: 582386 - DNA, 81 bp, Homo sapiens
ggtcgacaaaaaaatacgtccaagaccaacaaaaacaaattatgaaggaccatattatatatgtaaagatgttgctgctga

SEQ ID NO: 582387 - DNA, 122 bp, Homo sapiens
ccatcaggggacagatgagagggggctgctcctttttggagaatggaccttatggaggcagtatgaggagagtaactcctcaaagagaagacacccttgggttgggcctgctttttttaata

SEQ ID NO: 582388 - DNA, 147 bp, Homo sapiens
ctagaggatcccagactcggcaccgttcgaggtgctgaaggcagcagagaacaagaaaaaagaagcggcgggggcggcgttgggggcctggggccaagagcgcagctcaggccgcggcccagaccaaactccaagcgcggcaggcaa

SEQ ID NO: 582389 - DNA, 249 bp, Homo sapiens
cgcaatcaaggaggtatcaaatcaacctgaggctcaaccatagtcttaataggaaaacaacccgaacccaaattattccaggcactgcttatacaaattttactgggcctctattttcacctcctcaagccctaagggtacttcggagtctccctacaccatttccgacggcatctagggctcaacatttttgtgaccacagcttccaggcattcaggtcaatatggctcaacttcctcatatcgcttc

SEQ ID NO: 582390 - DNA, 1522 bp, Homo sapiens
  misc_feature (194)..(194): n is a, c, g, or t
  misc_feature (246)..(246): n is a, c, g, or t
  misc_feature (664)..(664): n is a, c, g, or t
  misc_feature (698)..(698): n is a, c, g, or t
  misc_feature (1522)..(1522): n is a, c, g, or t
ctctccgactgctgtacgcacggatccctgttgccttacgccaactgctctagtcgttcatgcgacactgcactacatatggactaataacagacaagtggcctacaaggaacaaaatgaaggagctgtccatgctgtcactggatctgctcttgcttttacgccggtaaccttcgctaacgatctaacgatcntatacattacggagtgatcatggagagctgaagctaatatcgatagcaaacngtgcgctcttgagccaggctttttagaggcgtggatcttgagagccactcgatctccttatctcagtaagcccctacgatactttgagacttctccatagagatagaaatgacctgtaccctgggaggtagatccagaatgataattggaggctgcgagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtntggctgaagcaagggagggtctggcacgccccancaatagtaaatccccctgcctatattataatggatcatgcgatatcaggatggggaatgtatgacatggtttaaaaagaactcattataaaaaaaaaaaaccaaaaaaattcaaaatttaaaaaaaatcaagtgcggacctctttgcagaaagtgtttggcattgactgtttaaaaaaatacctgggatcttatctgggacatacttacatattgggttaaagaaatacaagtatttgcattatgcaagttattgcataatcttacatgtcctgttaacaggctttggatgtcgtgtcttcccagctcaaatgaattggctaggtctgtccttattagaagctccccatgtctaactccattccaaaagcaaaaatgaggtcagtagaacaagtctatggtgctagaaacccaccattgcctaatgacctagaagggctctgtagccctctgagcttgacctaaggaccatacctagtatcacaggtattatgaactcccagttgaaaccttcacaatttggtccgctcaataatcctcactaacgggcctaaaaacctacaaaacccagcgctacaagaaatttaccccaacccaggtgcattaggcattgtaaccgttcgtgagtacccccgggggaataagtggtggcgtcaccacaattgtgtgctgtttggggcgttttgcaaaacgggggtattgggcagtgcgaggaagagacccgagacctgtgaggaacccccaattctgggggtagcaaagcgacacgaatagttttgaacgcctatttacaaagcggtggtgtgcaacaacacaattccaagn

SEQ ID NO: 582391 - DNA, 101 bp, Homo sapiens
ggtaatgctcgatccagagatcacaggaggcccacaaaatctactgtatacagtagaaacactgccatcttgggatcagaaggggaagaacagacggggta

SEQ ID NO: 582392 - DNA, 232 bp, Homo sapiens
  misc_feature (19)..(19): n is a, c, g, or t
  misc_feature (48)..(48): n is a, c, g, or t
  misc_feature (56)..(56): n is a, c, g, or t
  misc_feature (90)..(90): n is a, c, g, or t
  misc_feature (95)..(95): n is a, c, g, or t
  misc_feature (101)..(101): n is a, c, g, or t
  misc_feature (126)..(127): n is a, c, g, or t
  misc_feature (138)..(138): n is a, c, g, or t
  misc_feature (153)..(153): n is a, c, g, or t
  misc_feature (169)..(169): n is a, c, g, or t
tttttcattgatctatgcnttgagtttgctgtctcaacattattgtantttccacntattattactgtataacatatgctagtgtttagntggantaaacntacctaaaagtactgaaaaatgccnnttagtaccttntcataatttatacanttatttccgaatgtancattgaataattttattgagttataaaagtatcttattgctatttaataaaaaattaacacat

SEQ ID NO: 582393 - DNA, 753 bp, Homo sapiens
ggagcaaggtgagctttctgtggccacactcccagacgcctccctgagccctgtgaacccggactcgttgctcctggccttccataccccctgtgcagatcatcctgcgtgtcccaccccagatcccctcctcctcgccatccacattacatgcccccatccccatccctgtagtacataaatggtgactgaatgtagttggagcaagatgatgtgggtgcttaaagagcacccatgtgagcacatgagctaggagatcaagagtgacagagaagcgacaggggccaatctgatgtcctagcacctcaccattcgtcggtacctgctagagaggagcagaggacccaggccccttgtctcggaatgcaacgcaaattgtacttggcgatgttcgtcataaaagtggccgttgtaatgttgcacgcggaacagtgccaccagacacaagcttagtagactacctgaaaacacctccacatatggcaacaaatagaacaatccacaagacacccacggcaggggcagatggtaacagactttgagcaactagagcctagatactataacgacgcctactactaccccccagaacaccatcccctcccaacaccacactcgggcgttaagtactttgatacaacttagttcgctgcacactgaagggggatcacacgagcccaagggtgtactccgcttgtaccccaatacatatattggcagggagacgctcagtaggagaatccaaagatcagt

SEQ ID NO: 582394 - DNA, 88 bp, Homo sapiens
gcctccagtagtgcctggaattaagaccaagaaaagcctggggggctctgagagacttgaacaagtgtcaataaacgctggcctctgt

SEQ ID NO: 582395 - DNA, 700 bp, Homo sapiens
tgagcccccccccccccccccccgttaccagaaacgtccccacccacaaaagaatcatccaaacacaaatactctcatacagaaatatctcctataaaaggatctccgtaccatcgttcctcgattatgattagtagatatcgcggacgcaaggatcttatggcgctctttgatctttaggaccccaaggtcaaacgcgtatccggagggaataggggtcgcaaggtcaccctcctttccctccccaaaagataaaccctacggccctttaccttaagacaggtcctacagtcggggaagactccaagacctccggctcaaggggcaagtaaacactccttcgagatcgggaggcacgactaggtatccgggaactcggtcccgaacgctactctcgaagtacggaagccagcggcgaaaaaaactccacccttaagctcaggacaagtcatcctcggaacggtccactttaacctaagcaagctataggcgccacgccgctcgtactcacggacgcaatcaaatagctaccagggcgtccggacgaagaagaaagatacttagctccttaccaggtctaatcggccctagtctaaagttgaatcaacatccccaacggaacggtcggagtccccacattggcatctcaggaaaactcactaaccaccgagctttaggtaggggggttatttgatcctat

SEQ ID NO: 582396 - DNA, 293 bp, Homo sapiens
aatacactggaataaactgctgcatgcactgacacaggataacagcagaaaacagccacaatgcaggacaagatagacactcgcagtctagacagaagcttgttcagatagggatgttaatgctgttcgtaaattagctagataaaggcagaagtgtaaatgaacatacagaagaaggagaaagcctgctgtgtatggcttgttcagcaggatattatgacttagcacaagtattgcttgctatgcatgctaatagttgaagatcgagggaataaaggagacataactcccct

SEQ ID NO: 582397 - DNA, 351 bp, Homo sapiens
ttccatgtgtgtgagacgcagttctggccctgtcgccgtaagctggagtgcagtggtgggatcgtcgggtcactgctaaactcagcctcccgagtggctgggattacaggcatgtaccaccacgcccgggtcattttgtattttgagtagagacggggggtttctccatgttggtcaggctggtctagagctccagacctcaggtgatacccctgcctcagcctcccaatgtgctgggattacagctgtgaagccaccgcgcccggctgctgtgatagttgagatgtgaaccaaaaataaaattctaagccacccaatccgactgaatggacccttcctgttgagcaagga

SEQ ID NO: 582398 - DNA, 1025 bp, Homo sapiens
  misc_feature (260)..(260): n is a, c, g, or t
  misc_feature (649)..(649): n is a, c, g, or t
  misc_feature (688)..(688): n is a, c, g, or t
gagggggggtcctgaagacctgaagcgaaaatgacagcacaaagtttccaccatcgtttggctgagtagtggtcatatcagtacactctagtcgcgtgtctagggactgattcggctgcagtcgggggccgctagacttttggattgactgcttcactgtgactctcactcagtgggacgtgtcctgctacaattggtgcagcgcgcatcaccgcgtgatgtatgttagtgtgatggtctgcagagagctgtgtgtcaancgaagtcggcgagtacgagagtaatccccgggcttttgagtgcaggcgagtatggtcaaaatcgccctcgttggcgagtaagaggtgcaatgctcacgcaatatatttgccatggagcgatccggggtgaacacccctgtgatggatgcgtcggagagagcaggtgtaacttctagcttgattgttaccggccacattactatctcagaggtttggaacatttggccgctcgaattatttaccgcccgtggggaaatacctgtctttggaagtccacttcaaccatgaattataattgaggtgtgcactaaaggataagtgtttgcttctatgattacaatttcatctctatagtgacgaatcacttggagagaaatttgggaagacanataacatgaatgcccgtggatgggacttgaccatttagnttggaacggtttagtggggaatctgttgcactgcaggagttaggctccggtgttcagagaggtaaacgaggtaaggatttctctccactttttaaaagggtgttctcttccagcggaagaagagggtagaactttcaagtaaggaggcctttggggttttccaatgaggacatatcttctcagggggaaaattgaaggaaagtaatggggctgggtgggaaatttttggaggcttgctggaaaggttggattcaaggttttgggtgactctgggtaggtcactagtatcctgtgtagcctttaattaaagttggttggagaagggaggtggcaaccc

SEQ ID NO: 582399 - DNA, 606 bp, Homo sapiens
  misc_feature (108)..(108): n is a, c, g, or t
  misc_feature (115)..(115): n is a, c, g, or t
cttgaacctctttgtccctggcagatcccatcttggaattgagatcaaaggcccaattgagctcatgtgccacacatgtccctagagttctcagggatgggagggccntgcaccntcagggtataccagagagagagagagtgagcaagcaagcaccgtagcatcgccaccacagtttcctagaaggtgttttatacactctgtgtcattaggaaaaacttatttcagcctaaggaagcctggctgcctagagagctggggcaggcaatacatcattggctaggtccttttccttaccagagaagccccagcagcaggaagcctgagtgtggaagtcaccgtcgctagggtttgggtatctatttctggtgtcagcaggccatggactacaaaaaatactgttgtggaacttgttaacaaagaggaacaatggtaaaactttttttctgtgtttgataagtaacaacaaaaaaaaaatcattggctgttcttgggagacggttttctgttttataaagtaaatctagtagcattaaaattataagttacacaatcacatttagttttcattagtcttaaaaaaaaataaaagatatttaactgaaa

SEQ ID NO: 582400 - DNA, 147 bp, Homo sapiens
ggggggggggggggggggcccccccccctcccctttttggttccctttaaaaaaaggggttttttttgggccttgggcccctttgggtttggggcccggggggggccccctttggacctaaaaaaaattttttttttttttccccca

SEQ ID NO: 582401 - DNA, 856 bp, Homo sapiens
actccaccttactagcagagcaaccttaagcagaccatttgagccaaataagagtataggcgatagagaatggaaaccgtgggcgcaagtagatataggtagccgcaacggagaaagatgcaagaattataaccaagcataatatagcaaggactaatccccgtatagccttgctgtcataactgaagtataactaggaagataagctttagcaagagagagccgaaagactaaggagcccgcgaaagccagtacgaagctactctaacgaagcagctgtaaaagagcaacacgccgggctatggtagcaagaagtagatgggaacgagtgtatagcgaagagcgcgacagaagcctgagccgagcgctggatgatacgctaggttggtccacagactaggaatcttagttacaacatttaaagtcatgcccacagagaccctactaaatcgccgcttgtacaatttaactagtctagttccagagaaggaagagctctataggacacaaggacaaaacactagatagagagagtaaaagactggaacgacacatagtaggcctaaaagcagcacaccaataaaggagagcgtacaagcagcaacagaccactacgtaaaaaatcccaaaaacatataacgtgaagcaccatcaacgcccaaatgggaacaaaacaagtccaccccgtagtagaaagaaacgtaacaggatcgagaagtagagtaaacactgacaacaaaatacatcgctacagggcatgagggcaggaagacaagaataaacaaaaccaagaaactggacaacacaacaagacccaaaaacaaagcaaaccaaccaggcaaagacacaaataccc

SEQ ID NO: 582402 - DNA, 337 bp, Homo sapiens
ccagtcgggcatgcgtactcatctttttcagtggaggtagaataccgtggataacacgagatagagcgaccagtccttgctgagagacaagtctgaatgctccactttttcaatactctctccattcatcagtaaggcgactgcaatgtcggatggatgaaacccagacacatagcaattcaggaaatttgactttccattctctgctggatgacgtgagtaaacctgaatctttggagtacgctggatagcctccaggccagaaagagagagtagcgcgagcacagctaaggccacggagcgagacatctcggcccgaatgctgtcagcttcagga

SEQ ID NO: 582403 - DNA, 1218 bp, Homo sapiens
gtttcctaaattctcctacggtatcacttcccccttttccgtgcctgaactgcttcaatgtacaccgcgggtaaccgttattcgttctccttcttagactgttccgagaataccttcgggcgctggatatgtccatcacccggaggtgaacgcttcgatgtttctgtgacgacgtccccatagggcgttgtgccaacctccgacggccaaggaatgcccaaccgtactcacgtgctgtgggtaacccgcgtgcttttcgttgcgcgctgtggaaattgtcaatcgtatgacgctgcgggcctctgaaacaggggtgttgtaccaccttgggccttgcgacgttttacctactagggcgtcacggtcgattgagtgatccatgtacggctccgtgcctatcttgtcgaggctagtcttcttacatgtggatgtgacccagccttttcgtggttgtgaattaaaggctcctgtgggttccccccgttcgcctgaacttgtgacaaggccatgttgaatgtgcgcttccgtagtatctggggcccaagatgtcgcctccgtgggaatttggcacaatcaatgagaagaagccttcttgatgttgcgggtcgaactcgtacggatggatcatacacgggtgatctccactggagaatgcggtggtaacatcgaagtagacgctgattctgaaacgattctgccgaggccttcaaagacgcgttggagagaccgttatccaagaactcgtgtgtctgggagttcatgtggaactgatgcgctttgggattacagtctttgacctgctccagtcgtaacctggtgcacctggacttcgggtcacggagtgcagcatcaaacgtgcgcccatgctaagcaaagatagccgcgttcccaagagatcctggagaacctaagactcgcagaaagcagtggtactggacggatgtggacactgctcgccatcaggcggtggtctttgatatgttctaatttggaccgactaggcaaatcacgaggtggagctggtgcaactaaggtcatcgatggacgtaaactatttgattgattgtgaacggcgtctggagagaggaggcaggatatccgcatccaccacaccgtgtcatccacacacaagcattaactccccattcgccagctgatgactcaagattcccaggagttctgctcattctaatgatgatactccctacgtgctctgac

SEQ ID NO: 582404 - DNA, 580 bp, Homo sapiens
  misc_feature (227)..(227): n is a, c, g, or t
cggagcccttccgtggggggtcccagatttggggggtgttccaacgcaaaaaccccgccccgggtttgtcgtttccccatccaggggatgggtgtttcttcccagttttttgccccgccccctttttttaacccctcggttttttcttttaatttggggtgagggagggggccccacctcccctcctccccaaaagtggggggccgtgagggggtgcatcctcttcnttggagagacttccccttcgggcaaaaaataggggggggattccccggggggattttaccagggatttttttttttttggggggggggggccccccccccccgggcccctttttgccccggttttttttggtccccggggaatttttcctttttttaaacaaaaaaaggggggggtttttaccccttttttttgggggtttccccgggggccgaaattcccccaaaaggggggggtttaaaagggaaaacccctttttttccccttttttgttcggcccaattttttttttggcccccaaactttcccccccccgggggggggggggccccttaaaaaaatttttttttttta

SEQ ID NO: 582405 - DNA, 1458 bp, Homo sapiens
ggcgacagatggcggccgagagggaacctcctccgctgggggacgggaaggccagcgactttgaggatctggtaggacggagaggacctgttctaccagcactgtctccaccctagatggtcaagtctcactcatctcgcagaaaccgagtctagtcttccgtgctagaagattatcagtgcatagagctccacattggccgccaagaaagccgcgacgagatacgttgctgagttgagactcgagtgagcagcagcaacgagtcgtcttgtctggcgagcaatgcctacaaggaagggagagctcttcctcttgggatcgggccctgcaataggggacagccgtgatccgtattccttcggatagaggctttctactctgttgagatcgagcacgctgtgtaaaactttcctgaactaacatctcgatgtggcgtgccttagtcaatgtgtaacagtccaggaggcagtaatgtcttgactacaccgtggaattgcctttgagttaagaattcccatggggtagaggacgcacttgggagacggaaatgtaacgacgcatactggggaaggatctacttttttctggaaacaggtaaagaacaaggtatgaggtggtaaatgcgggaagttcctaggtatatacaacggtatgaggtagaattggacaggtgaatacctgcgccatagtgtagtcgggaccatcattactggagggtatagaatccttaaacggatgcagtccatcctgtatttaccactggtttgccagcggaaaagcaacgttgaggcctatcatacccccgacgtagcgttcggcaacgaaattgcgagttggagccatctccctcgggggagtaggcaagcgggcggccagaaacgtcaagagtccaaattgagccataccattaagtttagtgacccaactaggctcacggggttttacatcaattgcagttgggacagaacacgaagaacttacacgactgaaaaaatgagcgacacgtcactaacggtaacaggggggattatgaagcccgaacagggtgcaacgaccggtagggggtgcaacgagcgacaagcaactccacatccccatccaccctgcggcaacgtcgtggtcacgaccacaagccaggcgccgccacgcaggctccactggacacgagggcaatcctctcccacacaggccaaacaagggcaacacacctccaagccgtcaacccagcaagagagttccctgacttcaaggggccagtcctggagagacagctgccagaaggcgtgcccatcaaagccaagcaagaagcacagagcactcgcaacgtgcagccacgcgacaactgcaacgagatggtgccacccacgggcagacagacgcgccagagcacaacacggcaaaccacaacaggcaggcaaacagagcagcagacgccagagcagacaccggcccccgaac

SEQ ID NO: 582406 - DNA, 704 bp, Homo sapiens
gactctgcagaaacccggcgatatggctgccgttgtgccccgcgcggcatttctctccccgctgataccccttctccatgggtctatcctgctcctctccgctccacgcatgtgagggagcggttctgcacagcactaagggacagcccattccccctggaatagggcctaccgttgtctcacgaaaggattctgcccccagagagcattgtttcccttcatgaggtggacatcttcggagctccacgaaatagccccctaaacaggtggaagaactgcgagtgatgaaatttccagggctttgcttgctgggagataacctccgtgatatcgagggagactgatcctacatttggatcgcacagaatagctggtgaacctccacgaatgatgggttgacaagcatgaaagatgcagcttggtgtgaagcactctacctcgtcgttgacgccattgagtagtcataccccgaaggtctttacttaggcgtcatgccgggacagtcgtgaatgggttttagcacaaacactcaatctacccattaacaagcgtgaacggtgagtacaaacggtgggttatggcaatccatggggctgagcgtgtaacggttgcacaagggtgtcttgcctcatgggtattgcctggtttgccttgcctgttatacgacggccctggccgggggagtccatcaagggcctctgggt

SEQ ID NO: 582407 - DNA, 199 bp, Homo sapiens
gaaaaaaacaattcttacagtctaacctggcacacttagggggctttattacactttaaaatcttctagctcagtatgtaaattggagaagtaggcaaaaggtctagatgtaaatataattggagaaagattttaaagaaaactccataaggttggaccgagctagggggaccctcctaagaagtcgaccggcaggcat

SEQ ID NO: 582408 - DNA, 170 bp, Homo sapiens
cagtaggaagatgtgctgttctctggttctctaaaatggccacacacactttaaatgggccaatgaaaagatacaatttctttgccccgggcccaggaccctcaaggctctgttgtgtggtgcccgtgaggttaagttcagagcataaactgacacgccaggctctggga

SEQ ID NO: 582409 - DNA, 363 bp, Homo sapiens
ttagacaggtgtgttgccttcaccccagcgaaaaagaaaaacagatgaataagcttttgatctccattttctttctctaattctcatggtagtctgagatgcttttaaatgtgatgttataagcttaagccagcttcacttacagcaccaagttttttaccctcctggccaaaccagtgtctcctaatggtcacccttgcagcacttctctccaaaagctgcgaattcatccatccagctttcagttgctctttggtcgccttgggctgtgtgtttcacgagctcccagagcgcagtgtgtctcttgatgtgtctctccctctcagagagtgtgcatatatgcgcatgaaaggtgtgtgttcc

SEQ ID NO: 582410 - DNA, 294 bp, Homo sapiens
agcgtgtccttctccaatcagccatcttccatcatccctgcatgttcttctgaaagcccaatgtgaacgagagggacccagtcctttcccttcctgcaacccccacagcaacaacccatggcagggagaaggacttgtggtggcccagagacaggcagagattcaggcgacaagggacaggacaggaatgatgatgagggacaggagagggtacaggtaaggagtaaagagagcacctgtgttcccggccaagctgtagtcgctctcccatggggtactgagcacgtgaccagt

SEQ ID NO: 582411 - DNA, 259 bp, Homo sapiens
  misc_feature (244)..(244): n is a, c, g, or t
tggagtgcagtgactattcataggggcaagcattatgcacaacagcctcaaactcctgggctcaagtgatcctcctgcctgagcctcccgagtagctgggaggctgaggcatgagaattgcttgaacccaggagggagaggttgcagtgagctgagactgtgccactgcactccagcctgagtgacagagtgagactctgtctcaaaaaataaaaataaaaaataaaagaaagtaaaaccaaanctttaaaaaaatata

SEQ ID NO: 582412 - DNA, 116 bp, Homo sapiens
ccattctgtcccccttatcagtctctgaagcctcaactggactgtcttgggatgactcctagctgtcctttttcctctccgacgcggctgctcaaggcctgcttatgttctttttt

SEQ ID NO: 582413 - DNA, 414 bp, Homo sapiens
gactctagagggtacaaggacttgcagcgagcacttatctatgattatcgctgttttaagcagggcagactcccaagccagagtagcttagacagactcccgaactttttcttcttaatttatgagtgttcttcacacactagggaagttagctctttgtccgtgatgtgagttgcaaacattttttccagttagtagtttttctcttgactaatttttttttttttttttttggcaaaacaaaatttttttttaataaggaccaatttataaacaaattttagggcttcgggatttaaagttttagtaaacccagcctttgccattaagggttgaagggcctttttttcttttttggaatttccttcaaaaactttttttttttttttggaaaaaaaatttttctttttttcc

SEQ ID NO: 582414 - DNA, 327 bp, Homo sapiens
  misc_feature (14)..(14): n is a, c, g, or t
gagctcggtaccgnttcatcttctgaatcccaattcttacatgtattgcatgatgaattcagatgccagtggcctgcctggaaagaccagtcttaacgcaacaaggagtctggcaatccacttaataacacaaaccataagagaaaaaaatccaaaacctctatgttaatgaagcagcaactgtggtcccctagcctcctccacttcaagtacatggtgttcctagcacattaatgtcccttaatcctcccagcgacccctaggcatctgatgtgctatctgcattggctccgtgtcagtatcagctctggccttggcctacagagc

SEQ ID NO: 582415 - DNA, 741 bp, Homo sapiens
atcttcttaaggagctggtctgtggatcttgcgcttgaatagatgaacctacataagtctctctgtgagtgctcttcctgatgctcactcagtgacagtcacttccagtcctaatacaccttccactatggtcacaggattgacgagttcacaaggctgattctacacatttactgccctaaacctctaaatgcagaagcttggccataacttggatgagttacacctataataaagctgtgtgtcatggacaaagatcttctgacttgagccctgaaggcatgaacaagcatgccagctaatgatttgaaggtcagcaagctaattgtaccacttgtaatcctacgtattgttacaagcaacggaacaatactgttgcgtgaaagccccttgttgtaaagcctgtaaagagactcaagtctctgagagatccagttttccttgtgcaacgataatctataccagataatcggtatagattgctattcagaagaatgataaaaagatgcctcaaatctagtcgaaggctcacctgatggaaaatggagctgggctactgagatagttttcatatatatattaagataaccattctctaattccgtgaaaatatgtctttgcaaatctctgcaagttaagcaacttaatctgaagttggataattgggttttgtctagtactcacttctccctaaataatcttcacagatattgtttgagggatattaggaaataatactcg

SEQ ID NO: 582416 - DNA, 1892 bp, Homo sapiens
tatatatttatttttaaaggagtagaaaaaatctctttgttaacccccacacaaaaggcccaagtgggggggttaaaatggccaaagggtgggggtgtgttggggcagtaggaatgaatgggcgacaatgtgggcgcatgtgtagaacatgggcaacaagagcagtgtagaagcaagaaatgtaacacatggagcaaatatgtatttgggggtgctcgccctagtagatgggtgtggtgaggaatctccactactacaccgcgacgcgttagtcgccaatgaggtgagaggctgcactatgagggatcttgtggggtgcattataaaaacctcggtgttgctcaccacacaactcgcgaggagaaaatagtattgtgcctagtgcactagtaaagataatcagagtgcaaatcaagacaaaaaaaaccacaaaaagggtgtgggccccacacctttttgggggaaagaaacgagaaaaatatcatcctatatataagaggggacaaaaagatgaagtgggaacaaagaaaacagtgatgtctcgcagaacatagaaatagagggagagaaaatacccgagaacccacaccccaataaagatgtgagagagcaccaaaaaatggtggatgtgttttatccatggtggcgctatctactccctcctgtagtgagaagcaaaaatctcacaagaaaattataataagaccactctctaaaaaacagcattagtagaacacacaagatcatgatgtggatagaacgacaaataagtatctagagcccccaggtagtcacagtataaatataacaagctatcatgcgaggaaaagcaagagagaagaccaacaaaaaatggggatcactttatgaaaatttaagaaaaaaaaaactagtagatgagaagaaaagagataaaaaaaaatgataatatgataaaaacaaatactcaatatagatcattgtagaaacaaaaaagatatatgacattaagaggacacacctagtatcatatcaatcacagaaatagagaagagagatccctataaaagaaagaaaaaagcagaggcaaagataaaatgtaagaaatgaaatgtataaataatgttactatatctacaacctaaacacaaagaattttacaataacactccacatcgacatacaaaacaaaatgattgtatcaaacatacatccttatgtatgttgaccacaacttaataacaaatataaaatagaataacttatcaacccaaccaaaacaaacacacaacaaacataattatatatcaaatcaacctgtacgataagatatgactatagcataaacataactcctacatagtgaatacacacacatcaaagacaaagactaatcagtatactagtatgttaatctctagtactgacaacaatacacaattatgatatactaacccaccaccaaacacatatgaatacacgagaaataacttaatatatatatgatataaaaacataatcaaaacaatttataagcctgtcatttccaaaacactcacaaatcaaatacaaacacacaaaatattataacaactctcacgtcccaccatcaattatataaagaaatgacagagaatacactaagaaactataaagataaactatcatgagcataaccaccactattacaatcgatactaacaaaataaatacttactatcaccacgctaactagattatcataaagaaaaaaacaatactacatataagacaatataattacgaacaaacccacaacaaacagaactaagcatatcaaataatcatatgcatcacaacaacaaaaagaacacaacaatataaccattataatactaatcacataaaccaacagcaagatagagtaacaaata

SEQ ID NO: 582417 - DNA, 991 bp, Homo sapiens
  misc_feature (991)..(991): n is a, c, g, or t
gccaaacagatcctggagctgtacatgctgtataatgctggtgaccgagaagggaggcctggatggagatcatcaacaagaagatctggagggagatcagcaaaggcctaaatctgcccagcatccatcaccagcgccgacttcaccctcaggacgcagtacatgaatgtatctagtatgcctatgagtgtgagaaggaaagccttgagttccccagctcgatgctccaggcatgcaattgatggcaaccgcagggagggcccggtggcccagctaggagctcctccctctttggctactcacctgctgcgtgctactgctgcatgccgcatgccggggcccctgtcccttctgctcccccacccaagatccgctttcccaatccttgggtgctgtgggttccgagtcagtggttaccaagtacctacgttagccctcgtgcatactcccccgagacataccacctctcaggaaaggtggaatggtagccctctagttgacaaccatgttgcctgtgccgaaatcgtgcgtgggctgtgcccgttgacccttggacatagcccaggcagggttgtttactcggaatgcgcgcactggtgatgccagtcttccgggagctggtgggaggtcaggggtgacgtctttgctgcagaagcaaggcatcgacggctgtctgaggaggagcagcggctggttgcggcaggccttcctgcgcaacttgttccagaatggctcggcagtccgcatgagatctccggtcgactgggcgcggcatgaaacctgagcggaggccctcggttggcgcttgggcttgacaccgagtagccttgcgggcttcacatttggggccctctggcccccatgcagtgtggtcgttgcccgcacccctcggcgcctgtggacggacgcagtcactggcctttcttctcaagcccaccgtccacttgcacttgtctggtggcttcgcacactaccgtttccgtggggaaan

SEQ ID NO: 582418 - DNA, 322 bp, Homo sapiens
taagagcttcaaggaaaacccgaactgcctaccacatcaccatcagtgtttccctcggcggctgtcaagtgcagccccccccgtgggtcctttgttcagctaccaccagtatcataatcagcccatccactctgtctctcagggagttgttttttactccgaggtgcggaccaagggatttcaaagaggggccagccaggagttgaaaaaaccagttaggtcctctgtaaaggaaaaacagtgtttggagttaaccgggtttggggagtaggcttaagcccaaccttacacgtttgatgattatcaacatgtgcttaaacca

SEQ ID NO: 582419 - DNA, 192 bp, Homo sapiens
atgggtcagatggacggtcagaaaagaaactgcccatagactgagacataagccagttggacacgttattataccaagccaatatagtggtgtgagcgtgtactactacacaacgaatgaggttgtactagaattaaatcatgcaaagcaggttgcagacatggttagattaagtatacaacacatttccat

SEQ ID NO: 582420 - DNA, 382 bp, Homo sapiens
gaagctggctctctaccaccttcttactacatggaatatgtgagggcactagagactcatcagaacggattgctgaggaccatactgaccatacttgaagtctttcagctaatggtgagctggaagaaattgctacagtgtatctagaaaatgggtgaatacccactgatttccatcagtggtttcttgagactttctgaaaaattattgacatggatgcaggggcagatcaaaatcactctctggccctaatcacctttttcttgactctctcgctgattttccaaacacaagttaggagaaaagtggtagcatgacaaaaacagtctattacccaaatcttaacaaaggctacttagttttgggggataatctagagaaa

SEQ ID NO: 582421 - DNA, 100 bp, Homo sapiens
tagcttgcgactgtactttccggggtgttggtcgatagggaatttagctatgtaatagctgtcgtcctaccgcatgagttcatgcggtcagagatatagt

SEQ ID NO: 582422 - DNA, 436 bp, Homo sapiens
gcgattagccaagagtccgtactactatcaagctctgtgagacttcagaatctttatgaagcgtgtgtcaactggaattcaaatcacattttgccaaatccaccttgcttccccttggaatggctagatgtcgcaggtctattatggacaccaactggaaaaagacttctacctgtaacatctctgtagaaattgcacagtaactatcttcatcaagactttgatggccaccataccatcactactcataaagctacatgtgagagaattgtttgttgttatcaatcctaatagtctttgacctatcaagctctcgtatcaagctgtaagactgagtcatggtagtctctcactgtaagctgggcctttcaccaagatggccttcttaaacaacctaccttctaaacatttaattcttttgagcttgatagtgcat

SEQ ID NO: 582423 - DNA, 893 bp, Homo sapiens
  misc_feature (28)..(28): n is a, c, g, or t
  misc_feature (124)..(124): n is a, c, g, or t
  misc_feature (196)..(196): n is a, c, g, or t
  misc_feature (240)..(240): n is a, c, g, or t
  misc_feature (336)..(336): n is a, c, g, or t
  misc_feature (369)..(369): n is a, c, g, or t
  misc_feature (548)..(548): n is a, c, g, or t
  misc_feature (561)..(561): n is a, c, g, or t
  misc_feature (587)..(587): n is a, c, g, or t
  misc_feature (621)..(621): n is a, c, g, or t
  misc_feature (640)..(640): n is a, c, g, or t
  misc_feature (645)..(645): n is a, c, g, or t
  misc_feature (684)..(684): n is a, c, g, or t
  misc_feature (688)..(688): n is a, c, g, or t
  misc_feature (693)..(693): n is a, c, g, or t
  misc_feature (695)..(695): n is a, c, g, or t
  misc_feature (697)..(697): n is a, c, g, or t
  misc_feature (724)..(725): n is a, c, g, or t
  misc_feature (727)..(727): n is a, c, g, or t
  misc_feature (737)..(737): n is a, c, g, or t
  misc_feature (740)..(740): n is a, c, g, or t
  misc_feature (749)..(749): n is a, c, g, or t
  misc_feature (755)..(757): n is a, c, g, or t
  misc_feature (759)..(760): n is a, c, g, or t
  misc_feature (763)..(763): n is a, c, g, or t
  misc_feature (766)..(766): n is a, c, g, or t
  misc_feature (772)..(772): n is a, c, g, or t
  misc_feature (776)..(776): n is a, c, g, or t
  misc_feature (786)..(786): n is a, c, g, or t
  misc_feature (802)..(802): n is a, c, g, or t
  misc_feature (806)..(808): n is a, c, g, or t
  misc_feature (815)..(815): n is a, c, g, or t
  misc_feature (827)..(827): n is a, c, g, or t
  misc_feature (829)..(829): n is a, c, g, or t
  misc_feature (882)..(882): n is a, c, g, or t
tcatatataatttttattatgaccatanaaataaccctgtagtaaataacaatttaattgtacattttaaatttaaaaaaaggtgtagaattggattataaaacataggataaatgctacacgngaaggatgcctcacttaatgctgttattattattatatattgtattcctgtattaaaacatgccatatattncatagatactcatgcagccaccaaaattaaaataaatttaaatnattaaaaacagaataaaaatttacctacagaaacaatattctttaacttatttgcagttgaaagccactggcaaaaaaaaaaaatcactagagttnttaatctattatcttactaaacagtatattgtnaccatcttttacctatacccttgagtcaggtgaaagaggttaaagtttgtggcataataacgcttcattgaatgcccaatagtatttaacatgttaaaaatgttgaattaaactattaacttcacacataatctaaaatttataaatgtactgcattttattatataaaagtacaatcnggccaggctcggnggctcatgcctgtcatcccagccccncgggaggccaaagtgggcagatcacctgacgttngcagttcaagaccagcctngccancatggggaaaccctgtttctactaaaaattcaaaattanccangcatngngncacatgcccgtaatcccagctactcannangctgaggcanganaatcacttnaatctnnnanncanatntcacanttanccagacatcnttccaattcactccancctnnncaccaanagccaaactctntntcagaaaaaattagtacaattagtacaataatatactactcatttaattttanataaaattaaa

SEQ ID NO: 582424 - DNA, 234 bp, Homo sapiens
catatgacgaagatggacttcccggtgttagtgagttagcaatacagtcagtgcagacttaaagcgaatgagatcatttatcagatatcagttgaattgtgcagtcttctctactttggtaataaggtaggaagttagtaggactcacttctcggattaataagcaattggcagcacacagggttccacgggggggtctcacgctcacctgaaaacaccggtgcccaaccggtg

SEQ ID NO: 582425 - DNA, 880 bp, Homo sapiens
gctttctttgcggaaatcaccatggcggatgggaccgctgtataagtatgctgaaaactggaggggcttcatggttctctattcgtctgttcagtaccagtagtgggtgtcatggtcacgtcgttgcttcttccgtaatcacaagccacacttgccatttgggtcaaatctaccggtacgctcgtgaagtacttccgtgatgatctaacctgaccaggtcaagtgtcccaagatatttgaagggtggactgatgagattctagtgtgatttgagacgtaatgggcgagtggacactatctagtgtgtagccaatgaggtagactggggggaaagtagtacacagagggcggatagtccaggtgggttgcacgatggggatagagactttaagcttgagttctcgataataggtggcgcgcgccagacacagtaaccatggcgatgattcccaccatcatatggcgcatcgatgcgaccgataagacaacgaggccaactgagacatgcatgcagagaaggcaagtgagcagcgaaattcttggtggtctcgctgtggaattggcatgtaccttggaagcactgagggacctatgctgtgtgaggcagaacgatgtgacatgtggctgacatgcagagtaagtcatgcaacgctgtgagtggctctataaggaagtgttctagaagccttggttaacagtcaggcctttcccaataacgaatggatgagtaccgtaaatcctgcgataaaaccaggccccagttcccgggctggcttggggcgaagtgaaacatgtgtgagaaaacatggccaagatagatgattaaaagttgggagaaaccccagctaaaaaggaccacaggaaaagagaaggtcagggg

SEQ ID NO: 582426 - DNA, 115 bp, Homo sapiens
tagtccacacctgcaccggtagtccacacctgcacggtagtaccacacctgcaccggtagtcccacaccgtgcacctggtactgcacctggacttgccctccaagtggatcctcg

SEQ ID NO: 582427 - DNA, 101 bp, Homo sapiens
cactgcacgcccagacatccactgcacgcccagcctcccaaagtatagagattacaggcatgagccagtgtgcccagccaattcatcggatgttagatcga

SEQ ID NO: 582428 - DNA, 224 bp, Homo sapiens
ggattgtggaatcatttggcgcacaggtgcagcagccgtggtcagactttaccttcgtgacatcccaggtccggaaaagaaactgtcggagttcaggatggtggcttctctacgtggtgtccatggtctgtcagcgatgatttctccatcccgtccccgacagcccacgcccaacgtcatgggcaaagttcttggagcatgctcagctagcgcaataggcccgc

SEQ ID NO: 582429 - DNA, 605 bp, Homo sapiens
  misc_feature (541)..(541): n is a, c, g, or t
  misc_feature (565)..(565): n is a, c, g, or t
aattcgtgtaagccgaaatgggaaagctcacgaccaaagccactctttttcacgccaccaaaggccactcgcgcgtcgctggcacaataaccattgataaacaccccaccgcattccagacgtgccgccatctgtctggcctgtgtttcgtcagtggtaaaaatggtcgctgaaagccgaactcactatcattagccagttccagtgcatgttctgcatctttcgcaatggtgattgccgcaacggggccaaacatttcttcccgaaacgcggtcatttctggggtaacattcgccagaaccgttggcggatagtagttacctgccccagccatcttttccccgcccagtaacaaacgcgcaccctgcgccagggttttctccacctgatgatgcagctcatcacgttccgagccattggtccgagagcgttctcttcgtcacggggatcgcccttttcaaggctgccgcagctgccaccgttcggtaaatgccgaagcaattccctcttcgataataaagcgttttgccgctgcaaatanctgtccggtattctgatgtccggntaacggccgcttttcaacgccagttccagatcgggtcgtt

SEQ ID NO: 582430 - DNA, 1208 bp, Homo sapiens
  misc_feature (302)..(302): n is a, c, g, or t
  misc_feature (360)..(360): n is a, c, g, or t
  misc_feature (404)..(404): n is a, c, g, or t
gcggacatggcgggatcccggttcgcgcgggagctcttcctccaggtcgtggcggccgtgttcatggtaagcttctacgtcattcactcgtacgtactacgcaaagtactccaggtcctggtacttggcctcaccggcagtggacactcgctaccatgacacaggtatgagaacgacgtgctggactctctagggacgatatggtggacgcatggcgagacgagtctgatggagagaactcaccgcaaggacttgcttgtggcgcaagctgccgtagaactggtggactgcgaatcatcggnacacacgggaccttgtcactcatgcctgagacctgcttgcgggtgcacctacgttggncgactggcgagtcaccctgttatgactagagaccacactgttgncacagctacatgtcacatctaactatggctagtgtattgaggcccggactaaccattggtcaatgactgaccaagggtgtggccaaggctgttccgtttagtttccaagttggcgactcacctttgcatagcgtagagaacattggcttttcctagtggcaccgatgcgtatgtgtaggcccccaggcttgagtgcgcatgcacgtcctcagccggtaagggagtgcacctccacgaggggacaaggggcgagcgcatggggtgcccctgacaccccgacagcatagggacacttcaccccttcatgtgcttggtgcgcatgggcgtgctgttcacgcacgtcactgttctgcacttcaaggcagtgtgtcaaggcgttgaccatgctcggcttgcgcctgcggtgagtggggggcatcgacttggcctcaccttagccactaccggagacccgagtgccttgcccagcgccccgccggcctgggttcgcagacaccaacgtggcggtctggctgcgacaaggctcagcgtggttgggcaccttcctacattgaggatcgctgtgccggccctgttcttcggccccccattcgacgcctgcggctaggggcttggtttctaactccgcaggttgcttgctgccagggtcctgattactcactccaccgggaaacttaccaactttcttacaaggcttgattgacgctgggtgctttaccacttgcgctgtttggacgacaggaccctggcttgttagccttgccatggcaggccgtacacgaccggcacactctgggcccaggc

SEQ ID NO: 582431 - DNA, 421 bp, Homo sapiens
gtggttgacctgtgtttgcaaggttctgcacagacggtgcccccaggtgtcccaatacctcccgagcagtccaagaggcctctgggcgtgcacgtgcagcgaggcatcggaacatgcctacaaatggccatgtcaaggtacggcggcttcatctcctgccctcagccctctggtgcctgtgaggtgcagtgaccaatagccatgcgcagccactcttgaaagcagccccttgcttgcggctggtggccctggtgcccagtcctagggggcttaccctccttggcactgaggccatcaggtcggcgcagccggtgttcttgaatggccttgggcttcctgagggctccaaggcagaggctcactcagagtccatcgtgggctgagttgtccagcaggtggggagaaggtcagtcatgaaagc

SEQ ID NO: 582432 - DNA, 142 bp, Homo sapiens
aggtatagtcaagaggacatgcatgtatctatcttcggcagagcctgctttacgagcattatgcagctgtcccccaaatgcagaaccatggagcagacagactttccagtacagggcccaattatgtgtcaccagtgaacat

SEQ ID NO: 582433 - DNA, 294 bp, Homo sapiens
ggcggtgcacactggatagcgtgataagccagtctccagagtatcccccttcctgggagcccggcatctacactcagattagccagtgctcccagctgcgctccagccctctctatgagtacatccaagcaacagagatctcaataccgcccttaattgatgttgcctatatcttgacacctgccaaagcttcctgcacgggacaatgagaaacacctgcgtaccaagatataatctcatgatctttctggttcctgggataactctctgactcttagacatgtctctttcttc

SEQ ID NO: 582434 - DNA, 351 bp, Homo sapiens
  misc_feature (8)..(8): n is a, c, g, or t
  misc_feature (34)..(34): n is a, c, g, or t
  misc_feature (77)..(77): n is a, c, g, or t
  misc_feature (103)..(103): n is a, c, g, or t
gtccatgnaaagaaaactgcctcgccttttggtncccctaagcctaatagcctacagataaaaggtcagatatcctncccataggtaggtactcctatgttcnacccttatgtaaagtgcccaatttattgagccgtaagaggattaccctaattgactattccccagcctgctccttttctcttgcaacacatggagtcagcaatgggaccatatcctctctctttcccctccagcctgctttccccctttaaatactgaagccctcaaaatcatctttctaaaaaggtatgaaccatagattgttcctgtggatttgtgtttctttcttccgggcatatccttaagctt

SEQ ID NO: 582435 - DNA, 189 bp, Homo sapiens
  misc_feature (44)..(44): n is a, c, g, or t
ggtccgggaattcccgggtcggacaccgacgcggtccggattgnctgcgtattttgttgtgtgtgcgcaactcagactttgtgttcattgtgttaactttaatttgcaaagaaacatcacgtgtactgctgtttttcatttctgccttttaaaaagacagaacagactattcagaaacagacaagaagg

SEQ ID NO: 582436 - DNA, 254 bp, Homo sapiens
cagcacgctgctcagacgtgctgggacttacaggccttaggcatctgattcttgccttttgacaattgttagactgagttacaggcggtctgtctgggacccacatcctatattttgaactgatgaggcccagcaggctcagaaatgggaaggcgctgtgcttggttccccatctgtctggctctttcatgtaacaagttctcactggtgctgtgagcaacttgtaaataggccagactgctggtctctggaat

SEQ ID NO: 582437 - DNA, 283 bp, Homo sapiens
  misc_feature (254)..(254): n is a, c, g, or t
atgttcggcagtgttctgaggttctcgtacgagatcatctgtgcctgacgcctgtcgtgcagtgaacatgttctgatgcagcatgctgcctgtcgagctgatatgctgtggatcagtgtgtgtgccctgtgtcactgcctgccgctgtgcactgctgctgtgatctgagtgcttcagtgaagaactgctgttgtcggcccgttgactgttgcctgtggtgtgatccctctagatgtctgaccttgcatgtgcantgcaatgcttgtgcacttgtgcctgtctg

SEQ ID NO: 582438 - DNA, 111 bp, Homo sapiens
ttggtgctgctgggtgatgagggtggggtctggtaggaccagctgtagtccgagccctttaggtctttgattacctgctcgctggcgggaggcagtttgtggggttctgct

SEQ ID NO: 582439 - DNA, 619 bp, Homo sapiens
agactgtaagtgacatatgagaagggaaagacagagatgcatggaggtgtttacgcatgaaacatgcttcacattattagagttggggaaatgcaaatcaaggccacagtaagataccactgtgtactctctagggaagctataataaaaaaatcagtaacaggtgttggctaggatgtggagaaatttgaacccttgtacattgctgatggcaatgtgaaatggtgccactgttgtgaaaaacagtttggcagtccttcagaaagttagatgtaaagtttccatgtgacacagcaaatctactcctaagtatatactcaagagaaattaaaacttacatctgtgcaagcacacacaaactcgtgcatgaatgttcatagtggcgttaatcctaatagccaaaaagtagaaataagctaaatgtctaccaactgataaatgagaaagaaaatgtggtatgtccatacaatggactattactcagccacaaaaaggaatgtagtcctgatattggacacaacatggataaaccttgaaaaagtttatgctaagaaagaagccgtcataaagatcacatgtatgatctgctatatcaagtcagaatagcaatcgtaagacg

SEQ ID NO: 582440 - DNA, 406 bp, Homo sapiens
actactactactaattcgcggccgtcgacttttttgagacagagccctggtctcgcccaggctggagtacagtggtgcaattatggctcactgcagcctcgacctcctgggctcaagtgatcctcccacctcagcctcctgagtagctaggactatagacatgcactaccatgcccggctaatttttgtattttttgtggagacagggtttttccatgttgcccaggctggtcttgaacttctggactcaagggatccacccacctcggcctcccaaagtgctgggattataggcatgagcactgcacctggcccttgttaagttttaattaacttttttgtttgtttcttttttttttttgcgacagagtctcactctgtcaccctggctggagtgcgtcgacgc

SEQ ID NO: 582441 - DNA, 120 bp, Homo sapiens
cgactcttgaggatacaccgccacgagcgcagcgcagctgcaggagtcagggggtgttacggagtctcgttgggtgttaggagggctcgttaggagggcggtagtagggctcgttacgga

SEQ ID NO: 582442 - DNA, 264 bp, Homo sapiens
taccggggataccgccagtaacaacagacattttatgcatcctttgtacgtaaggatccccaaattctcggctgtggatcacatacccggctatagagctgttaggaaacagggcacacagcaggaggtaacatgggggtgggggactgagcattactgcctgagctccacgtcctgtcagatcaatgggattagattctcataggagcacaaactctgttgtgaactgtccatgctgggatctaagttgggtgctcattatga

SEQ ID NO: 582443 - DNA, 825 bp, Homo sapiens
cacccgggggagaagtgtgcccccacgggggacccacagcgacggcaggtgtcacgcccctcggcgccattagttgtgacccgccgggcacaaaaagttgcgccaagcgacaccgcggcgacaaaaaaggggggagcacctttgctgcacggaaagcataccgtcgataccgccccggcagaaaaagagcgtttgcggtgcggtcacgaaagcgaagaccccgggcttggggtaaacccagcagccccctgcgacaagccgttgcaggaaatggcacgctacaggaagaaaaaaccacgctcgcgtgcgcaaaggtgagtcagagcacacggatctgccaggtctggaaaaaaaatgtccatcgaaaagtaggagacaaagaggcctgctggaccaaacgcaaggggaaggagaaccaagtgggaacaggctcccgtcacaggcggacgtgggttctgcaaacacatgccagactggacaggctcgacgaccgcagcctgcgatgtatgtactccctcccaagccctctgggccaaaaaacgccagcacaagagggctcgatgacaccaaaggccaccccaggaccaggcctccttagaagatgattttcggggaaaatggtctggctctaccgacctaataacagaagtgtctcgtgtacatacacgcaggacataacaacagtacacacaaggttgcgaaacactgctcgtcaaaaagagaagacaagatatgtgaatcttgtgtgtatacaaacacacaacaaagtcagcgagttttgtagtaacaacaacaaaataggatattttctgtgcaatcaaatca

SEQ ID NO: 582444 - DNA, 461 bp, Homo sapiens
tgcatcttcactgatgggactcagtccccactgaaggaaatacacctcccaccaagtccaacctccaacactggagattacatttcaacatgagatttggaggggacaaatatccaaatgtatcagctgtgttcccagttctaggtttatatttcagagtatattctttatcactttttggtggtggtgttgcagggagaagtaggcagcaacccagatacctatcactaggtcaatggaaaagacaaaagtagtatattcacatcatggagggctggtacagtggctcacacctttaatctcagcactttgggaggctgaggtgagaggatcactggagccaggagttcaagatcagcctgggtaacaaaatgagaccttgtttctacaaagtgagactctgtctaaaaaaacccccaaaaaacaaagatgcaaaccaaaagtgtttatatatttattta

SEQ ID NO: 582445 - DNA, 246 bp, Homo sapiens
tcctggttaagacagagtctcactctgtggcccaggtggaagtgcaggggcgccatctcggttcatgtgaactttcacctcccaaattcaagcaatcctgtgggcctcagcctcccaagtagctggaataacaagcgtcgtgaaccacgcccagcttattttttggttttttaagataagaagacagggttccgccagtgtgggccaggcgggtctcaacttccgtggcctcaagtgatccacctg

SEQ ID NO: 582446 - DNA, 231 bp, Homo sapiens
tcctgcgggtctctcctgacctcaggtgatccgcctgtctcgcgcctcaagtgctgggattacaggcgtgagccgccgtgccgggccttgactgtgagattctgaagtgaattaattcacactgatggtgccctctcacttgagtcaagggttctggtcttacagatgccctcttcgccatccatctgatgttcaatgtgaatatagcagcaatctaactcttagcaggac

SEQ ID NO: 582447 - DNA, 419 bp, Homo sapiens
caaagttgattgcatgttattccattccattccattccattccattcctttccactcgggttcattccattccattcaattccgttccgttccgttgttttccgttccattccattccatttcatttcattgcattcccctctggttgattccattccattccattcaattcaattccattccattccattccattccatacccttcaggttgattcctttccattccattccattctataccattctactccattccgttccattccattcgggttgattccattccattccatgcccttttattccattccattccattcctttccattccattccataccattccaccagttgattgcatattattctattccataccattccactgtcgattgcatgttattcctttccattcct

SEQ ID NO: 582448 - DNA, 280 bp, Homo sapiens
  misc_feature (136)..(136): n is a, c, g, or t
  misc_feature (138)..(138): n is a, c, g, or t
  misc_feature (150)..(150): n is a, c, g, or t
  misc_feature (160)..(161): n is a, c, g, or t
  misc_feature (188)..(190): n is a, c, g, or t
  misc_feature (198)..(198): n is a, c, g, or t
  misc_feature (207)..(208): n is a, c, g, or t
  misc_feature (216)..(217): n is a, c, g, or t
ggacacggacttgcattcactgacgagaccacacaccactgtcactcagggaagaaaaagcgcgggcatgccagcctggagccccgaggaggcggcctcctcttcaagagtgggagggggcagtggctggagtgtngngggcagcctggngaacacctcnngcttaataggcgttgttagagacgaannngggactcngctggcagnnagccccanncctgtaccgcatcgcgaggtgtacctttctcttgatagggcaacggcgtgtttggccacgtgg

SEQ ID NO: 582449 - DNA, 185 bp, Homo sapiens
  misc_feature (121)..(121): n is a, c, g, or t
  misc_feature (160)..(160): n is a, c, g, or t
  misc_feature (181)..(181): n is a, c, g, or t
cttggttcgccagcggatcagtcgactcggccagaggatgtccggcttccagatcaacctcaacccggtcaaggagccactcggcttcatcaaggtcctcgagtggattgcttctatcttngcttattccacctgtggaggttttaagggccaaacaganattcaagtgaattgtcctccngcag

SEQ ID NO: 582450 - DNA, 339 bp, Homo sapiens
gtgctactagttcagagttcagagactgtatggcctgaaacacctaaaatatttactatttggccctttaaaaaaaaaaaaagattgtcaaccccgtgagctaaataattgtttatggctgtgtgccactgaaagtcaccagtgattggtttggcagcatcattgtagcaaaagttttactgacacattcttctcattctgaacagccattttcttttacctatttccccccacagtaaagtactgttggagcagtaaaaagcccaacgttcaaaacaaagccagctttcctcctcctctttcccaccgtgggcacggaccccatgcgtgaatggccag

SEQ ID NO: 582451 - DNA, 1009 bp, Homo sapiens
ttgaggtctctagaacttgatttgcgtagcacgatcattcctgtcaaagtcaccagagaaatgcatggtggacatgattaccggaccgtctaaagccatgaaccccctgtaaagcgcaagacagcctccctctttgatgcagaagtcctatgaaaggaatggtggccatgctacgcagagaaagatggcgcccgcgtaatggctgggagaagtggagatgacatggaagtcctcaagcgagaaggaggccgaccggagagggccagccgggaaggggctggtgacggaacccaacagtgaaccccaaggctggatttaccagatcgacagaaatctccttccttctggttcacctaagccccatgcaagaccatgaagttcatcgtgtggagccgcatttaagtgggtcatcatcggcttgcatgtgtcctgcattatccatgctggtcttcgtgggcgtgctcctctactctttgccgaactattgtgtcagttgacaggattgtaaatgcctacaaatgtgtagacaaacaggcaaggcttcattttccacgagtcatccagggaatgagagaatcctgccgtctgtagacgaacatccagttgtgatttgtgtctgagaacagaccccagtagccacggttacgccatgtcaccgagcccattgattccagaagggtcttaggtcctggaaaagtcaggcgaacaagcaaggttgcatcatggttatctcttaagtatgaaagcgttatttgtaaaggttagatcactgttgtgcagatgtcttcacgggggggtcccttgagaatgctcctttgaatggggtgggtcggaccttagcttgggatgttaatgaatgcacagtttggtcggggggaataattttgaacggagaacgggttagacggggaaagacaaattctgtgcgagggttattgtggggaaaatcgtcgaaagagtgttaaaaagggggattaggcacgagtgtggatgagggggtggtgtgagg

SEQ ID NO: 582452 - DNA, 316 bp, Homo sapiens
ccactctatctggtaccaactgtagtgcattagtccgttctcacactgggtagcaaagactaatccaagactggacaagtttacacaaataaagaggtttaatttgcagttacacttcgacgtgggtggggaaggtcacacaatcatggcagagggcaaacggcacttctcatatggcagcaggaagagagacatgaggtagaagcagcggtggaaacccctcataaacccatcagatctcgtgaaacttatgcactatcacaagaatagcatgggaaaggctgggctccatgattcaattacctcccccgtgtca

SEQ ID NO: 582453 - DNA, 207 bp, Homo sapiens
atcccgggcagaggagacaggcaagagctccctgctgcttgaacagtcacaattgcatcccttcctcccgtactgaagctacgcaggggttggactaatgtgccatcatgctggtacccatctcacccatcctccgtcactggaaggaagacaagtggcttcaaactcaccagccctgtggaggacttctcgtgtgactagggagag

SEQ ID NO: 582454 - DNA, 157 bp, Homo sapiens
  misc_feature (63)..(63): n is a, c, g, or t
actgcggtcgacctctacgacggactcccccaacgacacgacacctctgtgggacgctacggntgacgctggacgactataacaccttgtggacactcactcgggcactactactgtagtgtacttccgcgtgggacggacacttactacggtacga

SEQ ID NO: 582455 - DNA, 190 bp, Homo sapiens
tgtgtagcgctctagaggagctctcatggggctggccgggcgatgacaaaattctcagcattgtgcttgtcagcgaaatatttatatctctttcccttatgaagcttacttgggctggatacgaaatactaggttgaaaattcttttcgttgaagaatgtagaatatgggccccacagtcttcgcctgag

SEQ ID NO: 582456 - DNA, 804 bp, Homo sapiens
aaaacgtaggctaggtacgaggctggggttgcagtggtgcgcggagaggagaggcctccgggagtgtctctggcagatgagcgttcttagctgatctcgaagaggcagcagaagaggaggaaggaggaagctatggggaggaagaagaggagccatgcgatcgaggatgtgcaggaggagacagcagtggatctttccggggattcagtcaagagccatcgccaagctatgggatagtaagatgtttgctgagattatgatgaagattgaggagtatatcagcagagcaagccaaagcttcagaagtgatgggaccagtggaggccgcggcctgaataccgcggtcatcgtgtgatgccaacgaagccgtgaccgtggagatcgaagaacgagctgaacatcatccataacggttcatccgggataagtactcaacacgagattgccctgaactggatgtcgccttggtcgcccaatgctaactgtgattacatccgcacggtcaaggaagctgggcaacttagccgtggacacgtgcaatgaacaatgagaacctgctagcagatcctcacctaatgccaccatcatggtcgtcagcgtcaccgactcaacacacacccctagggggcagcagctgtcggaggaggagcgtggagcggctgcaggaggcctgcgacatggcgctggtagctgaacggcctccaagcaccgcatctacgagtatgtggagtcccggatgtccttcatcgcacccaagctgtccatcatcatcggggcatccacgcgcgcaagatcatgggtgtg

SEQ ID NO: 582457 - DNA, 585 bp, Homo sapiens
  misc_feature (147)..(147): n is a, c, g, or t
gccacagtctccagcctgaagcggaagtggaggaaagatggaggaccatcagcacgtgcccagtcgacatccagaccagcaagctgctcgattggctggtggacagaaggcactgcagcctgaaatggcaggaaggtcctgggatgncctgaccgaatcccgcggaagaaacaatatgctgctcgactccaaggaaatgcatgcgtggtctcatcatatcatgctaatctgactctcaaggccagctccagatattggctctctcaagatagatggaattctctgtataaaggacaacacctacttagtggaactctctagcctcctggttcgaatgtcactataatcccctcactgaagaacaattgcagtgcagcagctgcagcaagaatcagcgcaaggaggagagtgcagcagggctgcgaatgcgggagcagtttaccatcctgcaacagtatggcatcagggcgaaaatgtcgaggagactgtggccggtgaggacctgcgagtcatggtgaattggggcaggtcaatccctgggggaagccttgagtgtccaggcgttgggggtggtgtgaagcccag

SEQ ID NO: 582458 - DNA, 1426 bp, Homo sapiens
tcggtacgcagcttaagttgaacgtactcgatgagtctgttgagaaggattcagaatggaccgttgtggagtaaaggtatgtgcatcatgccctacttactctaagaacaggctttctgtgcttgttgtgcgatgtagcttgctgaccacatgtatctatgaatgtacatacaactactatggggttcattgggaagcgcagagagtggattcgacgtgtgcacgaaactcttgctgtagagcaggacgtcccgtgagactacattatcccgtctttacttgactagacacgctgatcacactattcactatcaagagtgaaaaccaataagtcacctgggatctattatccggggatgaccagcttagggatatttctccgcaaacgacgaatggacatatcgtcatgcatttctctcgaaactaccatatgggcttagttagcaactctgtgctctgatcctatagcacgcaataaaaaagacgcttttccctcttgcgctaataacttctgcataatgtgtcgaggatccctatggtttcaatttccgccatgagccccccttggcacggccaagccattgcataccacttcgagtgcgtttagttcgtattctcataaaggaactccggacgctctgtaccatagcgcagagcgttgctcgcagagcagtacagtgtggtacaggtctacgtgggcattccggactcacctatatgtgtggttcaaaaacgaatattccgtctaggttggttaaacttacacattttcatagtttccttaccttccgctacaattgtaaagtatatcgaaggaaattcccccccattcctctggaagttgaaaacagagataatagggaagcattgagttttgattccaacaggtaaaatgagctccaagaaaacttgtggttggtgtgcgaatttctccgcgatacccggaatatctacaacttatatatgagatgagcgccttcagtaaaaattaaaccgctatatggtgggtgcaatatatagggcgccccttcacaattttctccgcagaccaattattatggcgcgttaagaaaagttcggcgcgcatacaacccgttgtgtgaaaggggggcgattccacaagggagatcagtatccaccaatgtgaaggagtatctcagggtggaaaataaacattgtaaggtgaaaataatcattaataagcccaggtttcggccgcaatggttcctggaatcatctaccacagcttttttacacccgttatttggtttcacaccacaggagaacattagcacacattgatcccattgacataaaaacactatgtaagcaccacaccatataaaaaaagtgagatgaacacacaacaacatctacgaggcacctatcaatccctagtcgaacgcgacattaacaaacccaatga

SEQ ID NO: 582459 - DNA, 604 bp, Homo sapiens
gtgtcagagctcatcacccaggctgtgggccgcctctaaaaagggtagcggagtttctctggctggtctgaaaaaagcgttggctgccgccggatatgatgtggagaaaacacacagccgtatcaaacttggtctcaagagcctggtgagcaagggcactttggtgcaaacgaaaggcaccggtgtttttggctcctttaaactcaacaagaaggcagcctccggggaagccaagcccaaggttaaaaagggggggggaaccaaacttaagaagccagttggggcagccaaaaagcccaaaaaggcggctgggggcgcaattctgaagaagagcgctaagaaacccccgaaaaaaggaaagaaagccggcccggggcccctgtaaccaaaaaagtggttaagagcccaaaaaaggccaaggttgggaagcccaagaaagctgccaaaagtgttgctaaggctgtgaagcccaaggccgttaagcccaaggttgtcaagcctaaaaagggggggcccaaaaaaaaaaaggggaacgcctacttttaaaacccaaaaggtttttttcagagccccccctgttttcaataaaagagctggataatta

SEQ ID NO: 582460 - DNA, 284 bp, Homo sapiens
gaccacatctctgcaagaaatacaaagattggccagacctggtggtaaatattgtagtttcagctactcgggaggctgaggtgggaagatcgcttgagccctggaggttgaggctgcagtgagccgagatcgcaccactgcacttcagcctgggctacagagagagatcttgtctcaaaacaaaacaaaacagaaaatgaaaataagcactaaatgaacctgttaataagggtcaatgcatgctttcaaattaatgatcttttgagcttctaaggaagggcaag

SEQ ID NO: 582461 - DNA, 1238 bp, Homo sapiens
catcgtggatgtagtagttttgtttgtgactctcgtgcgtcgatgtcgtcagtcgcccgtgtctgacacgaccttgctgttctccgttttgctccttgttggagaacgtgtatatttcttctccccctgtagagagatgtactcccccccttctctctagaggaggagggaggaaaaatgggtgtgtagccctccccctctttctccgtgacgtgcctcctcatctaggtggccccccaggggtagactctccccgcgctgggggggaacacccccccagtgcgttgcgtgggacacacaaagtctctaagcctttaaacccagagaaagggtaatttcccaccgagcgatggtttcgcccccatctcttcctgcccttattccacccaaaaaattgtgcctgtgttcaaagttgtttcaaaccttttaaaaaatattcctttggagtaaaaggttaattgtcctagattttaatatgttgttctcaccctagacaggttatccccaaatttaacaatggtaagaacgcttctgaggaccccacaaactttttgtgcccactcttttaccccccgtcacaaactgctttaccacgaaatggaatcaatgtccccccctaatgttgagggtgaccaccttaaattggctttcctggcctcccctctggaaaggaagaaagagaaagaaagatctcgtgtttttgccccctcgagtttaagccacacgtgaaaactcattctccacttaccccttttttcttgggtgttgagaactgctcgtcttctaagaaagtcccactctcacacttgtgctcttgtaataacgctcacagtgctggagagaaattcttgaaatagcttaatggacccacaaaccttttaaaattttaataattattttgaaaactttgctttgggtttgtggcacccctggccacaccccactctggctgtgacacgcctctgcacgtccgctgggctggcacgctttgttgatcttttaagtttccttccctatcccacgtccccactttttctggtaagggttttctacggaaggttctcgttaaggtgtaacactcctcgcacggcttaattggcttaaaaatgtaactcctccttttaatgtggttcttctttggggccgaattgggaggaaagagaaatcaatagtgccactgttttgatactgaatattgacaagtgtctttttgccacctaaagaacccgtccctccca

SEQ ID NO: 582462 - DNA, 136 bp, Homo sapiens
actggcgcagtcattctcattaatctgcccactgacttacatcctcattactattctgcctacatactctaaactacaacgcactcacagtcgcatcataatcctctctcaatgacttcaaactctactcccacgt

SEQ ID NO: 582463 - DNA, 158 bp, Homo sapiens
  misc_feature (17)..(17): n is a, c, g, or t
cgtagtgctttccaggncagcgtgtcacagtgcagattgacgccggacggggtagcgtgaggcaggacaggtcagttgtgacggaggttgctttctcctgggtcacatctattgtgccccatatggcgctgaggctcgcccgtcaggctgccatactg

SEQ ID NO: 582464 - DNA, 474 bp, Homo sapiens
agggtagatgacagtagatcagggactctgaacagtctggggagactgatggagaaggagtcaaggacggccaggaggaagatggatcctattaagctgatattagaaagcaggaggaagtgagtgagggtgtagggatgggaatgagagatgaggaagataagagaaagaagagtaaagatacttttttaaacctagtatactctatgtatgcctatggagacttggcaatcatattaacaaagaagaccaagcaaggggtcctcagttacctatgtggagattgacaaaggtgctgtcccaggagacaaataatgctctgtaggatgctggtcaggtgacgtctcgtggagctacaaaggtgctctacgatacgtctgctgcattcagtcgaattccattggattagatggtgtagatacaggcaagagccaaggatgaacttaagacagcatatagcccagtttgctcaga

SEQ ID NO: 582465 - DNA, 488 bp, Homo sapiens
  misc_feature (278)..(278): n is a, c, g, or t
  misc_feature (348)..(348): n is a, c, g, or t
  misc_feature (366)..(366): n is a, c, g, or t
  misc_feature (409)..(409): n is a, c, g, or t
  misc_feature (434)..(434): n is a, c, g, or t
atcttatttaaaaactattgttagaaaatgctaatgatcatttgagctttcagtaagttgtaatctttttggtggtagagggtctcgccttgatgttgatggctgctgactgaatcagggtgatggttgctgaaggttgaggtggctgtggctattaaaataaggcaacaatgaagtttgccacattgactcttcctttcaccaaagattcctctgtagcatgtgacactgtttgatagcatattccccaccacagatcttctttcagaactggggtnggaacctgggcactgcagtaatggttctaaaccctttgttgtcatttcaacaatgtggcacagcatcttncaccagaagttggatttncatgctcaaggaaaccacttttctttggcttcagccgtaaganggcaattcccccgtttcaagttttnttctgaggttgcagtcaattcagtcacatctttcacaattccactgtaatttta

SEQ ID NO: 582466 - DNA, 1030 bp, Homo sapiens
ccatggggaagccgggcgtggaggcagcaccgggctcggagctggccaggttccctagcctatggagcacgcagaccaccacagtgccccaggcctgggacctccctctcggacgggtgagagaatgattgtgctacgagccaaggcactggcatgcctggagctcctggtggcacctcgtagtgtgggccaatctagcttggaagcagaggtcgccaccgagatctagcgctcaataatggaggcagcagcgtgcagatctccactgagctggttcgcacattcacgatcactagacaccacgcaccgtacatgagcagcactgcaggcctgataatcgttcgcatgctgcaagcacgtgcagatctcttctgcgcctgtgaatgagccgtggttacgtggtcgctggagctgcgatggcagatgtgcgaccatgcccgggctgtgcagatccccaggtgagacgtctggaacccctagtgcaattcccgagcgtcaggctgcccatgagctcatacactaagtgcccagtgtgcctggacgacgtctgatgacctacgagatgtccacggtgtcagcccaggaacaccatgatccccgagaatgagcagcacagggctggggagctggcggtgagtgttgctatgccacctagactcaggggagtagggcagctaccagagaccccaagagcctagggatctcatccagccagccctgtgtgccccgcaagctgccacggggaagtgaagtgggcgctggagcatcaggaggcccggcagcaggcactaggtgacgcgtgtggcaacctgggccggcagctgcagtgcagccagagaggagcccaggccagccgggcatcgactgtccccacaggctgtcggtgctgtgccgctgccaaggcacgggtccgccaggcctgaggctgcagtgcccgggtgcagctgcagctcaagcaactggcacgctgactccgttcctcacgcctgccccctgcgccggccggccctggcgccgccctcgctgcggc

SEQ ID NO: 582467 - DNA, 94 bp, Homo sapiens
agcgggctggctgcggcgtctgggctgcggcgtctgggcgcgcgcgggggtctccgggccggaccctcccctcccggccaagcaaaggacgagg

SEQ ID NO: 582468 - DNA, 109 bp, Homo sapiens
  misc_feature (57)..(57): n is a, c, g, or t
gtccaggactgctgagacaacatagcaaaaccctgtctctacaaaaaaatgttttanaaaattagtagggcctgatgtcctgtgctagctacttgggaggctgaggcag

SEQ ID NO: 582469 - DNA, 250 bp, Homo sapiens
ggcagtggtgggactcagggctaacttcaggctgatgagtgtgtggggtatggggcaggctgtaggtattactggaaaaggcaacattcgattggttaaggcgttattcagaaagaacaattgggaaagggtgggcaaacaggaacagaagttcccactctgcgtggtgggtttcatccaggaccagcaatctggtcttttagccttcaggctgatctttgcttgaacgtggggtttcatttgggaccct

SEQ ID NO: 582470 - DNA, 164 bp, Homo sapiens
gttgggacatgttttgaaatgctagagggggaacatattttgacgggaaccggttttgcaaaagagttggtggattcaaagtgggattggaccttcttgtggaatttgaatttccgcacactacaacgactggagttcttctggggatcaatagtcaaaaaatg

SEQ ID NO: 582471 - DNA, 580 bp, Homo sapiens
  misc_feature (33)..(33): n is a, c, g, or t
  misc_feature (35)..(36): n is a, c, g, or t
  misc_feature (40)..(40): n is a, c, g, or t
  misc_feature (107)..(107): n is a, c, g, or t
  misc_feature (115)..(115): n is a, c, g, or t
  misc_feature (134)..(134): n is a, c, g, or t
  misc_feature (139)..(139): n is a, c, g, or t
  misc_feature (141)..(141): n is a, c, g, or t
  misc_feature (143)..(148): n is a, c, g, or t
  misc_feature (150)..(152): n is a, c, g, or t
  misc_feature (156)..(157): n is a, c, g, or t
  misc_feature (160)..(162): n is a, c, g, or t
  misc_feature (164)..(164): n is a, c, g, or t
  misc_feature (166)..(166): n is a, c, g, or t
  misc_feature (169)..(169): n is a, c, g, or t
  misc_feature (179)..(179): n is a, c, g, or t
  misc_feature (182)..(182): n is a, c, g, or t
  misc_feature (187)..(187): n is a, c, g, or t
  misc_feature (193)..(193): n is a, c, g, or t
  misc_feature (195)..(195): n is a, c, g, or t
  misc_feature (202)..(203): n is a, c, g, or t
  misc_feature (205)..(206): n is a, c, g, or t
  misc_feature (210)..(212): n is a, c, g, or t
  misc_feature (214)..(215): n is a, c, g, or t
  misc_feature (219)..(219): n is a, c, g, or t
  misc_feature (221)..(225): n is a, c, g, or t
  misc_feature (228)..(228): n is a, c, g, or t
  misc_feature (230)..(230): n is a, c, g, or t
  misc_feature (234)..(234): n is a, c, g, or t
  misc_feature (236)..(240): n is a, c, g, or t
  misc_feature (244)..(244): n is a, c, g, or t
  misc_feature (247)..(249): n is a, c, g, or t
  misc_feature (256)..(257): n is a, c, g, or t
  misc_feature (263)..(263): n is a, c, g, or t
  misc_feature (266)..(266): n is a, c, g, or t
  misc_feature (269)..(269): n is a, c, g, or t
  misc_feature (272)..(277): n is a, c, g, or t
  misc_feature (279)..(279): n is a, c, g, or t
  misc_feature (284)..(284): n is a, c, g, or t
  misc_feature (286)..(287): n is a, c, g, or t
  misc_feature (290)..(290): n is a, c, g, or t
  misc_feature (293)..(293): n is a, c, g, or t
  misc_feature (295)..(295): n is a, c, g, or t
  misc_feature (301)..(305): n is a, c, g, or t
  misc_feature (307)..(307): n is a, c, g, or t
  misc_feature (310)..(310): n is a, c, g, or t
  misc_feature (312)..(312): n is a, c, g, or t
  misc_feature (314)..(314): n is a, c, g, or t
  misc_feature (317)..(317): n is a, c, g, or t
  misc_feature (320)..(320): n is a, c, g, or t
  misc_feature (322)..(323): n is a, c, g, or t
  misc_feature (326)..(326): n is a, c, g, or t
  misc_feature (328)..(329): n is a, c, g, or t
  misc_feature (331)..(332): n is a, c, g, or t
  misc_feature (336)..(337): n is a, c, g, or t
  misc_feature (341)..(341): n is a, c, g, or t
  misc_feature (345)..(351): n is a, c, g, or t
  misc_feature (354)..(354): n is a, c, g, or t
  misc_feature (356)..(359): n is a, c, g, or t
  misc_feature (366)..(367): n is a, c, g, or t
  misc_feature (380)..(381): n is a, c, g, or t
  misc_feature (383)..(388): n is a, c, g, or t
  misc_feature (405)..(405): n is a, c, g, or t
  misc_feature (417)..(417): n is a, c, g, or t
  misc_feature (425)..(425): n is a, c, g, or t
  misc_feature (429)..(430): n is a, c, g, or t
  misc_feature (439)..(439): n is a, c, g, or t
  misc_feature (444)..(444): n is a, c, g, or t
  misc_feature (453)..(455): n is a, c, g, or t
  misc_feature (457)..(462): n is a, c, g, or t
  misc_feature (465)..(466): n is a, c, g, or t
  misc_feature (476)..(477): n is a, c, g, or t
  misc_feature (488)..(489): n is a, c, g, or t
  misc_feature (496)..(497): n is a, c, g, or t
  misc_feature (533)..(533): n is a, c, g, or t
cacagaaggatgtaattatcaagtaagatgcanannacantttgttattggagaaacatgcagattatatcgcatcctatggctcaaagaaagatgattatgaatantgtatgtntgagtatttgagaatgagnggcananannnnnngnnnaaannaannnancncancccaaaaagnaanacaancaatananaacacanncnnccannnannaacncnnnnnaanancaancnnnnncaanaannnagacgannccaaancanaanaannnnnnanaaaanannacncancnaaacannnnnanccncnancanacnannaancnnanngacnnaaanaaannnnnnnaanannnnaaaccgnnaaacaaacaacanncnnnnnntgctggagatatttggngagaaattgcanacaagcantctnnttttgctgngcgcngcgcaaaannngnnnnnngcnngccccaacanngcaggcagagnnaaggcgnncaaaagcgcaaagagcaagagggcgggggagaaagncgaggcaaagggggcaaaccggcccagggggccgggcaaacaaaaac

SEQ ID NO: 582472 - DNA, 155 bp, Homo sapiens
ccgatctttattacgccaaactcaactcagaagtataactcaaccacaaattgacgggctggatccggatggataaggatgggggctgtggtgaaccaatgtttcatgttccacaaatggctctgtcgacctgtggagaccatgtgaactggtac

SEQ ID NO: 582473 - DNA, 379 bp, Homo sapiens
  misc_feature (69)..(69): n is a, c, g, or t
ggcccctttaaaccagggttgggccaaaaaaccgggggggcccgggcgggaatttcccgggtttttttnacccccggggccggttcctttttggggggccccccccaaaaaatgggggggggggggggggttggtttgggggttttttacccccgggtccccccccccggcccccgggggggtttgggttttccccccggggcccttttgggggatccaaacctttttttgggtttgggggccccttcctttccggggccccttagcccaggggggggtggggccccccccccccctggggggccccccttcccccgggggtttctttttccccccccccttttcccggggccttttttttgggccctttccggtttta

SEQ ID NO: 582474 - DNA, 1277 bp, Homo sapiens
  misc_feature (728)..(728): n is a, c, g, or t
  misc_feature (749)..(749): n is a, c, g, or t
  misc_feature (1258)..(1258): n is a, c, g, or t
  misc_feature (1277)..(1277): n is a, c, g, or t
tcttacagcctttgatttgagcccccatttcagtctgctttatactactgtcttgcatgttttcccatgataaataagatggtttttgggaaactgaactttggacttacttgattctcttataacaccaggaaattggccaattctagttgagttatggaaatatgttgtctgctgcataccaggcaagttcaagaataccagcaactcctgctacttagggtaatggtacaagtaggattaagtggatatagttgctatctatctgtagaagacaatgagtgagtgctgtcttaagtttggaaagtagttgattctctgcagaggggtataaactactgatgaaaggagagtgactcattactcctagagattctgaatgggaagaatgccagctttatgttttctgatactgatttttttttaataacttggtgcaaaagtagaacattattctaagatgactgtgtggaagaaaaaaaaggtagaacattagagttgtaaaaatgtttttaactataaagaggaaaaaactgaacttatttataattcatttacctagagagaacattcaacatttggtcaatgtattttttttctttatatctatgtagatatatatttcttcatttatttaacaaatgctactgacaccctatggttgctggaagtgagctgtgtaggaataaccatgagcctctgctctgatgtaattttagtgtatgtgnattgttgacatataattttanatttgcttttttcacttaatgtatcatggaattttttcatatcattaaatattctcttggtgtggcacaatagtatttcagcatgtagatatttgtaatttattgaatgaatccttttgttgcatattttcaatttgtctgtaattatatagcaatgcaggcaatagtccgtgtagcaggtggaattctaagatgaactccagtgacacttaccttgtataattccctctcctgtgaacatgatgggatattacttccctgattatgttatgttctgccggggacttggggacttaattaggctggctatcatggctctgattatcaagggccaatcctcggtgactaacttatagtgtggctttgacggggggttttcgctgtggaggaaggcccgactccgggtgggacccggagaggtttcgcgtgggagtccgacaggcggggtctatctgtgctgcggccaaggtgttcgggtgtgttgggtgtccccccacgttttccccgcngtacgcgctatctgtctgn

SEQ ID NO: 582475 - DNA, 135 bp, Homo sapiens
gctgacttagaggatccggcacgaggctgcggctgggctctgggctggagtatggtctagagctgggtgcgattggctcatgagtcagccccgcatgggatcgttgctgtcaagaaatcgcggaaacagatagtg

SEQ ID NO: 582476 - DNA, 245 bp, Homo sapiens
gtgaactctaattatagtaaaatatgatatcaccattatcagactgtgacatcatcaaacaacaaatcaagctgcgctaaacagcagaattagtacggtatcaaaacttaccactgtgtcctccacctacatcaaatacatccacaccactcccagtctctctggaaccttgacaaccacttatcctttactggaccacaaacatatgtttgtaagtatctattttttttatttatttttttttt

SEQ ID NO: 582477 - DNA, 2000 bp, Homo sapiens
ggcgcgggggccgcggctggtgctgggagccagcgcctgtcctcgccgccgtcctcgctgcctgtcactccgtcttggcccgttctccggaccgtgcagaggcgggggctgtggagtgggacgcggtgcctgtactgattggttcccagatcgatgggaatgcccctagacgcagctcggaggtggtcgtggtcatacggagcggctgagaaaatgactgcatcctgttgccagcagtaacccagctatttatcctattcgtaaaattaacttgttaacatgttggggggggtctcaaaattgttaccctggactggtctcgaactcccggacttaagctgatccatctggggtccaagccccattaagcgagtcatcaggggttacgtatactagaaatgatcaactaccttttttctctatatctgcatggcaatatgagatgtgggctttcagcttccgtcatgaattgtgaggccttcccagtgcacgtgggaactgttaagttccaagtaaagcctcttttgtacattatgagaaacaaatcactatttacggatactaggatgggtcgtgactgttgaagggaaggactttacactattcctaacatttgacctacatattttctccaaagccaagatgattccattcccgaggtacacatactgggtattcaataagaacccaggacgggactgtttcaatgcgtgcacaaggtgtaaccgaggtcgcaagagcttgtcctcctgcgcgtaaatctgagaactctcttaaaatctgatgccagacacgaaatgtcatgattccccagacagtagctcgttatcagtaaccacatgtctttcgttgtcacaagactcacaatgacggggtggtaggtgcctacacccactcacagcccggatgttacaacaccctgacaccagcatccacaactcctatcattgttctcactcgcctctttccacatgcattccacacataatcattacacttcccacgtaacacgacaatcacagaaacatcatcataaacaaactatccacagcagaacaccatacctcgcacaacccacacataccaacactacccaccgttaagccaacaccactaccaacacaacatccacgagcaaccacacgacacagaccatccacgctgccaaacacacctatcagcggcacagccccgaagagcagacacgagacagcagccagagcatcgagaaacagaagcgacagacaagacacaggagagaagaaagcaacaaaaggagaaggaacgagagcagcgcgcacagagcagcaccaagcgcagacagcaacgcagaaagagccgagccagcacgagcaagagacgttgagtagcgtaatctaagcgcacggacacaacagaacgataaagcgaccaaacacagcaccatagcagcgacataccgaagagcacaacagcagagcacacagacaaaccacacgaaggagagccagcgaaaacgagaacgacgaagcgagacacacgacctaggcagagacgacaccgcggactaaagacccacgccgagcaaccgaccacgccagcgcagacagagcgacgacgacacgacaggacccaacgcacggccagacgagctacagcccacacccaccaccgcacctacgaggcgcacacgacgcagcgcaatgcaacacagagagcagtagaggatgacgagaaggaacgcgcgcgaacaagaagtcagacgaagagaacagagagtgaaaaggagcgcaaacagatagagagcaacacactcctagcagaagagtcgcgatgccacacagctcgagcgcagtcgacgcgtaagagcagagggacagtgaccaagacacacagaaaggcggcgacagaaggtacagaagaagccgagagggaccaagacagcgagaacacagcagaggaccgccgagaagcaagagatgcgccagacgcagccaagcagagcacatcccggaccaccc

SEQ ID NO: 582478 - DNA, 1324 bp, Homo sapiens
  misc_feature (191)..(191): n is a, c, g, or t
  misc_feature (682)..(682): n is a, c, g, or t
  misc_feature (701)..(701): n is a, c, g, or t
gggggtagatacccacatccgtcgtgaggagtcgaccatatttcttctctttgtgtccaacattttcttgttgtttcagcgcgcccgccttggttaatgttgtccccctaggtatttagttcccaattttgttctctgtttgttgtttaataggtcgcctactcgagcctcgttgtgaaatatataatctncttgttgtgggcgaagaaatctcgtctcttcgtttttacacccctagattatttcctagtctctttcgtgtaaataatgcgtaatatatttgctgaaagtttcacaacaacgggggttgtatattatgcccacggcttttgttgcaacatttaccacggttgaaattgtgttgccgcgtatccacatcttcttcgctcatcctcccctccacaaaatgggggaagaatttaattttattggttcgccctaagaatatgctgcttgtgtaccgtatagattctcacaacgtgttccctagaagagattgttataaaatagtttggagaggttggttccagagaaaaacacacgttgggtttaattttttatatctgttggtgtgttgggccccgtcgtgtagttagatgtgtggtgtaattgtaacacaattttgaatgttgccacattccggggggaaggttgtttaaaaaccttgttccccacacttgtncccaactgggcttatgttncgcgaatgtttgtttgggggcgttcccacactgcccacagaatcctttgtgaaagataaaaaccacagctcacggtgacatgcacattttgtcacattatatgaggccacacagagtctacatcactttgttttcctgcacacacttgagagaaattctattatgttgcactccactctggcttctctaagagaagttctgccacaatttctttatactgtgtgtcctctgtggtggccactctatttaattctatgaggtggccactccacactcggaatataattgtggagagtgagactacgaagaaagtcaataagatcacctcgtaaagggaccacgttaaggggaaccacctcttaagagaggtttaattaatttttaaaacaaactcttttcttgaaactccctggccacaacacatggtgaaaaccccgtgctctatctctaaaatatcccaaattatagccacggcgtgatggtgggtgcctgtaatttcacgctaacttgggaggctgaagccacggagaactgcctgaaaccccggaggcacagaaggttggcacgtgagttcgagatcgtgctactactgcctgggtggcaagggtgagactccatttcca

SEQ ID NO: 582479 - DNA, 299 bp, Homo sapiens
  misc_feature (79)..(79): n is a, c, g, or t
  misc_feature (299)..(299): n is a, c, g, or t
gggatgcgcagctctctatcgcccatgatgcgcgcaaagccaggattgcctcctcggtgggaaatatccagatgaccgnggggattggcagtggcacaaaacaaggtgtcggcggaggtgatgatcgccttttcggcagcaccaagtacagtaccaacaacaggcacaccggtctccgaggcgtccatgccatcctgatccgcaggcaatctgaccttgcgtcgctggatgtatttgggacacaaaggaaaagactctcgcacagcgatcacgatctcgggagcatcgatcttgacgan

SEQ ID NO: 582480 - DNA, 98 bp, Homo sapiens
cctggaaaatagaactcacccacgatatcatcaccaagttcctggaaaatgaagacagaaggtctgccagcttacatttacccaaactgtccattact

SEQ ID NO: 582481 - DNA, 380 bp, Homo sapiens
  misc_feature (203)..(203): n is a, c, g, or t
  misc_feature (212)..(212): n is a, c, g, or t
  misc_feature (266)..(266): n is a, c, g, or t
  misc_feature (285)..(285): n is a, c, g, or t
  misc_feature (314)..(314): n is a, c, g, or t
  misc_feature (342)..(342): n is a, c, g, or t
  misc_feature (359)..(359): n is a, c, g, or t
ggtcgaggtgggcagatcacctgaggttaggagttcaagaccagcctggccaacatggtgaaacccatctctactaaaaatacaaaaaattaggtgtagtggcaggcacctgtaatcccagctactcgggaggctgaggcaggagaatcgcttgaacctagaaggtggaggttgcagtgagcggagattgtaccatggcactncagcctggncaacaagagcgaaattctgtcttaaaaaaacaaaagtcccaattaagaaccttncgaactttgtttttgaggncaaagggggagttagttctttggtaggtncaggattagtagtgtcctttgggattantggttcatctttcttgnacatcacagtaggaaaccaaa

SEQ ID NO: 582482 - DNA, 239 bp, Homo sapiens
ctactactaaattcgcggccgctgttgactttttttgtatatttagtagagacggggtttcgccatattagccaggatggtctcgatctcctgacctcgtgatccccctgcctcggcctcccaaagtgctgggactataggcgtgagccaccacacgtggccacaacttttttttttaatggcctaatctgtttctcagcgtcgacgcggccgcgaatttagtagtagtaggcggccgc

SEQ ID NO: 582483 - DNA, 935 bp, Homo sapiens
  misc_feature (1)..(1): n is a, c, g, or t
  misc_feature (66)..(66): n is a, c, g, or t
  misc_feature (69)..(69): n is a, c, g, or t
  misc_feature (522)..(522): n is a, c, g, or t
  misc_feature (527)..(527): n is a, c, g, or t
  misc_feature (542)..(542): n is a, c, g, or t
  misc_feature (845)..(845): n is a, c, g, or t
  misc_feature (902)..(902): n is a, c, g, or t
  misc_feature (927)..(927): n is a, c, g, or t
ntccggccggagagctccaccgctgaggccgacgaggccgaattctttatttcatgtgtgtgtcancantattgaaatggggggggtgatacgtgcaattcttttatagattcaaaagtgaggggtggtgtgaatgtgacaaatcataacatgagccaaatttataagaaagtgctttaaaaatcagacaaaagacttaagaattactatggtaaatttctaatcgggggggggaacaagaatacaggatattggcaatgctaatattcaaaatggggttaccccagttcataatccctctactcccctcctacctaaaatctaagaaagtattcattataaattggaagtacagaattcttaaaaagccaactggatgctgagttgtatgattttctttacagggacaatttacttttcagcgacctgtaagccatggaaagagtaactccatatccaacaaaaaaactcaaagctctatgtgggtggggaagggggggcaaatatgcaatggtggggganatccnggctccgacaaatantctgaagtgcaggatggcgtgaaagggggtcggaccactcaaggagtacagggggggcattccaagaaaggggtaatattttcaagggattcgggggggtctgggacacggctactcgggtttggggaagatgttctggggtttgtcttgggcatggtcacagtttggggtggggaaactttttggagtttaagggcgggcgagctatagcgtctgttgaagataatggggggggggggaaaccaggggcttctcagcatgcgggggggggaacttgttaatgtggggggagggggcggaaanagggggtgctcagcggggttggggctccgggcagtcccaactgtgaatactcggtgntaggggggaggggggggcgagaatntccggggt

SEQ ID NO: 582484 - DNA, 224 bp, Homo sapiens
taaaaaattatactttaatttggagtcaccaggagaaagattcactggtgaaggaaaagtgatcagaaaaagaaagaagccaaagagaaaggtaccgtgggttcaactaaagcgccagccgtgctccacccagagaagcacacttgggtgagaaccaagtgggaaggagcctgagcgtgcgtggaacctattccctagtgaattcagtggcataatagggtgtt

SEQ ID NO: 582485 - DNA, 797 bp, Homo sapiens
ttgccaattacaacttgttagcggcttgtacccatgaagtgacactagctcctgacattggtactctacctcatgagctggaggcatacactgtctacgagagtgaagtaatgtccccaattgtcaataggtggagggggcacacatggtccagtagaatctttgcaaggaggtggttccgtccagtctccattgatacacatcacgtcttcatccccaaacatttcataagggctcatacattgatgacgtactctctctccagatggatatttactcatgtgtctcgactgtatagcagcattgtgtagtgtgtgcgtattcacacagcaagtgtcagtggacgtgcattgaagtctgtatcgtgtgttgcaaataatctgcacagtatcaccttcgagatgtgttgtcctcaagattcagaatgaccattttccacaaaaggaaagaaacacagtctggacactgtggtgttggtgaccgtcgttatcatgcgcatgttatgagagtccagaaatgatgtgtgatagcacacacgagacttatattcacaggagtcatatacaacttcctctgtaggaccgtggtggaatataatatattcttgttcatcatatagagttcgctccataaaacagaaagtcccagagtgctgcgtctccccctgcagaggaatccgtcaattataatgacaatgagcagaggctacacgattagtagtaccattagttatagcagtcataggccttcagtggtggcggtgatgcagtgaatctgccttcatgagcagttaatag

SEQ ID NO: 582486 - DNA, 173 bp, Homo sapiens
  misc_feature (107)..(107): n is a, c, g, or t
atgtgggagaccagagaaaatctcctatcccagtcactatgcttaccagcaagttcctcagagacaggaagcaggcggaagcgttccttaccaaccaggagtatgtnctgggctcacattgaattgcctaccaccttggaagggcggcggtaggtaaagggcggcggataggt

SEQ ID NO: 582487 - DNA, 136 bp, Homo sapiens
cggtgttcccttgtctccaattgaacacctcactgactttaggcattaccacgccacacaggccaccttttatttttattttttttaagattctgcttttggccaggcatggtggctcacgcctgtaatcccagca

SEQ ID NO: 582488 - DNA, 639 bp, Homo sapiens
aagacccgggaattgcgagttcgcccattgggtaaaatatcccctagactgccctaaagttcagcaaatataacccacttcaaagtacttggaatttcaggcaccattcagactgccaaactgtcgtatatttcgatttcggacttctacagtaatatcccaacttcagatacgatcatctaatgggcaacccttaccattgccctcgatagttaatcacatcttaattcatgtgtcatctaatgaccccattctttgcgtccttctttccatattaatcttaatccgactcctcaggatttatttggtctttccaaacgttgctatattacatttgctgatcatccctaccgaaacgcaggtttctatttcaataactctcttatagccttctttaaataagccttggtttgttccattgttcatttccaactttctcaagttaaatctttaacgcatcatgtttcaggatttttaaggcctaacttaggcaattataccctttcatctgcagctctaaaaagttaacgtttttcgataccacgcaggttttcatatgcaatgctttaattacccatttagcactgtggatttaacaatcctgacactctgggccacatggttaaatcaagtctctcc

SEQ ID NO: 582489 - DNA, 119 bp, Homo sapiens
catcagcgatgatccggaatcccgttcgtaacttaaagggaaatttcacaactgtccggagcccttgatgtcctgcaaaatgaaggaggaggatgtccttaagttccttgcagcaggaa

SEQ ID NO: 582490 - DNA, 837 bp, Homo sapiens
gttgtgcaggtatttgggtttacagattcttcacttatgttttagaaacatgttggcctcttggatacttaatccttgtgctgataaagtcagattatggtaaattttaaatgggcctgtttgtggagttcatcaaatcatttaaacattataattatattctgtaatgaaaattattaaatttacataaaagatatcgagaaaaattctcttgcgtgttccaaagttagaaaatgagctgtgtggcaggcttagtttagtttcgtttacccaaacaatgtgtactgtttgaattcaaattttgtctcattactactcttagagtaagtgactgtggaagaaaaagaaggaaaccagcctggggcaacatagggagaccctgtctctacaaatagtaaaaaaattagtctgagtgtggtggcacgtacctgtagtcacaggctagttggaggctgaggtgagaagatcattgagctaaggtgttgagattagagtgagctatgagcatgcgatgaatcgggctaggtgacagaaatgaagaacctgtcttcgccaaatagaagaaaacaaaacaactaacccaacgggcgtgtggcgctagggattggcaagcccgaagcggggctcgtgagccttacggcacacattcaggggagacatcaggcaacacgaaaaggggccacatggcgaccctcggcgggcgaacataacacaagaggataccgggaaattaggggaccaggcgcaactcgcggcacaacctctactaacaagcttttcccctgaaggcatggacgaaacgcccggcggtcagagacaacggggcatacctcagta

SEQ ID NO: 582491 - DNA, 163 bp, Homo sapiens
  misc_feature (96)..(96): n is a, c, g, or t
  misc_feature (109)..(109): n is a, c, g, or t
aattcgcggccgcgtacggaccgagaagacgacagaagggaggaggtggcggtgccgcctggcctcgtgggatacgtgatggtgacagaagagaangtgtcgatggggnccagaccccttgcgggattccgggactgacgaccaagaggagggccgctgggcg

SEQ ID NO: 582492 - DNA, 283 bp, Homo sapiens
gtggtcgtctctagacggatccctacacatcaggctccggggcacgttgagctgggtttagaccgtcgttgagacaggttagtttaccctactgactatgtgttgttgccatggtcctcctgctccgtccgacgaggcaaccgcaggttcatacatttggtgtatgtgcttggctgaggagccaatggggcgaagctaccatctgatggtattatgactgaacgcctcttagttcagaatcccgcccaggcggaacgatacggcagcgccgcggagtcttcat

SEQ ID NO: 582493 - DNA, 198 bp, Homo sapiens
tcaaaccaaaaaggcataattaaacttataactatcctctctgacacatattcccacatcacaacacataagagattaagacatagtatctacctatccacactcacatccatacggcttatgacatagttctaccattccccacatcaccctataagacgtaaaacaacagatcatggaggatcctcatacgagtcg

SEQ ID NO: 582494 - DNA, 207 bp, Homo sapiens
tgtatacctagaggatcagttgggccaggaggtcgaggctgcagggagcactgatcatgccattgcactccaacctgggtgacagagtgagacaatgtctcaaaaaaaaaaaacgtcagtgaattgtaaaaaacacccctttcaaaattttttctgactagatcaatcatcatggaggaggtccagtattatctccaatcaatcccc

SEQ ID NO: 582495 - DNA, 164 bp, Homo sapiens
gcaggcccatgtatcactgcggacaagtccacacgaacaatacaagaaactagtacgcaaccatgggccgaacagctgtgggacgaaagcacagacaggcaactgggagagctggagatccattctctcaaggacaggattattcccaacatgccacacaggga

SEQ ID NO: 582496 - DNA, 1335 bp, Homo sapiens
ccttgttcccattttcgttcctcgtcttttttgcgctctgttttctgtctctcgtgtttattttgtctgttcttccctttcctttttcggttctttctcgcctccgctcttttttcggttgtttctttctggttttgtatggtgttctgttgttgctgtttgttttttgtctgtcgtttcctgtctctctcttttgtgttttttcccttttgttggcgtattttttcgatcgcgctgtgttggctttttttgcaccttttttgtgccctttctgcaccttcctgtggtctgggccactgtggctggactttatccctcctcccccatgtttggtgtttccccttggtcgcgggtccgtgtggacgctcttgttctgtggttcctgtctccctctaccacgtgttcgatctctcgtttgggtggggctcatgctctgggctcttcgtattcggtagacatagccaaggtggctcccggtcgatctccgcgtttgtgtgaggcccggtgtcgctttgtcacggtggtgccatttcctcttgtgaggggattgtcgccttggtgtttgtcctgtccatgtcttggtgatccctttggcaccccctccctctggatgactgtatcttgcttgtctatctccccgctgcccctttgttccccggaggtggtgggatccgttggttcggatccctcccttcctcgcactccgtgtgctcttcccctgcgttccttacttttcccccctttgacttatcccccccgttgggcgcctatgtttcatgtcccaaagtattgacttcctttgtgtatacgcaagtgcccatccccatagccgcctatgcgacaaggggggcactgcccatgtcccattctctgtgtggcccacgcactgggggtccatcgtggcttcggcacaaagtgagctcgatggcggttcaagggaggccataacagtgcacccgtcacccttgatgtgctcgtacccaactccaaagatcccctgcccaacgggtggcagccccaccaccatgagaatggccaagcatatcggaagtgagcaataactgccgcaagtctgcagcaccaggcgccaccagtcctgcagcctcctcctgatccacggacgtttccatcaggttcacatcacactgaaaatcgtctcaggttccacgtcacccctggggcattctcactgacccagtccccgtgccccgccgtccccgtaatcaggctactctccatcggcacaccacatcacagtcagggacatgagtgaatgcatcagtcagtcatcctgtcacaacagtgtaccaattaacgacctggggtgtgagacag

SEQ ID NO: 582497 - DNA, 196 bp, Homo sapiens
gctctagaggatccgttatagggtacccaaaaaaaaaaaaaaagaaaattcttcagaaattcagtttcaaatgccaggttgcttgtaatcccagcaattggggaggccaaggggggcagatcacctaaggccaggagtttgagaccagtttggccaattgggggaaacccggtttttaataaaaatataaaaaaat

SEQ ID NO: 582498 - DNA, 189 bp, Homo sapiens
gccccaggctttcttcagggtgcccgtgaaagtggctacattgccttctgtcagtagggcgggggcacccccagcagctgtgcccatcattaacatgatcttaccaactgtccctgcttggcctggacctggagctgggcctgggcgagctcgagcgggggaactcactcagccccggggcacagagca

SEQ ID NO: 582499 - DNA, 830 bp, Homo sapiens
  misc_feature (261)..(261): n is a, c, g, or t
gcgggctccgccaggacactggtggacagcacggggaggacatgggtgcggggaagggtgctctcacccaccgccctcctgccggcacgggtgtgcttcctgcgtcgcggtctcagaaggcctggccactttgcagttatagacgtgaacgagtgtgagctctactaggcaggaggggcgcccccggttctgcatgcacgcctgcgtgaacaccccgggctcttaccgttgcacctgccccggtggataccgatactctgngctgagcgtgtgaagtagctgtgaggatgtggatgaactgtgtgggcctgctaggccgcgtgtgccccccatgtggtgacctatcatggcgatctaactacctggtggaagcttccagtgtgtcagccctgagtgccccgagggcagcggctaatgtgagctacgtgaagacgtctccattccagtgtgagcggaatcccttgccccatggtacagcaggccctgccgtcatctgcccatagaccatctccttcgcagttacctcgtctctgccttccatcctgaagacgcccatcgacgctcttcctgcatggccactagcctctgtccccggccgagctgggccaacagcctgcgggttgggactcgtgggtgggaacagccgcggtcactttgtgcatgcaagcgttcaggacccggcagacctggggatcttgattccttgtgcagaacctggacggggcctcagtacgcttggatggtggacgtctcacagtgttcggagatacctggaccgctccttcgaggccgaccaccgtgtccagggttcaccatcctttgtattcccc

SEQ ID NO: 582500 - DNA, 215 bp, Homo sapiens
agaaggagaaagtgccaagatcctttcaggatatttggttttttggcgcgacacaatcgaggtgagggagagagaggaaatccctgaatcctgcagattatttattcaaaaggaaataaaaatactcatatgcaaagtctgtgagaaatgaggaaacacagacatgccaagccgaggagatcgcctttgaggatgtacacaggaggcagaggaat

SEQ ID NO: 582501 - DNA, 238 bp, Homo sapiens
gcatggggtcatggtaaaacgatattgggagggcagcacggtgctcacgtgtcgacggaacttgtacagggaggcatgcaccgcagtggtgaatacacgtcgaccaggatccatgtaagcgatattgggaggtgagcacggagctcatgtgttgaaggaacttgtataggaaggtatgcactcgcagtggtgaatacacgtcgagctggaggcatgcatgcatgctcgggtcctggac

SEQ ID NO: 582502 - DNA, 372 bp, Homo sapiens
cgggtggatcacctgaggtcaggagttcaacaccagccttcccaacatgatgaaaccccatcgggactaaaaatacaaaaattatctgggcattgtggcgggagcctgtaatcccagctacttgggaggctgaggcaggaaaatcgcttgaacctggggggcagaggctgcagtgagctgagattgcaccattgcactctagcctgggcaacaagagtgaaactccgtctcaaaaaaaaaaaaaaaaaaaagaaagaaagaaagacggccgggcaaaaggggtggaaggccgggagtccaggaagacaagtagtccagacaacgggtatccgggccccaattcacgatacggaatatggagagatcagaagt

SEQ ID NO: 582503 - DNA, 117 bp, Homo sapiens
ggcactattataagcacttgactggatgttaatgtatttaatcctcatcccaaccaattgtgctatcaattattatcctcatttgacagattaggaaacaaacataggaaggttaag

SEQ ID NO: 582504 - DNA, 336 bp, Homo sapiens
ttttggggtgggccaaattgggcccccaccccccccagggcccgccttttcttgggttttaaaatttagcccccgagggggggccccccgggaagtttacccttcccgggcggttttttttcccaaaaaatttccctttttttccggtttttggaggggaaaaaatttaaccccttaaggggaaccccttttgggtttaaataaaataagggggtttttttgttggggccgaaagccgggccccttgttagtttttccccatgttttaaaatggaaagtttaggtttgggtttaaaaaagaaaagtgggtaactggggttttttccttttctttta

SEQ ID NO: 582505 - DNA, 119 bp, Homo sapiens
ggtgggttggacgtattcactccagtggaaacgccaactataacccctccctcgagagtcgagtcaacatgtcacttggcaaggtcagggcccagttcttccttaaaggtacctctttt

SEQ ID NO: 582506 - DNA, 367 bp, Homo sapiens
tcgaccccgattatgcatgtagattcagaaaagtagcagagcaaacaagttgcattaaataaatcttcatgaaagcaaccttttcccttcgtgggcactacttctacccagtaagagggctgtatgattatatgttatacagtcttacccaatcaggcttcattttccacagagactcaaatgccaatgggacaagcacaggatgtctaaaaagagaggggcactgtgtaaagcagaggagtagtaagatgactgatcaagagggggggtgcctgccctttcctaaagtgagaggtgactttttagttctagccacctttgtcttgaggtaatagtggataggtcttgggatttttcaaaaatgaaa

SEQ ID NO: 582507 - DNA, 208 bp, Homo sapiens
gagattgttaataaattgattgctcagaaacagctagaagtagttcatacactcgatggaaaggatatatacctccagcccaaattaggtaaaggaaatgaggagatgaggctacaatgtccgaggtggtcggggtaaacaattgttgaatctacaacaagggaaattaaatgttgggcctgattcaaattggaaaatggatggggtg

SEQ ID NO: 582508 - DNA, 170 bp, Homo sapiens
gcaagagcctgcagctgatcttgtttccccgtgtgcagaggctactgtggggaaaaagactctggcaagtccccatcactgtcccttgcagggtgactggccgctgcggctctgtgcttgtacgcctctttcctgacatccaagagcactggcatcggctcttgcctcct

SEQ ID NO: 582509 - DNA, 432 bp, Homo sapiens
  misc_feature (105)..(109): n is a, c, g, or t
  misc_feature (112)..(113): n is a, c, g, or t
  misc_feature (426)..(426): n is a, c, g, or t
  misc_feature (431)..(431): n is a, c, g, or t
ttggaagttcaattaggaataccacaactctgtgttttgaactgttgtggttttctgcaatgttttccttatgctacaaagagaaatttccttgatgagggatannnnnaanncttaatctattggtataaatttagagcatagttatggactatatatattatttagtaaattagtggttgtaggttctctgtcaagaagcatgacttccctagcccaaggtagttggctaggtttccaataccaggcagtttctctgtctttaaggggatttaaaatttttatttatttatctgtccatccatctgtccatctgtctgaaatctatctatccgtccacccatttaggtgaggcctgagagacagagtcgaggaaatgtcaccatctttaaaaaaaaaaaattaagaaggaccctttctttaaanttaana

SEQ ID NO: 582510 - DNA, 244 bp, Homo sapiens
gatttcggccacgagggggaggggaggcccatttctttttttgggcacaggaaactattggctcttgtgcttcctccaataggcggcatgtttttagagggctgtggctttccctccgagtgtcttgtggtcatctctgtacaaccaggacacaggaagctcctcttgtaagtctcgagtcatgtctcttcttgccccgatatggtgttggagggttccttttcctgttcttctcgccctttaa

SEQ ID NO: 582511 - DNA, 248 bp, Homo sapiens
  misc_feature (9)..(9): n is a, c, g, or t
  misc_feature (55)..(55): n is a, c, g, or t
  misc_feature (59)..(59): n is a, c, g, or t
  misc_feature (90)..(90): n is a, c, g, or t
  misc_feature (195)..(195): n is a, c, g, or t
  misc_feature (233)..(233): n is a, c, g, or t
tttatgtgnttattggccaatttgtatacattttttaaagaaatacatattaagnaccntttgctttatttttgaattgggttatttgcntttttattcttgagttgtaattgttctttatatattctagatacaagcaacttattatgtttatagtttgcaaacaattttttcccatactttgggttgtctttnactgttttgatagtgtctttgaagccccaaagtttttnattctgatggctggg

SEQ ID NO: 582512 - DNA, 267 bp, Homo sapiens
catagttgttccttgtgtaaaattagatatccagaaatgatgtattacagagctgtcctacttgaatggagtactgaaccctctacgtggacgtggggtgcagtagagatgccggggagctgcacctcctccaccacctgtacccaggggccgtggtgttggaccacctcgagggactttggtacgtggtacaccagtaaggggagccatcaccagagttgccattgtgactcgaggcgtgcaaccgaactagtgtgaggtgtgctc

SEQ ID NO: 582513 - DNA, 214 bp, Homo sapiens
ggggggccccctcccccccccccccccttgggcccggggtttggaaaagcctggggggccccccccctttggggggggccctgttccccgggggcccccaaaatccccttttttttttgggggtaaggggggggcccagggatccaatagtttttttttttttaaatggaagggttttggggttttttgtaaaaagggggcccttttttcccca

SEQ ID NO: 582514 - DNA, 481 bp, Homo sapiens
agattaccccccccggttcgggattggggtccctccaaagggagattgccctgtaccaaaaaaacaaatgtttcgctcagatgtttcaaaagactctgggcccaataattgcaggtcaccggagtgggcattcccccaaacttctttgcgctattgggggccagaaggagggatttttttttttttaatgaaaaaaaatttttattcatagcttatccttcagagcaatgcccggcatgcagcaatatcaaacatcagctaaccgaaagagctttttgtcaaggcccgtatcagggtaatggggttggtttgcacatgttgttattgccttaattttaattttattttgttttctacaaccaatcaaggtaaagccatatcccaatgatccagtaatattgcaatgtttgtaacccttcatttttactagtttctttttaatcaagaggtcaaattgaataaaaatcccagcaatttttga

SEQ ID NO: 582515 - DNA, 169 bp, Homo sapiens
tcgcctgccgacccgttgctgtccttccacctggatctggggccctccatgatggacgcggaccttgagctgaatgacgtgatcggcttataggttccctcattcgccgcgccgttcccgcccggcaccccacttctgtctacataaacggccaaggtgtgtgcccgga

SEQ ID NO: 582516 - DNA, 882 bp, Homo sapiens
aaagaaaaaaggactgtgtgcagaagaacagagaactcgcagtgatggaaatatttatctgaataacaaaagatgtatctcaataaaaagacttggagaagattgctcccgcaacgagaaaggcatccactgctactgtcagtacaccaacgagagtccttcgaaagcttagtcgatgatggtattggttggactgttgagcaggagtcggagacttctcatagtttatttattgcggcttcccttccaagtaaagctcttcatgcaccggaaacatcagtaggaggttcggtgcaatctcaagttgtctgagggaagtcaaaagcatgtcaagccatacagaaatgcgattgagaaagctcatctgggccgattgtgaaaccgtggatgagcgaatccaccggctagtcaatagaacacgagcttacttcagttcgagagccaacgggaagagctccaggcagtaatgtagaagaaactacacagacgtgtgatccgcaaggtgtggaagatatacgccaggcaaataatggtacgccaagggaagctgcataacagatggactgataacttgttcgctataagatcttggcccactaagaatactttcgggtttgaggactctttacatgggctagacgttggtcatccccgaagaccttgcctacatagaactaattaagtccttggcgcggaagggaggtacaagctggtgaatttcgtactctcaactaatatttaactaagggtcgactggcgtggcggacggggacccaccgtaaggtcacacgctcacgccccttagcccaaaaaaagtggcgccgccgaaagaacctggggcgccaaaaaaaccttcaacggaggggccccaacggcggggca

SEQ ID NO: 582517 - DNA, 723 bp, Homo sapiens
catcccacaagcggtcctttcccgccagacctgcgcccaactggagtgtaaaccccgccccccgtgtctcaccagggaaacttgacaaccagatgcgaacttccaaatggatccctcccgcacagtgtggactggcgctaccaggcactgctctgccatgcgtcttaagacacagccgagggcgctgcccccaccccgctggcgatcgccctctcaagcccctgttcatgcctgggacagcgcccacaggaccttgctcatgcctgggacaggcccccgggccccccctggctgccgtcagcagcggccggctggtgggggaaggtatggaccctccgtgggccggagctgggagaaccaggcctattattggacacctggtggccctggcaaccccaccaggatgcctgagactgaaatctgtgggcttcacggagctcccgctcttgcacctggctgagtccccgtgacctatataactcttactcccccttttgggacactttttgagagggaccacgggatcctatctaactaccccgggatagacactcgccccagaccctcctgagcaagcctggacgctgtgaccctaacgatgaaggtgtcccgcagaccatgtccggggcaggcaccatgctctccccacctaccccagccagatgtttttgtaaagaaccataaaaatgaattactagaaagccaagacattaaatacacata

SEQ ID NO: 582518 - DNA, 2036 bp, Homo sapiens
  misc_feature (951)..(951): n is a, c, g, or t
gtggaatgagccgttggtttcgtggatggcgatgggttcggttggttggcgaatgcgctggttgtgtcctgtggtgtgcggcgcgcgggggtgtgtgggtgtggttgtgttctctgcgctcgttgggggccttcgtgagcgtgctggcttcgttctccttcccttctccgggggggtggtggtggtgttctcttcgtggggcctctgtggggtttcctatggggtggtgtagcaggggatgactgctgctgtgtctccatcgtggggaggggtggttggtgcagtggggtgctcaaagtttgtagtgtttctgcctgcagctggggcgtttagtatattcgtttgagggggagaatgttttggtcgcgcgcctcgtgcggtgacgccccgtggttgtctgtgcttgtccgcagacggggttgatgttcattttggtgggtgtaggagccggcccctcgttgggcaggtgcttgtggttgtgtgtgtgtcctctgtgtggggtggagataagtgtggcgtccatgggtgggtgtggtcccgcgttggggttggctcccacaaaggtcttcggttggtggcccagcgttggtggatgataggggacgctacccgtgtggtttgtggtcgtcgtttgtgtggtaaattattaggagggggtggtctggtgtaatatatataggggggtgttgtcctgccccacgcttgtgggcgattgatgagatgatttgtgtggcgcgcctcttgatgtctcctggggggagtactttctctacacgggtggcgccctctctgttatatgaagggggtggtgttgtgtcctcccacgaggtggtgtggtgggttgtcccccttgcttgaagcacgacaggtggcccgggtgttgtgttgttcttctggggtgttgtggcgccaacttcatgctggtggtggggaggagatcttcttatgagnggccgctccttcttgtgtgttgttgggatatggtgatcacctcttcggtgttaaagtggggggcgcgtgttgagtaggagagtagtattatagtaggtgtgtggtggttgatgataataaggggggaaggaggaggcggattattataatgatattattagactaccatccagcagaggacgcaccagcaatgcagcacctccacagcgggagagagtattattagttgtaggtgttgtgtaatgagagtagagtagtgtgttgtgtgtggttgttgttggtgtgttgttgtgttgtggtgtgtgtggccccccacttgtggtggactccacgctggagtaggtgtggtgtcccctctgcggggtggcgggagagtgaagagggggagatatagatgtagttgtaggtcttttttgtggggacgctcactacttgtcctcttctgggcgcggctactgcgtgggtcgtccccactcttgtgtggtcttgtggacgactctagagtttgctgtgggatagacctctgtgtggatgagtatagaatagtagtgtgtgtgtgaaatagagtgagagaagtgtgagagagagtgtggggatagttagagaggcgccataagagagaggagtgtgtgtgtctcccatagttctcacttttgagaggggacagtgtttgaacagctgtgtgtgtctcacaagtagccgatagactccccgcaaacgccctatagtaagtacaccactatactctcctctggcccacgtgcgcctctgttgtgtgaatatgggtgagttgtagggtggagagcgagagtgccacatgtgtaatattgtggtgggtgtgtcatatgttgtagtaatagtgagtgtggatatagagagtgtgtctcgtgagttgagaaactctgaagagataggtgttggtgtctgataaaagctcatagtgtctgatagatacaccccaccgtgtgtagaaccttgtggcgaataccagaagggttgttgtgtgtgtgtgaagaacacccagaggtgtgtgacagattgttgttgtgtcaccgcagttaccccggttggtaatgttataaaac

SEQ ID NO: 582519 - DNA, 877 bp, Homo sapiens
tttgtgtacaatttcgtgcatttggaatcacgagtgctggaacctccgcccgcataacgctgcacaatacgccctgtgggaaaaattgggaaatcttacaattggtctgtataacccgcccagttttataccccctgcataacatatgacagcccaggcttggatgctcctttggggcaatttaaaccacgtcaattcgttttgtacaataccggccttagtttcgccgttgccgcaggctatttaactaactggccccatgcgctgcgtgggttgcgaccccccggtctgttaggcaattcctctgtgggttccctcgggggggtaatcttgtttcgatttgggcgccgccggggtaagactcgctcctagttgaatgtgtggtcggtgcgcaggatcctgatacgtcgtgtggcacacgcgcagtgctcgagctattaccactgttttaagggcttcacaggaatgttgtcgcccccaaatacaggtgctgtatgagatatgtttgtcacgcgggagccttttttagcgcttgtccgcaatacgccccctatgttgtacatcgctggggcagaaccttctctgggtgcgtcacacgcggttgtctcgcgagctcaagatcggcggtatccccgttcgccgggggcgcagcatatttgggtcccgaccccttaatttcgccgtttcaaatagttttccccgccaccccgatgggggtcccaatgacctcaccgcaactcacgcagttgtccagcacattcttaacaccgtcgtcctcccgccgcgctgacaccccccggcgtttgcacaccacccatccccccatttctcccttcccctcccccccacaaccatccgggttttccctcaacataac

SEQ ID NO: 582520 - DNA, 104 bp, Homo sapiens
gtgagcctggaccgccaagcactgcaaccactcttttcttcatggtgctggtgctagggccgtgatctccttctgcattcggtcggcaatgccaggtacatagt

SEQ ID NO: 582521 - DNA, 133 bp, Homo sapiens
tgaaccactgatgtcaatatcctcattgccaacagtagtattttcatgttttcacatagactttttagagcagtttaggttcactggcaagattgagcagaaggtacaaacatttctcctataccttccaccc

SEQ ID NO: 582522 - DNA, 1440 bp, Homo sapiens
taagaaaaaaaaaaacaatttttcctacttttatcttacacccctcaatttgttatatatgtgcaggggtaattccctaaacttcttgtggtggggctccacagaggtggtaagtgttctataacaagtgactacccagagttctttgagggtgcgcaacaaatattatattcccctctcaaagcgagtggacaacaaaacccatttgtgaaggagggtatagtagagaaaatgtgtgtggctcattatatttctctgtagagacacaatgttgtgttgctcattatggacacatttttcacacacaaataatactctcaccacatatacaaaactctcgcgcacatagagacacaaaaaatataccgcgcgtgcaaacatgtgtgtgtgaaacgaagagcgtggtctacacaccaaataaagccctatatatatttgtgtgagtaaaatgtgcgggtacaccacacactacggagtataaaaagaagcgcggactttaggagcgcgtgttggtactacgtgtggtgcacacaccatatgatctgcggacacgcataacatttatcggacgggatgtcggctgcagcaacctcccacattatttttaaaatccacaacctcgtagagtcaaatataacatacccgtgtggtgtaataagacacacccagcaagaacaacaaacacaccacagagggcggtgtctttttttttgaaaaaccacacatgctgcgaacaggacagaatgtatgataggcggcgaacacaactattatagtgtgcgtaccccaaagaggggggcggaatcaatatatttctacacatagataacaaggggaggcgactgagtagaaataaggtgtgttttgaaacatgtggtaagtggcgcagactgtgtgtggtagaaacacaaactagtagcatgttgtctcttcttaagaaccgcccactagttggttgggcaaccaacagacgggttctactaataataatatttttgacagaggttgttcgaacagcagacaacctattaatgtggtggatgatcaaacaaccttaataaaaaacaacaaccggtgtgtaattctatacacaaagcgagcggccgcacgacttattcgttaatcaccaccaggcgaggagactaaatgtacaccgacactctattaaatatatatttacgaccggaagataatataaacaactctcgcgcggggtggtgcgagaggcggaacgacatatttacaccacccacaacgcggcgttttacaacaaaaggcgctttaaaacataacaccaacaagctggtgtttgcggctctcggcaaacaaaaagatatcttacgatggctgatccaaagggaataaccaacccgttctagtcggatctagtcgtagggcgcacagttccaccgagggaagtccccacaaaaatatatttag

SEQ ID NO: 582523 - DNA, 133 bp, Homo sapiens
aaattcgcggccgcgtcgacagcagcccaagagataaggcctcttaaagtgactggctgatgggaaggcattttatctaattcagactcagatgagggaaaacgataacacttcattacagacttggtcgacg

SEQ ID NO: 582524 - DNA, 704 bp, Homo sapiens
aacttacggctaggtacgagtgcttgtggtttaaatcgtgccgagggagcggcccggtggctggggcggcagtgtccgctgcaggacgagaaccctggtgtgtggctgtcctgtgccctcgcagtggagggccgtccagtggcatccgcgtgggagacgaaaagttgccagacggccagcattgccactgccagtgcatcctgcccaggccaggaatcatgtggactgcccagtgtgcagactggaggccccctgtgcctgtcagcgtgcagccccgtcccagtacgacatacccaggctctgcagcctttcttcggagagtggaggccatggtcatccgagagctgaacaagaattggcagagccacgcgtttgatggcttcgaggtgtcttgtactgtataccctgggctacccgccagacccaagacgcagggtctgcattgtgaccagcatctcctgttgaactccactggctcttgtggttgtgcctgtgtccttacggccggctgggaccatggggactgggagcacgcttaagtccttctgtgtgtgcctggaaccttgtgaccgcgcgagaacttgtgtcccagcagaacgtcggccgtgtgtggatggtccccacgcgctgtcctgtgtactggcttccaccccacgcagcctcccacgtcgcagtgagggctgtcactggtgaggggatgggtg

SEQ ID NO: 582525 - DNA, 202 bp, Homo sapiens
gcgaagagagtgatacatgatatttccagatctggagtcagtcacttcgtttgtagagggctgatgtccaggtagtagcccgactcattggtgatgaacatggcggatgggaacggcactgccgggtggtggtactgacggatgtcgatcttgacctcagcctgtagcacacggagtttccacaggcccggctgcctgtagc

SEQ ID NO: 582526 - DNA, 263 bp, Homo sapiens
cgtttctccatgttgtgctcaagctggtcttgacacacgcaggttcaagtggtccgtccgtcttgtgcctcacacggtgctggcactcgcggcgtgacccactgcaccggggcggtagagttaaggttgtggcatgttgtccaggatggtcctgaacccctgggctcaggtgatccacccacctcagactcccaaagtgctgggattacagacatgagccactgcgcctggcccagaactttttccttttttgggaagaaggg

SEQ ID NO: 582527 - DNA, 1848 bp, Homo sapiens
  misc_feature (439)..(439): n is a, c, g, or t
  misc_feature (1483)..(1483): n is a, c, g, or t
  misc_feature (1637)..(1637): n is a, c, g, or t
  misc_feature (1848)..(1848): n is a, c, g, or t
tctggaaagggagtctcgctctgtcaccaggctggagtgcaggggcgcaatctcggcacacctctccgcctttcgggggtttcaaggcaatttctctccgtgccctcagccctccgtggagtagcgtgggacatattagggtgctgtgccaccatgtgcccaggctaattttggtggtattttcttagatagaagagcgggggttttcaccacctgtgtgtgtggcccacagagagtagtggtctctctcagattctctctctgtgagacccttcgtgtgtctctctccacaccccacctgctgcggcctcctacccaaagagtgtggcgtgaggatatctcccgagagtgggtgtgagagcccaactgtggcgcccgcggtccaagtccgctgtgggtgtgtgtcctttcacaaagagtaacacctgctcgtgcgccncccgagtgtgtgatgtggccgcgtgtgactctctacaactctccccgcagctgtgtgttctctcgctgatagacaatttatacaactctctctctctcgcgtggggagaaatctccccctctctttctcgcgtgggcaaggctctttgtgttgctccccgttgttgagaggggagaagtctcaaccgggggggcagaagagtattcaccccgtgggccgtgtgttggacacccgctgtggtgctcccccctctcatagttgatacaccctgttgtgtgtgccacgaggcgagcgaggaggagatagttagaataatctcccccgagaagagagcgctccggaattcaagcgggggggggggggggaacaactccccctcaagagttgtggataaccacgagatccccaaaaagaagcccccccacaatatcgctggaaaaaacacccacaaggggtgctgtggggtcgcccgccgggtgtggggactaataataaaaacaatctcaggagaggaggagagggaacattccactcccccaaaaaggaacaccccaaatatacaaagacgaaggggtggcgaaacatcatcaaagaacccccccccgctgtgggggggtgccccctgagtgggcggctatatgcagcgacggcgatggggggttcctcattctatccaactatcaaatggcccccccctgttgttggggatctctctcatataaaaggcacctattctggtggaccccaagagggggtagtataggtcatccttagtgagttacatcatcaggaggcggcgcctctcccccagtattggtggtggtggctcactccacgagcgtgtttgtgtttgcggtcttctaaaaagaggccccccccaaattttttccacgcttggggggggggagcccccctatcttccacgagagacatcacttcaaatgtagagcggcaccttatcctctctaccgaagttgtttcccccccccacaatggtgtggttttcgtgtttccccccccagtggggagagacgcgcggtctgntcgcacttcaggtcagccctgatggtggtggagacaacccacccacgcggcgtttgccgacacaatatttccaaccctcctgttaatatagaggcgatcttcccttctgtgttgcggcccacaaccttctcttgtgtgtttcttcctcctcccngggtgtcgccgcgactcttggtggtagtttcccaccaataccagccgtggtttctggccgcgcgcaacaaaacattactaccagacaaaaaccgcgtgcgggggctcaatttctggggcgtcgcgggagaacccagtgtcgttataacatactcgtgcagtggcttcaatagctgtctctagcacctgctctcttgtaacctgtgagcaan

SEQ ID NO: 582528 - DNA, 292 bp, Homo sapiens
agtccaaacagggccatgatgacttctgattacagcgttgtcacaggtagctcattttcttcccaggacaaggcaatgctgggattgcgatggcaagagagccaccaagagctcctgccccatgtaggggcactgttgctttgggctatctggaaagaacactgaactctgcgagtcaagagccctgggttctagtgttggctctgcccctgtttatcatgagaaccaaccatctgcaaggtaagcattaattgatgtcatgcacatacaataattaccactgtgatcatgc

SEQ ID NO: 582529 - DNA, 450 bp, Homo sapiens
agaaggaaccacttctggactgtttcaggatcaggaccactaaccctggcagtggagagttgaggaccacagttggttaatgaaggcatggtgccagccacactgtagcctcagtgaagataggcaggaaagtagaaataaaaacatcgtttcccaagggtcataaaagaaggcagattggttctacttgcgtatgaactcatacctggtgctgaactggaagcagaatttgctgtggcatcttgttgccccttcgatattctccttgttctccccctgtcgcttcagcgtctggggtcgtggaaggacatgtaggtaatcgaggcagacatggaacaacagatgaggaggaggctgctctcccgagctcctcagctacctctgtaaggaggacaaagggaccggtaataagaacaatttcatgaccaaaacggggaagtggttccttgt

SEQ ID NO: 582530 - DNA, 126 bp, Homo sapiens
  misc_feature (3)..(3): n is a, c, g, or t
gtntttctgggagtagttatctacctctgtatgtctttatcagtttggtgtagatgttttacggtcatagtccgccgccgaagcttcgtttcactacaaacctacatttcactttataatcaaccg

SEQ ID NO: 582531 - DNA, 260 bp, Homo sapiens
gaaacccagttcagttccaggtaagaggagaagttcactccatccagtctagtgactttagctataaatcaggacagaacgaatggaataactattttcaggctctgaaaagtaaatggtaggaggaagactgggcaagaagatcagaattcaaaatgccactcaaccaatatgtctaacttaaacaagactcagaatctgatgtgttcaaatattcaaaatgccccaaaggcaatacaaaattgctcagcatacaaatc

SEQ ID NO: 582532 - DNA, 553 bp, Homo sapiens
  misc_feature (15)..(15): n is a, c, g, or t
  misc_feature (57)..(57): n is a, c, g, or t
  misc_feature (104)..(104): n is a, c, g, or t
gcacccaggtagatnccatctttatctcaaccagagcaagctgctggcctactgcangatgaatgacattgttctggttgcctatggtgccctgggaactcaangatacaaatactgtataaatgaggataccccagttctcttggatgatccagttctttgtgccatggcaaagaagtacaagcggactccagccctgattgcccttcgctaccagctggaccgtgggattgtggccctagccaagagtttcaatgaggagagaatcagagagaacatgcaggtctttgatttccaattggcttcagatgacatgaaaattttagatggcctggacagaaatcttcggtactttcctgctgatatgtttaaggctcaccctaactttccattcttcgatgaatattaagatggaggcccttgccacgagttctattagaagatcttttgtgtgatgctggactctcagatgccaataactcgacacaccgcctccaatcactgcttagcaactcacccccagttaattcaataaattttgcttcttttctat

SEQ ID NO: 582533 - DNA, 701 bp, Homo sapiens
  misc_feature (33)..(33): n is a, c, g, or t
  misc_feature (125)..(125): n is a, c, g, or t
  misc_feature (152)..(152): n is a, c, g, or t
tatatgccatgagctgtgggctctcatgtagtntacatgttactgggtaaggtgagccttgcctatagagcagcagtacaatcacggccaactcgacgctttaagagctcggcctcatgatgtcnacagtgtcattgtctaagctctcgtcnagccatgatctgacacagatcattagagtggatcttgtatggccatcaagtggtggtgcacatgggcagctatgtgcatgtccagagttcagcagctccacagtctcacagagcgagtacctcatctaccagtagagtcagtgtcgcctgcgctacttgctgcaggtcctcctctgagtgcccgcactgtcccacggggtcgtgcaaggtgagactgtgatcttcaatcatcaggcccatctctggtaccgttatatcgctcctttttttcaagaatccaatccgttgttgttagctatagtccccatgctgtacaagatccctgtctttatgcctcctaactgaaattttgtattctttgacgcatctgcccagtccctctcctcccagcccatggtacacagcgtttgactcttgacttgtataagggcagcttttataggttccacatgtaagtgagatcacccagtgtttgtctttctgcgccgggcttatttcgctcagcataatggcaccgggttcacccatgttttcataaatgacaagatt

SEQ ID NO: 582534 - DNA, 947 bp, Homo sapiens
gccgcccttttttttttttcccctgagtaaaagcaaaaaatttcttccttgggaaaaaattatatatattaaaaaaccactttaagtgtggtttttttaaaaaaaaaaaaaaaaacgggtaaaataactttgggcaagaaaaggtgtttaatgaaataagtgtatcagtgtggatatattattaatatattgttatacggtgtgtgctcatgtgttacatttttaaccttgtgtggtaacaaaggacaaatataaagagactctttctctctacaaaatatatctctcgtggtacacaaaaacaaaaaaaaacaaaacaaaacaaaaaacaaataataaaacaaaaaaaaaaacaacaaaacaaagagagaggagggcgcgcgcgcgatcaaagaaagaatatctctcccgcgcggagaggagcgcaccacagtacaaaagcgcgcgcgccaaccgaccagattatgtgtggagaagaaaagagagggcgcccactaagagtggacggaggcgcacactattacacacaacaccaaccgagcggcgagcggcgaccgagcgagaatcataaacaaaacctagagaagaacgcgaggcgaaaaacagccgcacagacaaagagagcgagaaacatccgcgtgagaaaagaagaaccaccatcatacaccatgcggggggcggggaaacaacacataagaggggccgcgacaaaactcacacccaaccacaggcaagaacgaactacttaaaaagcgcacccacacagaacgggcaccaacaccaaccatcacccaccccctacgcaccaagcagtcctaaacaaagaggtggcgccacaccccccaacctcgcccggaccaaattaaccaccgcacgaccacgctataccacaacctacaaccaccaaccaaaagggaagatataataacgccagaaacaataatatt

SEQ ID NO: 582535 - DNA, 823 bp, Homo sapiens
  misc_feature (14)..(14): n is a, c, g, or t
  misc_feature (65)..(65): n is a, c, g, or t
  misc_feature (71)..(71): n is a, c, g, or t
  misc_feature (82)..(82): n is a, c, g, or t
  misc_feature (171)..(172): n is a, c, g, or t
  misc_feature (186)..(187): n is a, c, g, or t
  misc_feature (197)..(197): n is a, c, g, or t
  misc_feature (207)..(207): n is a, c, g, or t
  misc_feature (217)..(217): n is a, c, g, or t
  misc_feature (231)..(232): n is a, c, g, or t
  misc_feature (243)..(243): n is a, c, g, or t
  misc_feature (291)..(291): n is a, c, g, or t
  misc_feature (300)..(300): n is a, c, g, or t
  misc_feature (303)..(303): n is a, c, g, or t
  misc_feature (343)..(343): n is a, c, g, or t
  misc_feature (346)..(346): n is a, c, g, or t
  misc_feature (348)..(348): n is a, c, g, or t
  misc_feature (352)..(352): n is a, c, g, or t
  misc_feature (362)..(362): n is a, c, g, or t
  misc_feature (373)..(373): n is a, c, g, or t
  misc_feature (449)..(449): n is a, c, g, or t
  misc_feature (482)..(482): n is a, c, g, or t
  misc_feature (525)..(525): n is a, c, g, or t
  misc_feature (577)..(577): n is a, c, g, or t
  misc_feature (582)..(582): n is a, c, g, or t
  misc_feature (615)..(615): n is a, c, g, or t
  misc_feature (637)..(637): n is a, c, g, or t
  misc_feature (653)..(653): n is a, c, g, or t
  misc_feature (681)..(681): n is a, c, g, or t
  misc_feature (693)..(693): n is a, c, g, or t
  misc_feature (698)..(698): n is a, c, g, or t
  misc_feature (737)..(737): n is a, c, g, or t
  misc_feature (740)..(740): n is a, c, g, or t
  misc_feature (798)..(798): n is a, c, g, or t
gggcctctgcagangttaagcccagaccttatacccaactacttactcacccccgaatatttaanccactnttcctgaaagnactcagggtagcaagtaacaaaatgcaaacgattatataaagaaagtgcagtcaaaaaggaaactatgtggcaagtaccctctttcccnncccaccccccaatnnaaggcaaacnatggcacttngccctcgctnaacccagattgtcnncaaaaactatnaaaatgtaaaagacttaacaaaaaaacaaaaagacgtttaacagatgncaaaaagcnccnccagtgtttagaaaataaatgcttaaacaaaagacaacanatntnatancaaacaagtntgaagagcccngaattgcagcattctgtaacataaacaaacaaaaagctgcgtcactacggatctattgtcaaaggcagaatttctncaggcaggtaagtcagcgagcgtggtggttctntttcaggcattttcacggccatttcataggttggcacaaacgnactgagcgcaggtgctccaaaggcagggtacacagcaatctccggcacgttncggtngtggatgtattcatagcagccccaaacacagtnaattagataagccttaaaaatnatgaataaggcaaagnacacaagaacaatgaacaggaggtagcnggagttcaaggncaggnggtcatctttttttggaaaatcaggtagttgatccaganatnctttgattcttggcaaataggtgagagaactaatagcaccaggcaactgaggacgagnaaaaagtcggtaacagaagaatgga

SEQ ID NO: 582536 - DNA, 342 bp, Homo sapiens
aggtccgccctgtcttcagcacattctggcatatctccatgacagcattccgtgtgaacttgggaagatcggtcgctaactcgaaactttctgcaaagtcagctttggaaaatctgtggctcagtcgagatactgcccacgcttagagagctctttctccaaatttgtagagagtggcacgcttgagtctctgtgtggcagaggactccgcaggcttggccccattctgtaagagcacctttattccttatagcaaataaagggagtcccggggcataaaagtaagagtgtcggctggcaatctcatataggtatttcataaagagtgtctctccgttctca

SEQ ID NO: 582537 - DNA, 376 bp, Homo sapiens
caatggaacatgtataactatgtaacaaacctgcacattctgcacatgtatcccagaacttaaagtataataaataaataaataaatatttttaaaaagtcctaaaagatttaaaaaaaaaacagaaatggaaaatgttaatagatatattctctattaaagaaattgaactcaactactttaccataaagaaatctcaggcccacatgtttatatcggtgaattccaccaaacatttaagaggaaataatactgaggccgggcaagatggctcacatctgtaatctcagcacttagggaggctgtgacaggaggatcgcttgagcataggagttgaagaccagcatgggcaacatggtgaaaccccatagctaca

SEQ ID NO: 582538 - DNA, 1498 bp, Homo sapiens
gggtgcgagctgggccggcggggtggttcagagagcgcgcagagtccagactggcgtgcagggcccgaggggccgacttgcagctgtcctggtctctccagccctcactcggaacctgcaccgtgagggcaaatccgcgccggatggctggcttagcacagcgggggacagcccctaccgaggcctccctagcggtgtggagcgagagggcgtcagggtcggggagaagcacggaaaaggtggcttcagacgatgggctgtagttgagggaggcgggggacgggcagacctggcgatgaccgtggaacatggaatgagtagggcaaaaaaaccatttatcggaaagaatagcatacgccaactataaaatggcagagggacatcaggacaaaagcaaggtcttcgccacaccagttgacaaatacccctccacatcccatatgggacatggacacccatagtcgttacagcatcaggaggcccaaattggcaaagcaaagacgaaaaaccaaaaccagaaggtgaagttgggaacccagaggtgaacggtcatggactaggcttgaagttgaccaaccggtgaaggattcgagtcttgaccgtggagtaagacaaggcacgcagaagggggcaaaattccataacttcaattggcagcaggacttattaccatcaaattgggacatggggcttatacaaaggcgcacacagcacacggcgtaggtacagactgatacagcacccatggaagccctttgtaaccaaaggcatcaaaacaagaccacacgggacgagacatgagcagatagaaccgagtcacttatagattggagactataggcgaggcacaccagggatagaggccaatggaaatacggatatcccaagaaaggccaattgcaagttggcctttcgccataaatataatcgcgagcagatagggacgcacaattagtaccattggagatttcaagatgcgagcccccgtgggctttgcagaagttggcgcacgacacagacccgtttcctgtttgcaaagagtctttccaactactagaaattggtatttggtcagacttacagctttataagacatacatattcaccggtatatatgtatgacgcatccgttagcacacccaaacagtgaatttccactatttccaagtaacaatgtgtaacataggtattatacaaggcccaggtgtcgaccgaggacagtctagcggaaatgccacgagcgggggaaacagacaacaacgagtggcggcacccccgagagaaacatgagaatgaacaggagcagagcaacgagagcacagaaaatacaccagaggggagatgaagaacaaacgagagggatatcagtagcgactacgtgacaccacttagggcaaaatgggagaggagaagagaaacagcgagcacaaaagacccccggagagcagcgtagcacgaggagaaccctgtgcaagaaatccccaagcagtcaactcgc

SEQ ID NO: 582539 - DNA, 408 bp, Homo sapiens
gtgtgtggcactgccttcttattatatttcatagccatttattaccatgcttgaggagccattccttttggaacaatggcccccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctacggttattgtttgcctgggtggaattttaccttttggatcaatctttattgaaatgtatttcatcttcacgtctttctgggcatataagatctattatgtctatggcttcatgatgctggggctggttatcctgtgcattgtgactgtctgtgtgactattgggtcccatattttc

SEQ ID NO: 582540 - DNA, 262 bp, Homo sapiens
  misc_feature (115)..(115): n is a, c, g, or t
aggggggaaaaaaccataggggggaaagggggggttttccccgggtccggggttccaaaggggtggggtttttttcccgggggttttggggccccccgggttgttagaacccccnccccctctcaaaaggggtccccctccggggggtttggtttaaaggggcccctttttttagggggtcccgtttggaaaaatttgtttgccggggggtttttttttgaaaggggtttcccttttttatttttgcctttttattagggga

SEQ ID NO: 582541 - DNA, 169 bp, Homo sapiens
  misc_feature (163)..(163): n is a, c, g, or t
actagacttagtacaacttcatcaaactttaaaacttttcagctaggaatggtgatgtgcactgtagttccagcaatgtgggaggctgaggcaggaggatcggttgaacctgggaggcggaggttatagtgagccgagatcgtgccactgcactccagcctgngagaca

SEQ ID NO: 582542 - DNA, 405 bp, Homo sapiens
gagaatgaggtctcacttctgttgcccaggttggagtgcaatggcggtgatctccagctcctgcaacctctggcctccaggattcaagcgattctcctgtctcagcctcccgagtagctgggattacaggcgcacgccaccaggcccggctaatttttgtatttttagtagagacgggggtttcaccatgttggtcaggctggtctcgaactcctgacctcgtgatccactcacctcggcatccacccacctcagcctcccaaagtgctggaattacaagcgtgagccaccgcgcccggccaggcaaagcagttcttagagggaaattcacactcatcagttccttctgggtgtttgaccttcccggtcgacgcggccgcgaatttagtagtagtaggcggccgc

SEQ ID NO: 582543 - DNA, 314 bp, Homo sapiens
tagcgaactggtgaaagtcgtgaaattccaaggagatttggaagtaagatcattatttactggtcctttaaatagaccaaaaaaaaaaaaaaaaaaaatttaaaaaacgagggctgccccctgcaggctctggcagaaccctgggctgctctggggaacacaggccaggggcatttcaccgatttgttccacagtgattctggttttgcctgtttccctccattgttggccacgagttcggggacgttgcccagcagtgggcttgcctacacctttgtagttaacctcagcgttcatctgggtgtacttctcgt

SEQ ID NO: 582544 - DNA, 429 bp, Homo sapiens
cacgaggagcatcgacatggcgcgggcgatgttcagcccgatgtgctcggaatcccctgcccggtaagggatccccgattgttgttcgtgcatcggtagtcgccgccaggcctggttgccgtgcgcgtcagcggcgctggccagccaccggtcctgccaggtgtcgccgggctggcgctccagccagtccaggatctggatcaggccgcggcggcggtttcgcgacccggccgaaccgctcaggagcgggtcggccatcaatctggtcatcagttgtgctctcggggccctggtcgccgaccagtcagcggtggccgcacggggtgggaatcggcgcaacaacgcgactgccggcgaaggcccgggcgtgggccgcccggccggtcgggcgccctgatacagaccaccacccgcgaccgcgggcgcctc

SEQ ID NO: 582545 - DNA, 108 bp, Homo sapiens
aacttttgggacggcgtcagcgggactgatgtataagaagggcgagtgagagtactgcagggagctctgctttctgctttgggcagccagatggctgacacagtaaag

SEQ ID NO: 582546 - DNA, 773 bp, Homo sapiens
gggagtggcaaaccatcctcttgcctgttccctggtgtttgggccttgcctgtgactggtgggaaaagaaaatgtgccttgctgtgctacaacctgtgggctctggtcagctgcttcgatcctgagaccaattcctgacgatgcttgcacataccacccaggtgttgttctggtctttcactgatgcattaaatgggtttggtctttctgtatatgatgatattgatacattcttgatttttttcttgatttcttacatgacatttgtatgtgcttgtatcaaaactgtgtatgatcattacatatgttgatgatatgccattctgtagggccatgtacaaaacctatgaaatggtcaattggatctttattttgactgaacattggaaaatggtggaatggtcctttacatttgggttttgcaatatttttttcaaaataataacacctccaaataatttttttccattgtggatacaaccagttcaattatccaatgctccccattaaatgccccattgttatgacattgcaacatcaaagaaatgcaccagatgcacctattgattgatactctaattgatcaaacacttttgtgtcattttatatcaattcttattcttgatcattccactaataaaatcaatggcctctttttgatatctcaccttttaaatccttggttactattttcttgtgtgtcacttttgtactgcacactctttaatttgactcactgcaatctgtgtatgattcaattttggatttgcaac

SEQ ID NO: 582547 - DNA, 219 bp, Homo sapiens
agagtgtcactcaagacgtaggactatactcactgatccaataactttaccaacgggaacacgttaccctagggataagagcgcaatcctatatctaaagtccatatcaacaatagggtaacgacctcgatgttggatcaggacatcccgatggtgcagtcgctattaaaggttcgttcgttcaacgattaaagtcctacggcttgattgacactcttt

SEQ ID NO: 582548 - DNA, 338 bp, Homo sapiens
cggaggtgcaacgcactcaagagcaagctcaagagcgaggaaacgagactctttcgttccttctagaagagtctgagaggacgatgagttattgaaaatgcagatgttctgaggacggaaacggacactcgagacgcagacttcaatggaaccaaggcgagtgaatcagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcatcctaccaaa

SEQ ID NO: 582549 - DNA, 372 bp, Homo sapiens
tgttataatccttaggtactctaaccacgttaatcattgaattaaatagtaattccagtgaatggtgggggtttgttgtgctgtttgcttcagttggctatgatctttttcttcgagtcttcgtacgcgagagctaataggcagttattgtgacaattaatatatgtagtggcagttttcttacggtcttgacattttcagagccacaaatgaatcatcctgtaatgcatcgaagaaactttctttttgtttgttttttttaatcccccctgttcattttttctttttttaaaaagacatataatcaaattaagttgaatttgtgaccccggggatatgttcagaataataaaacaaacatcctggcacaca

SEQ ID NO: 582550 - DNA, 472 bp, Homo sapiens
aaattcctatgaaagggaaatgttcgacaaggctagattgaaactgggcctggataaagctgtgctacagtctatgagtggaagagaaaatgctaccaatggggtacaacagctttccaagaaagaaatagaggatcttctacgaaaaggggcctatggtgcactcatggatgaggaggatgaagggtctaaattctgtgaagaagatattgatcagatcctcctacgtcgaacccacactattaccattgagtcagaagggaaaggttccacatttgctaaggccagttttgttgcatctggaaataggacagatatttccttggatgatccaaatttctggcaaaagtgggctaagaaggctgaattggatattgatgccttaaatgggaggaacaacctggttattgttactccaagagtgagaaagcagaccaggctctacagtgcagtgaaggaagatgagctgatg

SEQ ID NO: 582551 - DNA, 120 bp, Homo sapiens
  misc_feature (120)..(120): n is a, c, g, or t
ggaccccgcccaagccaacaccctgttgattatcagtgtggtgatcggtgcgccattcttcgtgttcttcggctggctgtcggaccgcatcggccgcaagccaatcctgatgctcggccn

SEQ ID NO: 582552 - DNA, 662 bp, Homo sapiens
  misc_feature (346)..(346): n is a, c, g, or t
  misc_feature (397)..(397): n is a, c, g, or t
  misc_feature (662)..(662): n is a, c, g, or t
agcagtgtctcacacctctaattccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccnggaggtagagcttgcagtgagctgagatagcaccactgcactccagcctgngtgacagagcgaaactccgtctcaaaaaaaaattaacttgccgtgctggtgcgcgcctgtaatcccagctactcaggaggctgaggcaggagaatcactagaagctgccaggcagaggttgcagtgagctgagattgcgccagtcgcctcctgcgcaacaagagcgaaactctgcctcaacactacttaaactaagcgtccttataggttggtgaggattttgtcagacaccaattcattaaggatttagcgatgcgtttcttcn

SEQ ID NO: 582553 - DNA, 92 bp, Homo sapiens
tcgaatatgtaggcttcatatgagggtcactctcctcaccctgctgctgcagagccaccagggtcacactggcagattgcagccccagcagt

SEQ ID NO: 582554 - DNA, 126 bp, Homo sapiens
taaggatccgtgcgtcacttcatcgcgttttctgggccatttaggtaagctctaagactcctgagccaacttttatgtacctggctttcctaggcaggggcttgaactaagtatagaagccaagga

SEQ ID NO: 582555 - DNA, 175 bp, Homo sapiens
  misc_feature (155)..(155): n is a, c, g, or t
ttagaggatcttatccccgggtctgggtatcagcagcggatggtgcagaacagcgaatattgctgaacagcaaatgttgctgtctgattgttcttctggaacctttgtctcagaggggtacctggccgtgtgaggtgtcaatctgcccctactgngcagttcctcccagttaggc

SEQ ID NO: 582556 - DNA, 216 bp, Homo sapiens
ccgggagccggtcgaggccggcgggccaggaggcgtccatctgccggagtgtttgttgggcgagggaacaagggagaggttttttttctacccggaagcctgagagtgaagggggtgaaactcgcatttggggaagtgaacacgaactctgcctgagggcacatttgagttccagcgacagagtcacacgggctgagctccctcccagcttgactg

SEQ ID NO: 582557 - DNA, 349 bp, Homo sapiens
  misc_feature (19)..(19): n is a, c, g, or t
gggtttttttgtccggggnggggtttttttaccccgggctcgtttggggacccccccccttgtgtttggacccccttcgggtgttttgggccccccttggcgccggggtgttcgtttcggcccggggggttttgcctttttcccggggggggtgcctttttccctcggggctttgttgtggccctttggccccttttggggccccttttgggcggggttgggggccggagctggctgggtctggttgggccttccgggggggttgtttttccccccgcccgggttgtttttttccccccccccccgctttttttccccccccttccttttttaagaaaatgtttaatta

SEQ ID NO: 582558 - DNA, 329 bp, Homo sapiens
  misc_feature (11)..(11): n is a, c, g, or t
tttgaggcaanctatatagtaatagatgtggagatttggccatcctgttttagtctaagtaatggagtgtatatctaatttgcaggtggaaaaaactcgaaagttatgcaacacgaagatttacaaccaaccacgaaagttcaaaggctagtagctacttgctaacactcgttgtccactacggacaagaatccacagatggcactgcactttcttcacttctatgagacatcacaaaagtactgcacaaatgttatgaatagtataggagaaattcaagagacagaccaagaggctgaaccagtcccactagatggcaccgtcacagg

SEQ ID NO: 582559 - DNA, 374 bp, Homo sapiens
aaaaaaaaaaaaccaaaaaagccaccattactttcagggcccctattgctttaaatgcataatataacctgctgccagaacccgatgtgtttaaaaaaaaaaataaaacccccttctttttatagcccttaaagccaacttttctgttttaaccaatttggtttttattttgcattgccccccctttggttatttaaaaactacatccccttgggagtaatgtttcagggcaagtagggattacagcttgatggttgggggttttaattttaaaagttttttattcccggtcatataaaggagttaaaaccactggaacagcctttttttaaataccttgttaaataataaaagggccccccatttaaatcgga

SEQ ID NO: 582560 - DNA, 1346 bp, Homo sapiens
  misc_feature (9)..(10): n is a, c, g, or t
  misc_feature (14)..(15): n is a, c, g, or t
  misc_feature (41)..(41): n is a, c, g, or t
  misc_feature (59)..(59): n is a, c, g, or t
  misc_feature (92)..(92): n is a, c, g, or t
  misc_feature (102)..(102): n is a, c, g, or t
  misc_feature (175)..(175): n is a, c, g, or t
  misc_feature (192)..(192): n is a, c, g, or t
  misc_feature (199)..(199): n is a, c, g, or t
  misc_feature (219)..(219): n is a, c, g, or t
  misc_feature (229)..(229): n is a, c, g, or t
  misc_feature (241)..(241): n is a, c, g, or t
  misc_feature (249)..(249): n is a, c, g, or t
  misc_feature (259)..(259): n is a, c, g, or t
  misc_feature (265)..(265): n is a, c, g, or t
  misc_feature (270)..(270): n is a, c, g, or t
  misc_feature (282)..(282): n is a, c, g, or t
  misc_feature (296)..(296): n is a, c, g, or t
  misc_feature (375)..(375): n is a, c, g, or t
  misc_feature (397)..(397): n is a, c, g, or t
  misc_feature (410)..(410): n is a, c, g, or t
  misc_feature (446)..(446): n is a, c, g, or t
  misc_feature (500)..(500): n is a, c, g, or t
  misc_feature (726)..(726): n is a, c, g, or t
cccggtcannaatnnatatagccgtgatctatacgtaattnatttattatatagtattnattatatgtaataaacgtattagtcaaccatanacatcaatcntcataccaagacgccctgatcgcatcatccactcacatacgtcttctacatacatataccacacatactttancgttccctacaccgtantccaccncatatacaacaaatactatntatactcacnacgcatcacacngccaacanataatcatcncacaancacanacacctacaccnagtcatcccacccncagtatcatatacatcgttctcgccggtactcatcccacgcgtccaatcacacgtgggtacattataagtcctactcantccgctaaattctaaataaaanatgacaataatantataataagatataatataaataacagcatcaatantgtaaaataatatatatatatatattatttttgcttcacaccgaatctactatntaatcatatttacaccatgtttaggtcagcggttacactcccgtctatatgattttaatgtagggctacgtctcatatcgttcggtcgcatctttttcctacaatgtacttgcgagttgcctgggttatgtggcgtgcccgcctacacaccaactcgagtgttcccacgcggagcgtggcgcgccacgcgcgcggtagttccggcccttcgatgcgtccgtacgtngatcgtgcacccgcgcgtgattatgagtatttaggatgactaactccacgaacttacccagtaggcacgccgagccctccccgccctctccttacaatctcccttccttagctctcgtgcgtcgtgcttctcgttccgtcggtcgtccctcttcactttactttcgagacttgattctgcctctcgttgtgggtgcgtcgcgtgtgtgcggggttcgaggtatgtgtgtgctcagtttgcgctatgagcgcagagagatctgacgctaatgtgcgtcggtacggctctcgctaggctgtagcgcattacgccgcgcatcatggagctccgttgacctcggcggtaccgatctctacgtcgatcggcagcagcaccaggtacacctcggcatgtagtgagatgctcgatagtatgtgttctcgtgcttcgtcgtcggttaggacaggacgagatggataaaggcaccacggcgtcgtgtcggtgaggttacggtcatagcgcagtgtcctagcctggtgatatgtagcatgtaacttgtctgttcattacgccgtacgtttgtagacgcgtcttacatcgcggttgtccgtcgtctctgtaggcgcgatagcgggcgccgt

SEQ ID NO: 582561 - DNA, 253 bp, Homo sapiens
  misc_feature (248)..(248): n is a, c, g, or t
atgaccactccttccagtccctcacctattggctttattcagggcagaggctctttcttccggctggtcagtacaaagaggcaggattcttcaccgggatctggggattctcaaagaattgggggagagaattcagggcatggatgacctgggatgaagagaaatttacatctttatttacactaaccttcaggtgaaatttagcattttgggccatttaaaaataggggcaaaaaaggggggggcgnggggt

SEQ ID NO: 582562 - DNA, 249 bp, Homo sapiens
ggtcgacgtctagagtatcccccctcctgagtagctgggattacaggcatgcgccaccacacccagctaattttgtatttttaatagagttgggttttctccatgttggtcaggctgtcttgaactcccgacctcaggtgatccgcctgcctcggcttcccaaagtgctgtgattacaggcatgagccatcatgcctggcctacctggaggtcttaaatatccttgagacagaggtgggaggagaggaa

SEQ ID NO: 582563 - DNA, 928 bp, Homo sapiens
  misc_feature (34)..(34): n is a, c, g, or t
  misc_feature (79)..(79): n is a, c, g, or t
  misc_feature (87)..(87): n is a, c, g, or t
  misc_feature (89)..(89): n is a, c, g, or t
  misc_feature (105)..(105): n is a, c, g, or t
  misc_feature (115)..(117): n is a, c, g, or t
  misc_feature (119)..(119): n is a, c, g, or t
  misc_feature (125)..(125): n is a, c, g, or t
  misc_feature (136)..(136): n is a, c, g, or t
  misc_feature (141)..(141): n is a, c, g, or t
  misc_feature (149)..(149): n is a, c, g, or t
  misc_feature (154)..(154): n is a, c, g, or t
  misc_feature (156)..(156): n is a, c, g, or t
  misc_feature (165)..(165): n is a, c, g, or t
  misc_feature (169)..(169): n is a, c, g, or t
  misc_feature (171)..(171): n is a, c, g, or t
  misc_feature (175)..(175): n is a, c, g, or t
  misc_feature (202)..(203): n is a, c, g, or t
  misc_feature (220)..(222): n is a, c, g, or t
  misc_feature (230)..(230): n is a, c, g, or t
  misc_feature (239)..(239): n is a, c, g, or t
  misc_feature (272)..(272): n is a, c, g, or t
  misc_feature (334)..(334): n is a, c, g, or t
  misc_feature (413)..(413): n is a, c, g, or t
  misc_feature (417)..(417): n is a, c, g, or t
  misc_feature (423)..(423): n is a, c, g, or t
  misc_feature (427)..(427): n is a, c, g, or t
  misc_feature (431)..(431): n is a, c, g, or t
  misc_feature (688)..(688): n is a, c, g, or t
  misc_feature (861)..(861): n is a, c, g, or t
  misc_feature (903)..(903): n is a, c, g, or t
tatacatattaatactcctgaatagtttcccaanttctggggcacttagggagcaaaagcaaatgtttcaatttttgtntacaaaantntactttaccaattgcngaagacaaannntncataantctggcgactnaaacnctcaaagnctcancnccttttccnatancnaatnctcccaaccttgttttgactattttgnncaataaaattgggtttnnntgtttgtnttgaatttnatgaagtatcagcctgttcattaaaattttganagttcttagtccagtggtatgatcttgaagttatcaggaacttgtattcaagagtccttgtnagagtcttttcataaatctccttgaacaaaaagcaattttggactgtagctgatggtaaatactttgaggaagaatganagcnactgtntgcnagtnttcctgaaatacagaaatgacatcacggctgctataatggattaaggccaggaagatgtcctgttcctgaaggagcagagactttgactgttatggatttggagctttccatgccagtggctgagttacgaacagagcaagcatagagcccgctatgctttgtagtaatctgggggataaagagcttttgtcctgatagctgaaacttcccattaattgtccaagaatattctgctggtgggttagagtccgcgaanaggacaaagtagaggttttctcctgaatggtaataggtgaatgaagggtaaattctggggaggtctggaccatagaggacattcagggtgactgggtaactgcggatgccaccatatcggtcctgtatttcacattgatagggtcctgtttcatttctcgtgacactgggtanaatgaggatcctgttttcaatggggtcgctttaccctgggantgaacggggaggctctgaacattta

SEQ ID NO: 582564 - DNA, 989 bp, Homo sapiens
gtctccagcccacacttccaggtgggagagcgagctctgctattactggaaataatgaatgacatcatgagtctagaatcagtgacaacgcagtgaagattctgcccattcatgtttccttcctgtaccgcagctcaaagagccatggaacaagacaatacatggctgatatagcagagcgccccggagagcatcttcaatggagagtgaaccagaagctattatgatgactgtacacatacaggttcaaagcaagagagactaataagagaagctaaaaatgaaagaacgggaagaagcatgggcttaaaatagaaaatctagccaaagccaatccccaggcgcagacacagatccgaagaaggaccgtcctcttgcagcgccgcaagtccgacgctggctcaggacccccacagcaagaaaggcttggaagctcagctgctaggcccgatgagctggctcccaggacggccgctagtctccggggggccgcgtcggggcgggcgtcgactagattcttgttccggattctgtgagaaaatacatacttgctgtgtcataccaatcagttacatctcaaaagctttcttggaacccgttccgtaggacaataacgtgcgtggcggctcagtgcgagaatgagggaggtacaaaacacaagggtggacgtttcccaagagccccgccggcagagcccgcggggttgaccgacggggtgtccatctggatgggcgcgtcagcccatgcgataggtcaagtcagagacattcgccgaacgtccagaggaaaggaaagcacctggcatcactctagggctccgaagggagtaggacctgtacagaggggctggaacacccgcggtccaccaccgacgccaaacgtgggcaaatgagagttaggatgaaggagcaggagaacagaggccggcgcgggaaccaacgaaaggcgggcagaccaaggagaaccaaggagaagagaccagaaacaga

SEQ ID NO: 582565 - DNA, 120 bp, Homo sapiens
gccatccagactgaggaagacccggaaacttaggggcacgtagcacggccacgcctagaggaaggacctgaaggaccctgcggcctcggtaatctggtgcttcataccacggactacact

SEQ ID NO: 582566 - DNA, 229 bp, Homo sapiens
acaaactggtggacttgctgctgatccatgaagtcctaacccctgtgtgctggatgcgttcccctgctctcaacatatagttgggcgcctcaatgcccgggccaagctcaaaggcttcctggcctccgctggaaatacattttcctcatttataccaactattaagcgggcaaggatgactattttaaggcactgcccgggcaactgaagccttttgagaacctgctgt

SEQ ID NO: 582567 - DNA, 453 bp, Homo sapiens
  misc_feature (12)..(12): n is a, c, g, or t
  misc_feature (41)..(41): n is a, c, g, or t
  misc_feature (51)..(52): n is a, c, g, or t
  misc_feature (58)..(58): n is a, c, g, or t
  misc_feature (68)..(68): n is a, c, g, or t
  misc_feature (85)..(85): n is a, c, g, or t
  misc_feature (215)..(215): n is a, c, g, or t
  misc_feature (259)..(259): n is a, c, g, or t
ccagcgtgccanttccagcgcccgcgtccccgcagcatgcngcgcccccgnntgctgncgcgctgtgnggcgcatgcatcatgcnccccagcctcctcgtcgccctggatatctgttccaaaaaccccatgccacaacggtggtttatgcgaggagatttccaagaagtgcgaggagatgtcttcccctcgtacacctgcacgtgccttaagggntacgcgggcaaccactgtgagacgaaatgtgtcgagccactggncatggagaatgggaacattgccaactcacagatcgccgcctcatctgtgcgtgtgaccttcttgggtttgcagcattgggtccctggtactggcccgcctgatccgtcgcagtgcatggtcaatgcctggacacccagctagcaatgacgatcacccctgagatccaggctgaaccatgctgcggaaggatgtg

SEQ ID NO: 582568 - DNA, 204 bp, Homo sapiens
tctagaggatcccgtaggtcgatcactgtactatagcctgggcaacgagagcagactctcccccaaaaaacaaaaatctgctgtccagccagtacattatttatttcagacatgtaatttctatctgttgatatccagttggagtttttttatatcttccgtatctgtaaggaactttgggaacgtatggagtacagtgatcga

SEQ ID NO: 582569 - DNA, 295 bp, Homo sapiens
attgaatgaactgtttcaaggaattactcaatttaatgcagtggccaggtgcagtggctcacgcctgtaatcccagtactttgggaaggattgaacacctgaggtcaggagttcaagaccaccctggccaatatggggaaactttgtctctactaaaaatacaaaaatttgccaggccagctattcgggaggctgagacagcagaattgcttgaacctgggaggcagagtttgcagtgagctgagattgcaccactgcactccagcctgggcgacagagcaaagtagaacagcta

SEQ ID NO: 582570 - DNA, 442 bp, Homo sapiens
accaaaggctcccccagtgtccacatgaagaataaggtggaggagcacttgttcttctgcagctctgctactgtaactgatgcagcactatatctcagaggggtccatagaagctgacgagacatttttggggaaattaaagcacatgttactccgacttatagacgacataatgaatctatgcaattcaccgcagtgattaaaaggccggctaataatatacaggagccatagttgcgtatataagtcacatatcatccgtccaccgcctgttataaccggttataaacacgaggggttagcctgttaaactctagccactgaggccatatcacatttccacttctgatcaggctacctattaatcccgtctttcagaaagatcatcctggcattagcgttccaagtcgactggagacgttgaatagatcaagagcaacga

SEQ ID NO: 582571 - DNA, 265 bp, Homo sapiens
  misc_feature (4)..(4): n is a, c, g, or t
  misc_feature (33)..(33): n is a, c, g, or t
  misc_feature (98)..(98): n is a, c, g, or t
  misc_feature (125)..(125): n is a, c, g, or t
  misc_feature (260)..(260): n is a, c, g, or t
ggancggaggccaaagaggggaaaagggcagancccgggagcctgatgaaaagttcctgatactttctgttctccagtgccatttctctccttcttcntggttcacatatatgcttaatgcacantcatgtgcctacgtcctgcctcgcaatgagggagcatttaccccagtacacccatgaaactgcggcagcattttgacttattgctgttttcagctttaaaggttgtggtgtttttgtttttgattatgttgcttnttaac

SEQ ID NO: 582572 - DNA, 120 bp, Homo sapiens
ttgcattgtgcggccctttgggtaactccccaaccccactcccaaggagcccccttgctccttcagttccctccaacactggcgctcccacccctctgctggcctcagtttgtccaaacc

SEQ ID NO: 582573 - DNA, 271 bp, Homo sapiens
tacatagctcttattagttacacggcgcgcaatcttgcccgaagaagtgcggttgatttcccctggggccttccacacgatgtcatctggggtaattccatcatgcgaggtaacggcggtgcggatggccgcggatgcctctgcatcgccagctggttgcgcatcatcggcgcgctccaccaacaatacgagagattcagagtccttgccttccacagagaaagcggcgacggagtccggccgcacctgggtggacgctgcttgtcgacgc

SEQ ID NO: 582574 - DNA, 523 bp, Homo sapiens
tccaaacagtgccatatttattcacacaaaactactgaacagtaaaaatatgaaatatcattagtacagtgaagaaataatgtgttcactgtaactaatcagcacagtagcattaccagaatacctgtatcagatattaacagcaagaacagacaacaggctttcagtctccacctctgatgctgtgttttgattaaaaggttactgtacattgtatttcttttaggtgagaagaaagcttagaagcatttgaggaccaggaagtgggtcctctagtgatgaggaggtattctgctagatggctttttaaaatgttttccccagtgtcatctgcctcattaacaatggtttttgtcttagaggtctctctttgattttataaactgacatgatttcttgttctgttatgaatgcacaatgctttagtccttcagtaagcccatcacacatttttaccatgtcatgcataggcactgtttggactctgggcactgtttggactctgagcactgtttggactctg

SEQ ID NO: 582575 - DNA, 354 bp, Homo sapiens
gagtcggcccaactatggtctcagcttcccagagtgctaggattataggtgtagccactgcaccaggcctacacgtggtttctcccttggaagtactagccaggcctgaccatgcttagcttccgagatagcaggttccagccggtgcagcctcagatgcagcatgttttaggtctttgaacatatttaaatgagctgactgaacgtctttgtctagcaattgcagcatcgggctggtcccattggtgacttttcccgtgtctgggtcgtcctttcggtttcctttccatgtctcataatttgttaaaacctggacatttcacgggcgataatgtggcaactccggaagtcaga

SEQ ID NO: 582576 - DNA, 592 bp, Homo sapiens
gcccgccccattaatgatggtgtcaagtctaagacgcttgatgtgtcctgaaccagcggttgatgttctgcggctctcaaaatgtggcctgcaaaacgagagatatagttctagtgagaggcgtcattttcccacacggatacattgaccggcccctgaggggtcatagttatccatgtattggcggtattaaacttccactccgtcctctcgaggggggtggtcatccccgaggcctgaagccggggatctagcccgagctgagccccacgcagtttttttgcagaggaatggggtcaatacaagaggctacgcaccccgataagtagtttgtgctcggcccatttcggaatttggacatctgttggaagcaacatttgaatcctcccaaaggggctttcctcccttcacagggtcgcctggaattaagtgacgtctcctttacaaaggagactcttaaaattaggagggagtatttctcgcgccctgatgtcactgacagcaaaattctcgcccgaagcaaaacgtgttctaaccaaatgtatgcgggggcaaaaatccaaaaaaggaaggaccccgctcaaacatgaca

SEQ ID NO: 582577 - DNA, 833 bp, Homo sapiens
tcctggtgcatcttcaaaatgagtcctaagagaacatactgagtacttagaagtagaagaacataagatgtatttctgagctaaaacaaatggctctttcacatgtggctttattagactctgggagagcaacaattaaccaagctgcttcaggaaccaggtgtttgagctatttaattcttcacggtaagacaaatgaagtcctaattgaacgtgtttctcccaaggtttgtaaaacatgtcaagagttattctgtctgtttaaatgacataagaaacctccttaagcaatagaatttcgctgggttttctttgttaaaaacataatactgtgcaggcaaggcactgtgaaagttttaattccttccaggaagaaccagtggaagaattctacagatgggcgctacgatcaaagactactgtaacttagtagaaataatgatgtctaaagcttaccatacaaaagaaccctcagcagaataacaaaaactttgcctcaggacatttgaggtcaattgaagacggaaaaccggaaacccgttttcttgtaagcccctagaggcagatcaggtaaagccatacattagtaggaggggaacgggagaggaactggcacataacactcaagtatttatgcaagatttatgccctttatgttctaagcatcttctaaggttcggggtctttcagggctggcttgcgtggtattaggatctgtgctaggcctaataactgggatttcagtctgtataattaaagctaaataaatccttttccttggggatatctatcctttgccttttgttgtttaaaacttcacccttccaaaaaca

SEQ ID NO: 582578 - DNA, 331 bp, Homo sapiens
  misc_feature (311)..(311): n is a, c, g, or t
tgagacagagtcttgctctgtcacccaggctggagtgcagtggcgcgatctcggctcactgcaacctccacctcccaggttcaagcaattgttgtacctcagcctcccaagtagctgggactataggcatacaccatcacacccagctaatttttgtatttttagtagaaactttagtaggttttagtaggcttagtaggttttgccatgtttgcccggctggtctccaactcctggactcatgtggtctgcccaccttggcctcccgtgctgggattacaagcatgaccactgcatccagtcttggcggngaagatcctgtcattaccct

SEQ ID NO: 582579 - DNA, 540 bp, Homo sapiens
tccccatgcactagttgatctggattagcagtgagcaagactctgtgggtgtgggacctgctgagccaggcgtggaatataatctcctggtgtgccatttgctaagacctttggaaaagtgcagtatttaggtggcagtgtcccgattttcccggtacagtctgtcacagcttcccttaactaggaaagggaaatcccccgaccccttgctcttccttggtgaggtgatgccccaccctgcttcggctcaccttccatgggctgcacccactttctgaccagttccaatgagatgaaacaggtacctcagttggaaatgcagaaatcacctgtcttctgcgtcgatcacgctgggagctgcagaccggagctgttcctatttggccatcttggaacagaagcctttttttctttttttagacggagtttcactcttgtcacccaagctggagtgcaatggcacaatcttggctcacctccttgcaacctccacttcctgggtaaatttttggtattttttgtagagacagagttttatca

SEQ ID NO: 582580 - DNA, 1573 bp, Homo sapiens
taggtaaaatcttttttttccaaaaaaaaaaaacccccaaaaaccacaaattttcccacccacccacggggagggagatatggggtaggggagagaggtgtgtgcctggcccacccacgcccgggcccccagcccacggtggttttcggcgccgcaacaaaggggtgaatggggcgtaatgggcccaaaaaattaaacggtggcatgcgggggtggtgatatgtgggagaggagacagaggggagcgacaaaccgccgtgtaggagcgagacgcggcgaacgaaggagagacaaccgcgccgaccaaaccagcgcgcgcgcacacacaaacccgcggcgaaaccgccgcacagcggcgcgaccggcgcgcacacaattacgccacaacaaaggcaccaacactactgcgatgagagagacaaaaaccaagaccagcacgcggggcggcgaacaacaccgtagcatggagcggcccccacacaccagagaggcacaacactagcagcgcgctccgcaggcagagcaaacgacaccgcgcgcggacagcacaagacggcagccaacacgagggaaacaggggagtggagcggccccccaccacagcgggggggaccaaccactgagcaggtcaacacaggaagaagaaacacccagcggagagaataaaaatacatccaccccaacaacacggagaggacaagaaccgacgcgcacgactcccgccggaggacagcgaccgggacaacacaaaacgacggcgagccccccccaagcaggaccaaacgcgccaacatccccgcgatacacacaacacgctggaagaacacgacggacactagtaggaagcaccacgagggcgggaacacccgacccacagcaaccgatggtgccctgaataagagaccaagcacacaaaacgcgcgggtgcaaccccaggagggaacagagagatggacaaccagcaagcacacgcagagcgcggaacagccccaagccgccaccccagaaacagcagggtagagcccgaacactctagggctgatacaccatgagagtcatgacttcacccacacttatccgcgactagacaccctccgagtcctacaaaagcaaatcggtgtgtgctatagtacgtccctagtagaccaattgaaccaacgcggggggacagtgaaccgcgcttgctttgtctcgcgacccccctctctgagtggctcgacacgttttctcccattcgtctgaccgaatagatggggcctacgaggacacacgcgacacgagggggctagtaccaagaggcccccaacaagaagagaccctccagggggacaccggcacatcagaccaaaggggacgcacacgaagaacacacgaataacagagacaagagacccaaacacccctggagcgagacaacgccactagaagtcaacaagtggcgacagctagagccagcccgtccaccaaaagaaagggaacaacgacgacacagcccgcggaggcgcacagaaggcacacgacacacaaagagagagcggcgagaccacacgtaccacgagcatccaagcgagcg

SEQ ID NO: 582581 - DNA, 729 bp, Homo sapiens
ttttttttttgtttttggaaatggaatttttatcccaaaggactaatatctagaaagggcagtagctaacactcaaaacaattggtttaagtgtaaattaaaagcagtggattggcaggagagcaaacaggggggtagtgggcctagggcactcggatctagggtttattatccaagaaaagctataaaataaccaatggtgcctggattatgcaatctgggtatgtgcagctatttacagcaaaaaaaaaaaaaaaaaaaaaaaaaaaaaagaaaaaaaaaaaaaagaaaaagaaaaacaaaaaaaaaaaaaacaaacaaacaaaaacaacaaaacaaacacaacaaagaacaagaacacaaaaaagaagagagagagagaggggcgcgacgcggaaacacactatatcgacgcctcgcgcgaggggaagccacgcaccagaccgctcgccgcacccacgactggatcccaggaaaaagacgcaaggaccgccaaccacacgaaacagagtaccgacgaggacatacaacaacacctcacacgcgacaacaagccccccgggcaccgccttaaaactaaccctcaacgcacgcgcgctacgccacgccgagcgacaacccaacacggggacccacacactcccaaagccccacgcgggaaaagcaacaacacccacccaaaacctcacgcgccaggaccagaacacaaacaaacacgcacaaccccac

SEQ ID NO: 582582 - DNA, 288 bp, Homo sapiens
acgcgcacgcggtccaagtgatgttggatgtaaagtgaaatattagttggcggataaagcagatagtgatggaaagttgagccaataatgacgtgagtccgtggaagcctgtggatacaaaaaatgttgagccgtagatgccggtcgcaaatggtgaagggagactcgaagtactctagaggcttgtagagagggtaaaatcagagacccagtcaaaattgtaaatagggcagtgcttgcaattatattgggtatacgggtggtatatctaataagactaatggagag

SEQ ID NO: 582583 - DNA, 392 bp, Homo sapiens
  misc_feature (3)..(3): n is a, c, g, or t
ggntcgacatcccagctactcgggaggctgaggcaggagaatcgcttgaatccgggaggtggaggttgcagtgaaccgagatcatgctattgtactccagcctgggcgacaagagcagcctgggcgacaagagcaagactccatctccaaaaatatatatatatacacatagagagaaacgttatagtgaaaaaaggggcccgttacagcggctcatccccataatcccagcatttgggtggctgaggccagcggatcacttgagctcaggagttcaagaccagcctgggcgacatagcaaaaccctgtctctacaaaaaatacaaaaattagccgggcatggtggcacacttgtagtgccagctactggagaggttgaggtaggaggatgg

SEQ ID NO: 582584 - DNA, 296 bp, Homo sapiens
cacgaggcccgccgccgccgcgctcgcccccgcctgatccgaccccgccgctgcggtatcctcgccccatggaacgcgccgaactgctcgcccagcttcaggccctcaccgcccgggtcgacgagctcgccgaccgcgtgcgccgtctgcaggacgagaaccgcagcctgcgccagcagcaggagcagctcgtgatcgaacgctccgcgctgctggcgaagaacgagcaggcgcgcagtctcgtggaggcgatgatcgcccgcctgatatcgctggagcagcatacatgaccgcga

SEQ ID NO: 582585 - DNA, 256 bp, Homo sapiens
gagactcatggaaacagacgataatacaaaccagtatgtaccgagcaggaaagacatccatgacatagtgctcaataaaagtacaaaaggagattataaaacagccagtatagatgtgtatatgaagtatggggaaaatgttcaccacgcgtaacagtatgggctcatggagaatggcggattcgcaggtgatattttcttacttttttgtacgtgctctatatttccaggtgtgcatccatatttgacgtgcggg

SEQ ID NO: 582586 - DNA, 323 bp, Homo sapiens
caggccttcgcctgccttccaggggcaagccttccaaccaagggttcctcctggtcagccccagccaggccgttaggagggctcccctttttaggtggaacgccttaaactggagcctcccgaaggggtggtggtccgctttccctacgcgggctgaattcagcctgacatgggccccctacccttttccttttctttccagggcctttgggttttgatttttttttttttttaaaaccaacaaaccaactgttgcagattttgagttaaccccccaatagggtgttttttgccttccaattaaagtcccccctgcatggtta

SEQ ID NO: 582587 - DNA, 115 bp, Homo sapiens
cacgtctaggatttatgtcgttgaaaacaagaaccatttacatagcgctgctccatcgggatgtcctgattccatatatcgagttcgtataccctattgttgatatggatcatgc

SEQ ID NO: 582588 - DNA, 145 bp, Homo sapiens
  misc_feature (130)..(130): n is a, c, g, or t
gggaagttatggacaggaacttaggttgcccttacccccttcccagacctttttccttttctttgacttacagagcaccattcaggcaaaattaggagcgcaaatggtttttcttccaatcttaagcagntatacctttcacagg

SEQ ID NO: 582589 - DNA, 220 bp, Homo sapiens
  misc_feature (31)..(31): n is a, c, g, or t
  misc_feature (57)..(57): n is a, c, g, or t
  misc_feature (83)..(83): n is a, c, g, or t
  misc_feature (101)..(101): n is a, c, g, or t
aagcacgtgctgctgctcgaggaggagatcngcgagccgctgttcgaacgcctgccncgcgggcatggctgacccggccggcnagatcctgctggcccacntgcgcaggacgatgtcggagtaccggcaggtcgaggccgagatccgcaatctcaacacgctgcagaagggcgaggtgatcatcgcgacggtgaccggccttgccaccggcatccgtcta

SEQ ID NO: 582590 - DNA, 226 bp, Homo sapiens
ttgctgtcttatttacttactacttatgtgtcagtctagtatatgcatgaagtagtttctgagttccaatctatgaaacacctttactggattatagcctttatattcaggccagatgcagttttccaagcttcttaggttatattcgtgtttttcccattcccttcagtgtggttatattggtcattcggagtgcatgtgtttggtggtgcaccaaagccacaca

SEQ ID NO: 582591 - DNA, 796 bp, Homo sapiens
gccgggggggccatctcttctggccgtgcttgtctctgggccacttggagtgtgtgatacaatcagtcaagctgttgaagtctcaggagtcgtctggtagcctgcagaagtaagacctcatcatcatgagcctttcctcaaaactggagtacccaaatgtcatcaggttcgtgttagtaattaacagctcacataagaacccctctgtctttgaactctagaatgtgggctatggatcagatctaagcatcttgagatacgtctgggcggtctaggagccgttcaggccttaagtggaaggttggatccaaggaggggtgtaatggagcagtcaagccaactcggcggcagaatggagctataactaaggcatcctgtgagggttcgtggctcgtccaggcatgttaagccctcacattgagatctagttactgtggtatggctaataccgtgtcaacatgtggaggcgatcctaccttgcttatggggttgctagagcttagcagtatctggatcgtgtcaggccatacttatcagtgttccacttggtggtactataagaagctttctgagcagccctaagctccaggggggacaaatatgtggccccatcgaatagcagcccctagtcacatacaagagaacctagccagctgtccgggcagaatgcgtctctgctggagtagaaatggtggcactgggttgtgaagaggtaattacttgacacagaatccaagaaaaacagaaaggatgactggagcggtctcatagcgtgagcaattccctaaacatcgag

SEQ ID NO: 582592 - DNA, 945 bp, Homo sapiens
gtcccctaggactgggggcccccgggttgcctgggcggtccacttgtgttttttttttccagcagaagatcaataaattctgaatacagtgctagagatcccaattctacatgctaccaaggacagcacgccaattgatatactcccgaatctagttaactgtagcatctaaaatacgaaaagctgatcatagaagaactttcttaagtgacataatgtgaatatctaacccggagaggctaaaccacacaactatggatattcatatttgatcttggctcctaattgcttggccagataaaatagccaggtccacccccattcagtagaattggacaggacccaatgtatatggtagatggttcacagtaagtttcacacagcctaggagcagcaagaaatgtgacaaatagtgtgcggattaagctgctcctcaagacagtcattcatcacctttgtgaacatggaaacaccaacataagtcaaggtctgaatattcccatctgtgataacgagctaagtaccacgtacgcagtatggttcataaatcatcattactgaaggatatttcaagaacacagaaggtggggctaaatcaatgatagaaaccatgcagttcatcaattccagagaatcgacaatgcagggttcatatatcctttttaaaaatctgagatcattattataaaactagctctatacattctctaggcgttcaaatcttaatcttagcttgaaatgattacccttaagtcagttggctttaggcctttggcgattgctcaatataattatggaattattaggatgcagcatcttcaggtaagtgacagttatgttttaagaagagatcatttaaaaaatgatcctagaaatacactgctctgatatgtctaatgtataccccccaaatgtgtcagtgtccatataagctagagtaaattt

SEQ ID NO: 582593 - DNA, 250 bp, Homo sapiens
  misc_feature (121)..(121): n is a, c, g, or t
gcattaattctccttctgtaatgacacttatactataaaacttgtattatggtttcagtaaagatatctttttcttctagatcagtgctatacataagtacgtgagacacatacataattntatgttttctagtagtcattatttttaaaaagtaaaattgattttgtaatatattatttaaccccaatatatcgaaattttttttaaagacataaaccatataaaaattattgggcgtacggggagttt

SEQ ID NO: 582594 - DNA, 204 bp, Homo sapiens
  misc_feature (110)..(111): n is a, c, g, or t
  misc_feature (168)..(168): n is a, c, g, or t
gtatgtacagtacagcacgacacctagcgccacaatgtggtttgcccccttgcgagatagcagggcggcccaaattaggcaggcataattcccgaacggaaccccacccnnatccactgggccggggtgtacagcaaggtaataaatacctaacccgacaataatgtnggccgcgcgcccggccaacttagtggaggttggcaa

SEQ ID NO: 582595 - DNA, 101 bp, Homo sapiens
aggtggtctagaggatccctgcggtgagcatcctccacttcagcctccttgtgagttcaggccatcctcccacctcagcctccttggtagctggaactaca

SEQ ID NO: 582596 - DNA, 295 bp, Homo sapiens
tttcctttctttctctttccattcatcccacattgttttctaaagttgtctcaaaacatttgccaatggcctagtgtttccccatgggttttattttcctgagagcatgtccaaccaaaatgggatcattacccacccccccaattagggcctgttggggggcctggctcaaaaaagtctgctgccttgctccaaagcaaaaagccccctcccctttcttggacaggacacccccgtttttttcccacctgactgattttgggcaaatttcttcctctttccaaatgccacgttc

SEQ ID NO: 582597 - DNA, 319 bp, Homo sapiens
aagcgccttctccgcaccacggaaggcccacccaccagaagccaggatgtacagccacgcgggaccacagccacgagcaccaggaaggcggcttgttgggtaagtgggaggttagatggtaagctgtaaaaattgacaaggggtgggtcagctgtgaaaactctttggatgattctgccaaaaggtacttctggaaaatacaaatatgtggagaattttggtctattgatggtcgcctacatctgtacatctctgtttctttgcatagtgctttgattgggatatatgcaccctttcagagtcaaccgttttgcttgtg

SEQ ID NO: 582598 - DNA, 144 bp, Homo sapiens
tataaagcttgtttaattataatggcatgatctatgtaatcacagaggccattatgtacagacgaagtgggaggtatatttcttggatctgcttcctccttggataaagtcttgatgatcacctccttcttggccttatctgcg

SEQ ID NO: 582599 - DNA, 394 bp, Homo sapiens
  misc_feature (268)..(268): n is a, c, g, or t
  misc_feature (271)..(271): n is a, c, g, or t
  misc_feature (273)..(276): n is a, c, g, or t
  misc_feature (282)..(283): n is a, c, g, or t
ggcggcataaggttcatcccattctccttttcagccaactgaccacaccgccgaggaccggcacgtgttcatacagcagcgcacccgcgtcgaaataatcccgatggtggtacaccttgtcgcgccacagcagatgcgagcagcgctcgtcttacgaggcgatcctgcaagccaaccgccaaccgggcaacctgtacaatccgacgcagacaccgcggccgaccaacacctatttcggcagcgatattcacgacccgcgtgttgtcancangnnnngcatannaggtcattccctgagtcagacatgcctctttgactaccgtgtgccagtgctggtgattctcacacacctccatccgctctttgtggaaaaactggcacttttctggaacta

SEQ ID NO: 582600 - DNA, 397 bp, Homo sapiens
tcacagaagggacatttgaaattgactcggacaagagggtgactggctttttttttttaatttggaatctttctaatggaaagggcaagggaagagaccacccagaagagctccctccagggacagggctcggggctcggcccccgctcggcccggcagagctgtgtgcgggggacaggtggcatggatctcggtcgggtcattggtggacgggataatgagatcggctgaggaagagggtggaggcggtggtcggggcagataagggtgtcgcccaggggccattagcggggcagccgtttagggggcacggacggtgtgctaggtaaggtcctaagtggttaatatctatggatccatggagaccctacaatggccatcaggggaggatcactgg

SEQ ID NO: 582601 - DNA, 222 bp, Homo sapiens
ccattcgtggcctcaagctgggcgccatcgccgagatgcgcaagattgccgcttcgcgcaatttcagtttctgcatcgcgcaccgcgccaagccgatctacgtcgccttgctcgccacgcgcttgcaggtgattggtgtgcaccacgcgtttggtgattactggtgattctcacacacctccatccgctctttgtggaaaaactggcacttttctggaacta

SEQ ID NO: 582602 - DNA, 111 bp, Homo sapiens
actagtccaggttggtgagcgggagatgccagccagacagtggacgatgactggctggctggagagcttggctttatcgatgaactcgataaagccaagccggggactagg

SEQ ID NO: 582603 - DNA, 436 bp, Homo sapiens
gagacatggccgacttcataacagcttcttagatggcttcattgtttgcagccttgccactccagtcagccagtgcgctggcctgcagggtccgtccataagagttccttagtttccatggctttggtagagggcacaggttgacagcattaaggtttagagtggcatcctcttcactcatgccaccatgcacacagcagatgccaggagcagctgcaggcgctgtacggtggagagctgttacggtgcccatagctacttgttctggagtatacttcttggtgcaggcatgtccatgcagtcaccatgttgggctttagcagggtgccctccaggtagacataatggtcattcaggtccttgtagacttctagccaggaccttctcagtcacatactgtcagtgttgcaaatcatggtgtcaaacggggattacc

SEQ ID NO: 582604 - DNA, 690 bp, Homo sapiens
  misc_feature (324)..(324): n is a, c, g, or t
agagctgagctcagatgacacttgctcaggaaaggcctctctcctcttctactcctctgtgagaccttcccctgggtcccggctcactcatgactctactttccaaatcacaccgggtgctgtgcctctgtctcagtgcactcaactccagctggcctatgggtctgctccacagcaggctccacttagaaggacacggagctgaggaaggagggcagggccaggttactacacaacctccaatgccgaggcaatgccttcagactttgtcttggtggcaatataaagttatgggagcgtgtgtgcagaatcagaactgttttntggttgggggagacagcctcactctgtctttgggataaaattaaaacctgtaacaggtctatggggcctcgcagggtctcggccctgctcattgcacacggcgccttcctccccggcttcagccccaccagcccttcccagttccatggagcatccgctccttcctgccctgggtgcttggcacatcctggcctttctgcctgaagcagctgccaggcagcttccggctccgtgtctccacctgcctcaaccagttaatgcatactcatcccacaggtcttcacttagcatcgtgagctcacaaagccttccccaacaacagaatccatcaaaggtcactcaggcccgggaatttggcaagcatta

SEQ ID NO: 582605 - DNA, 198 bp, Homo sapiens
gtgcagacatcactgagcagatatcgctcgagcactattgggagcgctgaaacaccgtgacctgattaccgattctcacgcgcagtaccaaaagtcgatggtatgattcgtatgcctgtgagtcctcatagctgagcacataatgtaagtgagaacatacagggttcggtttccagttcctgagttagttagacgcgt

SEQ ID NO: 582606 - DNA, 455 bp, Homo sapiens
  misc_feature (346)..(346): n is a, c, g, or t
  misc_feature (368)..(368): n is a, c, g, or t
  misc_feature (378)..(378): n is a, c, g, or t
  misc_feature (390)..(390): n is a, c, g, or t
caccacgcaaaaattgtttgcctggcctggtccccagccaatgaacactttgcctccggtggcatggacatgatggtgtatgtttggaccctgagtgacccggaaaccagagtcaagatccaagatgcaccccggttgccccatgtcagcagcctggccgggctggacgagcccccgctggtcccgccctcccatgatgcctctgtcaaggagtggccaatccccttctgaggagccccccccccgcctttggatgggccgaatcagggactagagtttaactgcagcggaacatgtcatttttctatttttgtgacgggcccccatgcccccccccccccccaanaggcaggagggcccagtcatgncccttgtctntgcagggggtcnggacccgtttttttgaaagctttagccagtaccagtttgcccatgaaaaataaagcgggccccta

SEQ ID NO: 582607 - DNA, 379 bp, Homo sapiens
  misc_feature (19)..(19): n is a, c, g, or t
  misc_feature (49)..(49): n is a, c, g, or t
  misc_feature (67)..(67): n is a, c, g, or t
  misc_feature (112)..(112): n is a, c, g, or t
  misc_feature (117)..(117): n is a, c, g, or t
  misc_feature (230)..(231): n is a, c, g, or t
ttattaaaggagtgggtgntacagtaacttgaggcacatccacagattncttagaaataaaagatgnactaatagtataattttaacatgtttattggcagcttattttacnggaantcaattaatagagtatatagaagctagattttctattgcagacggagtatttggaaggattttttatttatctacgggatttcacggaattcatgtcttgtgtggtggtttgnncttagcatttaattttttacgtcttctaaaaaatcattttaattataatcatcatctggggttggaatttgctattttatattgacattttgttgatgtagtgtgattatttttatttgtgtttgtttattgatgatcttactaatat

SEQ ID NO: 582608 - DNA, 912 bp, Homo sapiens
atcgccctgctgggctttgaaaagcgcttcgtacccagccagcactatgtagccatgttcctggtgaacatggcgacggacctgtcggagaagagtggtctaccggcgcttcaccgagatctactgaagttccataaaaccttaaaagaaatgtgccctatggaggcaggggcgatcaattccagagaacaggatcatgctcctcgaagcttcctcgagcgtcaccaagtggtttgacgaggcaagcgtggccgccgaggaatctaaccagggcatgacattatcgaggtactgcgggaacgctcatgagccatgcccaccataggatctcccgctgtccccaccatcccttgatgtgcttcaaggtgcgcccgtgattgtaacttcaaagctcactccaacggacattaccctacgaacaacaaaagaatggctcagaatggacgagtacgtgtgaatgtcccacatatgcatgtgcaacgagataccagaggaagacaatgcgatcgcggccacccaatcgaatcgcatgggtagacggtacacgcagtccaatgttgcccaaacctagcgaggaaaggacgctcgggggctcgcgatgatggctctggtccacgggggacgtggtggacggttccgaggaggaagaagtcgagagccggtcgggtggggtctgttcacgattgaaatgcataaggcggaaggatggatctcggagcataccgtccctgcgagtcccctggtacaggacttgaccgagaggaaagacccttggagcccaatttatggccgggtgaggcataagttcgccatcacgggctaaactggtgtggaggggggaccgaggtgttcctgtccaagggtgacttgtggagtatttcccaaccccgggaggtggggggtcctccggaa

SEQ ID NO: 582609 - DNA, 400 bp, Homo sapiens
cagcttgtccagacctggaacaaaatttttggaataagaaatttgtattaaagtccttttttgccctaacagttggctcttgtagcctgcaggctgaggaagtcttttctctgggcatcagcagagttactgaaagcctttgattgagaaaaaacctccgtttgcctaaatcccttttttcgcagaagccatgggactcccccccgacacgggcagcttcccaagccatttttttcatttttgcttgaagcccccttgggtgcagcaatcctgtttgccataggttttttccttccttacctactcaagggctttttttaaggcatgcccccatatttcctgttttttgagaggaccatggggttccttaaaagaagaaaatttttaattttgaacccca

SEQ ID NO: 582610 - DNA, 709 bp, Homo sapiens
ttgccgcatgcgaaatggtgggggccgcccacacgacccccttttctctgctcggtgacaaaatgagtttcgcacggcgcgcctcccactatactctctcgcggtgcgccactggtggccagaaagtacaaagaggaggcgctgtctgtatacaaaagtgactttcttttgacgggcggcttgtaacaaggaagaggttgctgtcgccccacgccgcgagttattggagtctaagtggctacacagcgacggacagtgattgttgtatggtccgccctcggtctctttcgatcgggagggttacagcactacacatagtcgatgtctctaggattggtgtttcgcgcgcccagtgccgctcgcccgctccgatggatagtgagagtagcggggacacccctcttctcgtggccccgcagagacgagctagatatatggtggcggcgacacacgcacacgcggtatgtacaacctacatagatcaagtctgtatggtgagaaaaaagaagtcttgaggtagagtaggtgctgtctcgggggggtataggtagaatagaaatcttacacaaagaatattctcccctagtaccttctttttcgtaaaaaatcttttattttatccgagtactatttactcctcacacaccccctcgccactcacgctccccgcccacacgcaccccacaccacaacaatagacaaacacata

SEQ ID NO: 582611 - DNA, 416 bp, Homo sapiens
ctgtggtgtaccgtcccccaaaagtcttaaactgataagcaacttcagcaaatatcaggatacaaaatcaatgtgcaaaaatcacaagcattcctatacaccaataagagacaaacagagagccaaatcatgaatgaacacacattcataattgctacaaagagaataaaatacctaggaatacaacttacaagggatgtgaaggacgtcttcaaggagaactacaaaccactgctcaaggaagtaagagaggacacaaacagatggaaaaacattccatgctcatggataagaagaatcaatgttgtgagaatggccatatggtccaaagtaatttataggttcaatgctattcccatcaagctggaaaaacaaaactagagaaaaaaacaaagagacaaaaaaaaaagggacta

SEQ ID NO: 582612 - DNA, 459 bp, Homo sapiens
  misc_feature (289)..(289): n is a, c, g, or t
  misc_feature (348)..(348): n is a, c, g, or t
caacgatggtcctcagctgctgggcagcagctgctcagcacagagttctttcctcacaagtggagaggctggttgtccccactgatctccctgaggtccttgacttttttgaggggtgtggcccaaacccacaacttagttcctaataccttttgatactcttttattagatagatgttttacaaatattttctctcagtctgtgccttacaaagtagcagaggtgctgaaatagaggtttttcaaaaaagttttgctttttaagtccagttgatcaacttttttcttntctggtccatgcttatgtcctatctaagaaatctttgctaactgaaggccacaaagaantcctcctctgtctaaagcaggggtttccagccggggtgcagtggctcacgcccgtaatcccagcactttggaaggccgaggcgggtggatcacctgaggtcaggagtttga

SEQ ID NO: 582613 - DNA, 477 bp, Homo sapiens
  misc_feature (385)..(385): n is a, c, g, or t
  misc_feature (414)..(414): n is a, c, g, or t
ctcccttgggaactctagggcactgcacatgcctgatcatccctatactaccacagctgatgctctcttgatcctccacttcctggcaggaggcaaacagcacaaaactagtgcaataaacaaaactacaactaaggaccctcacagagttcatttcactctcctgccacctccaccagagcaagtgctgctatccacagctaagagacctgaagatggttcacatcacaggactctgtgtagacacccccaagtaccagcctgggagccaggtagctctgctggatggctagatccagaagagaaataacaattcactacactttggcttttcagaaaaccccatccctgggggaaattggggggagcattacattcaaggggngttacccaatggggacaaaagattttgantagttggcctttgagccccgggtttttccttttggacttagtttaccttaattgaggagggac

SEQ ID NO: 582614 - DNA, 114 bp, Homo sapiens
gcaaagaaaagaaggaacaatggtcgtgccaaaaagggccgcggccacgtgcagcctattcgctgcactaactgtgccccatgcgtgcccaagcacaagcccattagcaatgcg

SEQ ID NO: 582615 - DNA, 510 bp, Homo sapiens
gaacccctgcgcctggtttctcatcgttcaattcccacctatgagtgagaatttttggtgtttggctttctgcccttgcgatagtgggctcataatgatggtttccagcttcatccatgtacctacaaaggatgtgaactcatccttttttatggctgcatagtattccatggtcacacccagtcttttaacacaattgttgtttctggcctgcccctaaagatgctggagtttgacaacttttcttttgacactttgttttcttgcttgagaaaagaaaattgtagaggccgggcgcgggggctcatgcctgtaatcccagcactttgggaggccaaggtgggtggattacgaggtcaggagttcaagaccagcctggccaagatggtgaaaccccgtctctactaaaaatacaaaaaattagccaggtgtggtggcgggcgtctgtaatcccagctactcaggaggctgaggcagagaattgcttgaacccaggaggtgaaagtgcag

SEQ ID NO: 582616 - DNA, 397 bp, Homo sapiens
tctggagtagctgggattacaggcacacgccacgaggatcaactaatttttgtatttttagtagaaacggagtttcacattgttggccaggctggtctcgaactcctgacgtcaggtgatccgcccactttggcctcccaaagtgttaggattacaggcgtgagccaccacgcccggcctccaatcagtccctgttattctaactttgttatatttcatcttaatctcaaaaaggagatttgctcaactcttactatgaaatttactgcaggaaggaagaggataataatatagtacaaaggtaccttctgatggaacaataaaccaagaatgcctgtctcttaatactctagttcattaacccacagacgtattgatatgtatgctttgtcgacgc

SEQ ID NO: 582617 - DNA, 260 bp, Homo sapiens
tcttcctgtgagcaactttggtgtaaagaaagagcactggaaccgggcgtggtggcttacgccctgtatcccagcactttgggaggccaaggcgggcggatcagggagttcaagaccagcctggccaacatggtgaaaccctgtctctactaaaaatacaaaaattagacgggcgtggtggtgggcacctgtaatcccagttactcgggaggttaaggcacgagaattacttgaacccaggaggtggaggttgcagtgag

SEQ ID NO: 582618 - DNA, 193 bp, Homo sapiens
gcacgaggaattgcttgaacccaggaggaggaggttacagtgaactgagatcatgccactgcactccagcctgggtgacagagcgagactccaactcaagaaaaaaaaaaaagtagaagtgcagaagagaaaggtcttaaaaaaaaaaaaccatcaagaacaatttcaagacatgaaatgttctgcactgatt

SEQ ID NO: 582619 - DNA, 131 bp, Homo sapiens
tctctttcaaaggacagtttacatagtgtatcaaggggagacaacaaaattccaaatcactagagtatggctagttttcccacagatcctccactccacaccccaactccacgagtccatggcctatgtat

SEQ ID NO: 582620 - DNA, 333 bp, Homo sapiens
aagatagagacaagcactcacatgcaatcgccaaatacaacacaacacttagaaagtacaggtgcacattatataaagggaaaaatacacgccttacaatagcataatgtcaagaggtgaaaacaacaggtatcaaaacaccctgtatgcactacgtagatagtaatagactgatagagtgcccaccatatacaatgaggatgtctccataatataagtacagatgatgtaataaagtactgataaagataaaaacccaaatctaaataggctgcattaagacagcaaaattagccaaatacaacaaagtatataaaccactacttagtgata

SEQ ID NO: 582621 - DNA, 683 bp, Homo sapiens
gaccccaccggcctgcctggcatctgtctgctgacgcctctggcttgcgccaggacttggcgtgggcaccgggcgcccccatcccagtgtctgtgtgcgtccagctgtgtggcacaggcctgggctccccacttgagtgccaagggtcccctgagcatgcttttctgaagagccgggcctcagagtgtgtggctgtgtgtctgttcgatctccccatcgcgcccattttcatcccaccgcccgtctctgatccccgggggcgacagttggcgcgggagtgtgggcgcgccccatcagatgttctccctgtcaccagcgggagcttgatatcccttgtgtctgtaggcatagagccgccgggatactgcgggaggggagggctgactggggaggactggggggatgttatgtaaactagtagatttaattttactgtgtcggaggctaggactggtgttactgtaagggtgggagagtgggtgagcagcatctggtgccaggctgggccagactcccggccaagcgtgaagaggactgtgaccatctttccaacccctgggggaagacctttgctgctgagttggcggaggacacaggttcagcaacagcctctcctgcgtggccaagccagctgggaaccctaccaacaggtaccggagggcaggaggggggatgcgctgtgg

SEQ ID NO: 582622 - DNA, 360 bp, Homo sapiens
aggcgtgctctattgctctagggcgggtgggggggtggcaatgagagttccttggagtattccgctctgggagtttcatagcaacaggatcccatgaaggtgcatctttacttttccctccctttctattctgacttgctctaggcttggataaattttttccttttttatggaggagaaacatggtgaagactcaatgggacactcattaagagaagtgtggacctttccactataccgttggaaatcttcaacctccacatctctatccaccctggtaaagtaggcattacttatgcagcctgtgaaattagcatactgagcactgattgctgagccaccgaagtaaaacttcttttc

SEQ ID NO: 582623 - DNA, 956 bp, Homo sapiens
gcccaccgatggcggagaccaagctccagctgtttgtcaaggcgagtgaggacggggagagcgtgggtcactgcccctcctgtccagcggctcttctatggtcctgctcctctaatgggcgtacctttcaccctcatccacggctggacacgcgcaggtccccggacgtgctgaaggacttcgcccccggctctgcagctgcccatcctgctctatgacattgcgactgccaagacagacacgctgcagatcgaggactttctggaggagacgctggggccgtccgacttccccatggctggcgtcctctgttacagggagtccattagcaccgtgcggcaacagacgttttccacaatgttctccgcgattcatcaagaacccggttgcccgcgctaggacgaagccctgtaccagcagactgctgcgcgccctcgccaggctggacagcgtacctgcgcgcgcccctggagcacgagctggtcgggggagcctgcagctgcgcgagtcccgccgccgtcttcctggacgtgcgactagtgctcacgctggccgactgcagccttcctgccctaagcttgcactatcagtctgactacggtgtgctgcgcacttcctgcaggctgcccatcccgcggagctgctgcggcgtacgccgtaacctggacagcgcgatgcaggagaaagagttcaaatacacgtgtccgcacagcgccgagatctgggggctacggtccgcgtgcaccccgctacgagcccaccccgcgtctgtcgccaataaatggcatctttgtcgggaaaaaacaacactcccacacccccacactccccacaacaccaccaccaccctcccccacatccctcccaccccttcctcaccctccaccccccccctcatactaccccaacccaccaccaacacccacccaccctcacccaccccacccacaacacac

SEQ ID NO: 582624 - DNA, 116 bp, Homo sapiens
cacattcatcttcaataacggctgaaaggtgtgcaaggatgtaatatatggtctctagacaataatccttgagtgggtgaaatgttgcaaaaaagaaatgctcctgaatgcgtccg

SEQ ID NO: 582625 - DNA, 217 bp, Homo sapiens
tcctacggcctcctcttgctagtccacctacctctagtgctagtccacctacctctagtgctgtcacacctacctactgtgactgtaccaaccatccacatgatgcatagacatccacatagatgcccatccatcaatgatgcaatgatccaaccatccatcatgccatccaatcatgatgcatagtccaaaatcccaaacctacatactagtagct

SEQ ID NO: 582626 - DNA, 212 bp, Homo sapiens
aaaactagcactctacccacagtgaggtggtatctgatgaagacctgatcgagtgtattgattttagtattgcttggtgtcctccacacaggaggaggatgtattcagcctttaggatgatcagaaaagcagaaaaaaagagtggccggatggggctgaggggagaaaaaattatccccccataaatcctttcaagccaattttaattgtga

SEQ ID NO: 582627 - DNA, 396 bp, Homo sapiens
ctggaggctgtgaaggctaaagttgaggggatgaatctggtgagggccttcttgctggtggtctcaaagctgtgcagagcatctcatggtgaggggcctgatggtgcttgctgaggtctctcttcctcttataaagtcaccagttcactcccatgataacccattattccaataattcatgaatgaattaatccattcatgagggcagagccctcatgacccaatagcttcttaaaggccttgtctctcaatactgctatattgggggttaaatttcaacataagttttgaaggggacaaacatttaagacattgcatatgtcatacgattaaagtatgccttagagtgtgggatttgaatgttatttatcctctctgagagaagcagaggtgttc

SEQ ID NO: 582628 - DNA, 113 bp, Homo sapiens
gcttttgctgaagaatctgaaacatggcagccatggcgtaccggacgagtaatgcccagtccggaacgtctatagaaggagtaaagctcgagtcatcactgaggaagagaaga

SEQ ID NO: 582629 - DNA, 463 bp, Homo sapiens
  misc_feature (37)..(37): n is a, c, g, or t
  misc_feature (172)..(172): n is a, c, g, or t
  misc_feature (366)..(366): n is a, c, g, or t
  misc_feature (398)..(398): n is a, c, g, or t
gtattttggttttttctgagacagagtttcgctcttnttgctaaggctggagcgcaatggcgcaatctcggctcactgcaacctccatctcctgggtttaagcgattctcctgtctcagcctcctgagtagctgggattacagacgcatgccaccacacccagctaattttngtatttttagtagagacggggtttcatcatattggtcaggctggtctcaaactcctgacctcaggtgatccaccagtcttggtctcccaaagtgctgggattacaggtgtgagccactgggcccagcctggtcaatgtttttaatatttacccacataacacatatttgccacattctttgcagtttaatactnccattgtgttccagggccttcaattctgggantcattttccttctggataaattttttttttttttagaatttccattaaatgtaggtctgctgggt

SEQ ID NO: 582630 - DNA, 204 bp, Homo sapiens
tttgatacttctctttgattgacatgacatcaactattttgcacgtgccactgagtaaatatcaatgctatctaatgtaatatcttagcagacaacgtttaacaagcacattttggctgggcatggtggctcacaccgtgtaatctcatcactttgggaggccggatcacctgagttcaggaactttgatggtaacagaccctg

SEQ ID NO: 582631 - DNA, 812 bp, Homo sapiens
  misc_feature (665)..(665): n is a, c, g, or t
tgggaaacggagtctggctctgtcacccaggcaacctccacctccggggttcaagtgattctccgtgcctcagcctcccgagtagctgggattacaggcatgcactaccatacccgtgctaaatttttggtattttaagtagagtgggggttcactgtgtggggcaggctgggtctcaaacttccgggacctcaggtgatccacctggccttgacctcccaaagtgctggggattacagggcgtgacccattggtgcctgggtcacctggtatcttaatatcagataggaatcagatgggtctggtaagggaattcaataattctggattttcagaaacaatgggtttgggtacgctattattagaatttcacaagatacggggaagtcacctggtgagtagtggttggactctggggtccacagataacagggataatagctatcagtttaacaattccaaggatttttcactcttaaaattttttcatcaattggactttacaaaatttctggtaaatccggatttatactttcatttaatagtggcctgtaagtcccaagaagtattgaggtctataattttggaacactgccgagtgtttaacaaatcttgtggtgacagcatttggtgtaggccgcagtaatggggggaccttaattcgngggagcagtagggtccttttgggctttaaacgtggggattataacccttttccacttttctagagccgggagggactggttgggaatagcccaatggatgtttcaaattggggctaaatgccccctggcgggctttggatcaatcca

SEQ ID NO: 582632 - DNA, 183 bp, Homo sapiens
acgccgaccgcggtcaaaaaggcttcgatacgggatcatcctatttattacctcagaagttgtttcttcgcaggattttctgagccttttaccactccagcctagccctaccccccaactaggagggcactgcgcccaaacagtgatcaccccgctaaatccccttagaagtcccactcctta

SEQ ID NO: 582633 - DNA, 305 bp, Homo sapiens
  misc_feature (76)..(76): n is a, c, g, or t
  misc_feature (228)..(228): n is a, c, g, or t
tccatcgtgatcgaacaggtatagggcagggccatcaggtggacgccacgcttggtcttccggttctggcgatccngatcggggttgcgctgctgttcgatttcctcaacggactgcacgatgcggcgaattcgatcgccaccatcgtgtcgacgcgggtgctgcgcccgcaatatgcggtgctgtgggccgccttcttcaatttcattgccttcctggtgttcgggnttcatgtcgccaacaccatcggcactggcatcatcgatcccagcgtggtcgatgcgaccgtgatctttgccgctttg

SEQ ID NO: 582634 - DNA, 190 bp, Homo sapiens
  misc_feature (105)..(105): n is a, c, g, or t
  misc_feature (184)..(184): n is a, c, g, or t
ccatgttgccaagtctgttctcaaactcctggctcaagcagtcctcctatcccaaagtgctgaaattacaggcatgagccaccacgcctggccaccactagtttnttgtaatgggagcaggttccatattgagatggaggaatggatttcactgattgtcatttgtaattttctcagtgtcccncaagaa

SEQ ID NO: 582635 - DNA, 407 bp, Homo sapiens
gatcgagctcggtacctgtccttacccttactgggggggggtggtgctggaggctcacgcctgtgatcccagcactttgggaggccgaggcagatgcatcatttcaggtcaggagttcgagaccagcctggccggcatggtgaaaccctatctctactaaaaaggcaaaaattagctgggcggtagtggcacacacctgtaatcccagctattcgggaggctgaggcaggagaattgcttgagcctggcaagcagaggttgtggtgagctgagatcgggtgactacacttcagcctgggtgagagagtgaggctctgtctcaaaaaaaaaaaggctaatcatgtgtgaatcctgctcagcattgaaaacgtctgaactattgatgcatacagtagggggtagggcgg

SEQ ID NO: 582636 - DNA, 234 bp, Homo sapiens
ctgcaaaaacaaaaaattagcaggacatggtggcatgttcctgtagttctagctacagaggaggctgaggtgggaggatcacttgagtccaggcgttcaaaggtgcagtgagctcggatcacaccactgcactccagcctgggtgacagagcgagaccgtgtatgataaaacaaaaacagaaaacatccagaggtttgtctagaagtagttatcttgcaggtgttcagaaggac

SEQ ID NO: 582637 - DNA, 395 bp, Homo sapiens
  misc_feature (2)..(2): n is a, c, g, or t
  misc_feature (14)..(14): n is a, c, g, or t
  misc_feature (20)..(20): n is a, c, g, or t
  misc_feature (26)..(26): n is a, c, g, or t
  misc_feature (40)..(40): n is a, c, g, or t
  misc_feature (72)..(72): n is a, c, g, or t
  misc_feature (177)..(177): n is a, c, g, or t
  misc_feature (269)..(269): n is a, c, g, or t
  misc_feature (325)..(325): n is a, c, g, or t
  misc_feature (367)..(367): n is a, c, g, or t
  misc_feature (375)..(375): n is a, c, g, or t
gnattcggcacganctcgtncaattnggcacgcccatggnctgctagagcttgaatatgaagggttttatancgaggggattcttcgttacgaagaagaggtatgcagtaatagatgaagaaggaaaagtcattactcgtggtttagagatagttaggagagattggagtgaaattncaaaagaaactcaagctagagttttggagacaatactaaaacacggagatgttgaagaagctgtgagaatagtaaaagaagtaatacaaaancttgccaattatgaaattccaccagagaagctcgcaatttattgagcagttaacangaccattacatgagtataagggccgataggtccctcacggtngctttttncaaaagaaacctagcttgct

SEQ ID NO: 582638 - DNA, 781 bp, Homo sapiens
  misc_feature (11)..(11): n is a, c, g, or t
  misc_feature (101)..(101): n is a, c, g, or t
  misc_feature (146)..(146): n is a, c, g, or t
  misc_feature (157)..(157): n is a, c, g, or t
  misc_feature (208)..(208): n is a, c, g, or t
  misc_feature (252)..(252): n is a, c, g, or t
  misc_feature (299)..(299): n is a, c, g, or t
  misc_feature (359)..(360): n is a, c, g, or t
  misc_feature (406)..(406): n is a, c, g, or t
  misc_feature (420)..(420): n is a, c, g, or t
  misc_feature (422)..(422): n is a, c, g, or t
  misc_feature (425)..(425): n is a, c, g, or t
  misc_feature (445)..(445): n is a, c, g, or t
  misc_feature (460)..(460): n is a, c, g, or t
  misc_feature (595)..(595): n is a, c, g, or t
  misc_feature (611)..(611): n is a, c, g, or t
  misc_feature (637)..(637): n is a, c, g, or t
  misc_feature (680)..(680): n is a, c, g, or t
  misc_feature (703)..(703): n is a, c, g, or t
  misc_feature (710)..(710): n is a, c, g, or t
  misc_feature (764)..(764): n is a, c, g, or t
tattgttggtnttgcaccttagatatcaaataaagatatctagcttgacacaaaagttggtagctgcaaggttaagtctgtattagtttgatgatgggccnggaaatgatatattttctaaattttgtccttaaatattggctgtnacaaatgctgntatagcaaaaagtaagcttctattagacagcaagagggaaacttgagtgantgaatgcaacttaccgtgccaagtcctcttaaaggaggtaaaanaataaatactgtgttttaccagtggctcccctcaaagcattattctnagcatgcggggcgcgcgctatagtgagcagctcacaatagtgaggtcgcggcccaggggnnggttcaaggccaagggtaggacgccgtggtgtgggggaatccgccnagggcgcggtgccngntcntggaatgccgcacttgtgcngggggatgagtctanggcctattttcttctgattcaaaaggacattcccaatttcaaccttgctgaaaaacaggcatttttgtacctgctgttaagaacagctaggatacaggataaggctggcataaaattatttagcaagcacatgcnagctattccagtttgnaatctaccaaactgtaacatcagggngaaataaaaagttgaagatgaagttgttcctcaagctgagggnacaaaatcttacaaaaggagggnttaggcnctcgctaaactctatatggagaacatccttctcaagctaggtggaagatgaggnagaatattaccaaaagc

SEQ ID NO: 582639 - DNA, 1194 bp, Homo sapiens
gctgctcgcggcgccgccgtcctgtctcctcccgtgtgctgctgcccgatgcccgcctgagtcactgcctgcgcggctccgggcgtctggctccccatactaatcagcgcagatatttggagttcttacaacatgggcaggacatagactagaacgaaatgcaagcagtctgaacttagatctacacgtactttggatgagctgtccgaagaatgtcagaagaaaggaggcaacacttgttgtgtaaccgaacacaagatacttccaagaatgcacgatctaggacgtacatccgtggttcgaagagtgagtagtcagacaagtccctccagcattcattggccgatggctcctttccgattgaaattgaatcttgagtgcgtcctgaggtaagacaacaatctcaacacaagggactagctacgtttgaaaaaaggcttcgtgcccccgtacggtgtgagttggtaggggaacgacggaatcttgacattcgccttccgtacatacagaagaccctgggctagagatgtagacatagtagcggcgatttattgatgtcaaggacctagagatttccttaaggtgtagtcgccacagttgctatggcggatccccttgtcaggcaccgggaacagaatattgcttgtggttacttccatcaatcaaagacccttgctttatctttgcatgaaacgcctgatttcgcagaattcatattaattagcaatcaattttatcgaaccctcaaccgaaagccaagccaatgctgaaatcggaaacacccagaatgaaagcacagtatgccggcatttccccgcgcaggaaacatttgaccagcaacaatcgtgcgaacaagcatttgcacaggcatgcagaacagcactctgggactgcaatgaactacaatgtagtgagccccccagagcagggaaatatcccttggatttagcgccgccaacacatggttgctcagcggacatgattgaactgtagctaccagtgattatgccgttccaggcttcgacgagtgagcaccactacttctgataacgccttcgaccacgattattagcgtagaagattcttccagatgctggcacgcctaatgagttcggcttaaacattacacttgaccccttgaatttttccaatattagtggttgcgcgaccaccagtatccgccgacgatattgc

SEQ ID NO: 582640 - DNA, 973 bp, Homo sapiens
gcaggaggcggaggttgtggtgagctgagatcgtgccattgcactccagcctgggtaacaagagcaaactccatctaaaaaaaaaaaaaaatggtattatactggccttcaattcctctcttcacttactaatattctgtctggttatttttattacagaaagtggggtattgaaatttcctactataattatatggcttgtctaggtgtttcttccagtctggtcaatattggctttatatattgggaaccttagtggtgacatacacacagacacacagacgtgcacacacacacacacacacacacaaaattctgtcataggttcccagttaataaatctattatggttaaaggtctttcttggtctcttggcagtttggacttaaagtactttatgtaagatatgacagtttggggacttaagatgtagctttgggtaatactatttgggacctcttgggctctcatgggttaatatgggcatgcaagtgtctaaatctatctgtgcaccttcagtatgttttaatcattagatgtcaggtgacccttgtagaaaggcaactgggatcgggttttaataattttaataaattctttattgaaagtatgtctctggcatgggaaagttttcttgaacacaaagagacttactaatttatgggggggctcaactggactcctggcatctgtggtcccacattttctctccttgggtctcatcggggacggaaatttgacttgaatatgctttaacttctctttcttaatgggggtcgcggattcaaaagcgggataattctcggtgggaacggggcggcgatacattaaacctctgagaagaataccggggttttcgcgtctgtttgaaatggaaccttggtgtggtgtgcaacaaatatttccttcacatgttttccacaagtgtgctgtcaggtgcaaaaaattcaatgatgtatataaacgttgttaa

SEQ ID NO: 582641 - DNA, 165 bp, Homo sapiens
tatatgaaagggtttttttgggccccaatttctcaatttttttaaaaaaataaaaaaaaattggggtttcctacgtgtggttgtgtgtgtgaaaaacctttagggccccaacaacaggttttgtgtgtgtgttagaggaaaaataaagaggtggtgtgggcgaaa

SEQ ID NO: 582642 - DNA, 140 bp, Homo sapiens
  misc_feature (117)..(117): n is a, c, g, or t
ctaatgataaatcatggaatgtaagctcgataaagaggagagtgaagggacatcaagagcatgagagatatgaaagactcttccttatcaacaatgaactggcatgcaccctttttnctttgcagatacttctgacatat

SEQ ID NO: 582643 - DNA, 767 bp, Homo sapiens
agcgggttgtggagtggatgctttggccagatggcggggagcggggtccggcaagtctacttctaacgtcagcaccttcgatgaacgcccattttcagtcgcggacatgaagcgaggccaagcgagagggtgcgcgagctctaccgccgcctggtactcggtgcgtaggcgctgctctgtagacgagctgatgcgacctaaactctccaagctgccactatcagctgctggaaatagagtgggcacgggagtaaccgctccgagaaatgtgtatgaagaatgcccatgtcacagaccccagtggtggtgtgatctgtctggtcattatcggggacaacgatcaggaccatcgggaagacaacgcatctacagacgtatcggaagccagctggactcgatgtctatgcgggcttcgttcccatgagaacgaagaagcggcccaagggcctaaaagggtagttttcccatatccaaagtttccttattgattggcccgaacgaagtaccccagtgggaagaggtcccacttacaagggtcggggacacatggacttggccatcggtttcgagttagcttcgttcttgtcaagtagtcgagctaaaaatagatacttcccacctgatttacagactggggctttcaaccttttggtctgactcagtaaaattccctattctgtattgtacagcccaaagtattgcctttgctaagccctcctttttttggcgcctgaaggcatactgtgcggatcccttggggttattag

SEQ ID NO: 582644 - DNA, 831 bp, Homo sapiens
  misc_feature (7)..(7): n is a, c, g, or t
  misc_feature (18)..(19): n is a, c, g, or t
  misc_feature (22)..(22): n is a, c, g, or t
  misc_feature (37)..(37): n is a, c, g, or t
  misc_feature (97)..(97): n is a, c, g, or t
  misc_feature (118)..(118): n is a, c, g, or t
  misc_feature (124)..(127): n is a, c, g, or t
  misc_feature (134)..(134): n is a, c, g, or t
  misc_feature (136)..(138): n is a, c, g, or t
  misc_feature (143)..(143): n is a, c, g, or t
  misc_feature (208)..(209): n is a, c, g, or t
  misc_feature (213)..(213): n is a, c, g, or t
  misc_feature (219)..(219): n is a, c, g, or t
  misc_feature (221)..(221): n is a, c, g, or t
  misc_feature (232)..(232): n is a, c, g, or t
  misc_feature (235)..(235): n is a, c, g, or t
  misc_feature (252)..(253): n is a, c, g, or t
  misc_feature (256)..(258): n is a, c, g, or t
  misc_feature (261)..(261): n is a, c, g, or t
  misc_feature (297)..(297): n is a, c, g, or t
  misc_feature (304)..(305): n is a, c, g, or t
  misc_feature (309)..(309): n is a, c, g, or t
  misc_feature (315)..(315): n is a, c, g, or t
  misc_feature (323)..(323): n is a, c, g, or t
  misc_feature (325)..(325): n is a, c, g, or t
  misc_feature (330)..(330): n is a, c, g, or t
  misc_feature (354)..(354): n is a, c, g, or t
  misc_feature (368)..(368): n is a, c, g, or t
  misc_feature (372)..(372): n is a, c, g, or t
  misc_feature (379)..(379): n is a, c, g, or t
  misc_feature (388)..(388): n is a, c, g, or t
  misc_feature (396)..(396): n is a, c, g, or t
  misc_feature (406)..(406): n is a, c, g, or t
  misc_feature (413)..(413): n is a, c, g, or t
  misc_feature (425)..(425): n is a, c, g, or t
  misc_feature (433)..(433): n is a, c, g, or t
  misc_feature (443)..(443): n is a, c, g, or t
  misc_feature (455)..(455): n is a, c, g, or t
  misc_feature (459)..(459): n is a, c, g, or t
  misc_feature (469)..(469): n is a, c, g, or t
  misc_feature (508)..(509): n is a, c, g, or t
  misc_feature (529)..(529): n is a, c, g, or t
  misc_feature (576)..(576): n is a, c, g, or t
  misc_feature (613)..(613): n is a, c, g, or t
  misc_feature (619)..(619): n is a, c, g, or t
  misc_feature (659)..(659): n is a, c, g, or t
  misc_feature (663)..(663): n is a, c, g, or t
  misc_feature (686)..(686): n is a, c, g, or t
  misc_feature (692)..(692): n is a, c, g, or t
  misc_feature (701)..(701): n is a, c, g, or t
  misc_feature (716)..(716): n is a, c, g, or t
  misc_feature (730)..(730): n is a, c, g, or t
  misc_feature (734)..(734): n is a, c, g, or t
  misc_feature (740)..(740): n is a, c, g, or t
  misc_feature (746)..(746): n is a, c, g, or t
  misc_feature (748)..(748): n is a, c, g, or t
  misc_feature (758)..(758): n is a, c, g, or t
  misc_feature (820)..(820): n is a, c, g, or t
gtgaacnaaacgcctcgnngcngccagatcgctgctntcgctggcggatggtgtgtggccgccgcaggacgcccgccgtgcccgggccatgaagtancggctgctggcggcgccgctncccaannnncagcccnannnccgcnctgcgctgcccggtcctctcccggcggggtcgtatcggcgtggacatggctggccgcgtccctannctgntatttntncttgtttttcnaancagctgtttggctttcnnaannncantttctgtctttaaaaggtttaaagaaactaccagancattttnnaatnaatgtnttggtacnancaganccgtagttcctattgattcatcanattttgcattgganattngcatgcntggggttanacctaaanagtccgatanatacttntgcatgtctatncgaatacnagtggatgangaagccttcgtnattnaattcaagcntcgagccagcatggatactgtccatcacatgttaatttnnggatgcaatatgccttcatncactggaagttactggttttgtgatgaaggaacctgtacagataaanccaatattctgtatgcctgggcgagaaatgctccttnttactnggtctccccaaaggctgtgggattcagagttggaggaganactngaagtaaatactttgtactacangtacantatgggggntattagctttttganagataataatatgnactntgcggntgtgcncntacactgcanatgtctgccacagcctttaattgctggcatgtacccttatgatgtctgttgacactgttatnccagcaggaga

SEQ ID NO: 582645 - DNA, 546 bp, Homo sapiens
ctagactggagcctatcgtgtgttctttaaaaacagccgctcctatgcattccactataaagacgcaggactgacatacactccagtaatccgaactcactgaggattatacatatacttcatattatcactcgaccttctggaagacccttacctctgatcgagcgagcgcggtatataacgagaacccccttcgagaggatgagttacataattcgccggcgagcgtactttatttgacctttcgtggcatgaagacgtacacctagtacgaagggtccacgcaggtacatatttcgggttcaaacccacctgtattatttcacgaccgcaggccgatgttcatgggctttgagagactcggtttacctgaagctccatagactttatgccttgaactgtacgtgccatgggtgcggctgtgctcacttgctatcaccgggagcacgtctgatctcaactcataggacgcatgcaagttttgcacaatgcgcgttaccactattgtctctatatgtgctctagcagggttatttccggagcggt

SEQ ID NO: 582646 - DNA, 467 bp, Homo sapiens
  misc_feature (386)..(386): n is a, c, g, or t
cgtcataaaccagactgacacaaacagactttaaaagtttgtggaaaaatggaattaaaaaagaaaaatttatttcaacctaagctctaccaagtacaattttgtaatcaatgatagcagccatttaatccatcctaaagaactgagggtcttgataattataccatggcaatgcagtagttattacgctattaactgaagaaaatgggtgtcctttatagattctttaagattaggaaacaaaaagaagtcagaggactgtaaggtgtacgcttaatgattctctgtcaaaactctcgaaaaattgcccttgtatgatgagaataatgagcaagaacattgtcatggtttagaaggactctttggagaagctttcctgggtgtgnaacatgctaaatcttttgctagtttacaccaagtcatctcataataagcagatgttttgtctttggccctaagaaagtcag

SEQ ID NO: 582647 - DNA, 239 bp, Homo sapiens
aacacggtcttacaatagtcgagcgaactgtttgagggtcagtctcctcaccattaggctgcacgcccttgtacctcaaagcgatcccacaatgtccacgcttggttatatgtacttggtgactgtgatgcggcaaggtgtgttcagtagaaaccaaatgaaaggcaggcccacagttgatgtgaaaccagttcctgtaaggaggtcaagctgtcgtgtgcccctaccacaaccttgtc

SEQ ID NO: 582648 - DNA, 248 bp, Homo sapiens
  misc_feature (13)..(13): n is a, c, g, or t
taacgacggtaantgaaagtagaagcacgacggcggccagccgatggatgcccccgagcagcgcaaacccttcggcagctacgccagcgacggcacggaagttttctccttcctgcggcaatttttaccgggtgtaggcgtatgtttacacggcgaagcctgcagttatgatatgagccccgacgaagactttattatcgatacgctgccggattgcgatcgcctgatggttatcagcggattgagcg

SEQ ID NO: 582649 - DNA, 934 bp, Homo sapiens
  misc_feature (172)..(172): n is a, c, g, or t
  misc_feature (174)..(174): n is a, c, g, or t
  misc_feature (191)..(191): n is a, c, g, or t
  misc_feature (213)..(213): n is a, c, g, or t
  misc_feature (217)..(217): n is a, c, g, or t
  misc_feature (228)..(228): n is a, c, g, or t
  misc_feature (249)..(250): n is a, c, g, or t
  misc_feature (263)..(264): n is a, c, g, or t
  misc_feature (291)..(291): n is a, c, g, or t
  misc_feature (295)..(295): n is a, c, g, or t
  misc_feature (320)..(320): n is a, c, g, or t
  misc_feature (363)..(363): n is a, c, g, or t
  misc_feature (400)..(400): n is a, c, g, or t
  misc_feature (923)..(923): n is a, c, g, or t
gttctgaataaagctttgttggtttgtgccactttaatttaatggtaaatttgtgtccaataagtgtctggtgatattacaacatggatctaagcattttggtggttctgaccattgtccgtttctacatggttatttgattgttaccctcaagttgatacaagtctggcantngtactcaactgatgaanctggagcatatactgaccccgnagantctttgcatanaggtggtcccgtcagttttcnntttaaacacatcnnttcttcatccccaacatttcataaggnctcntacattgataacgtactctctcacnagatggatatttactcatctgtctcgacactatataagcattntgtactgtgggcgtattcacacagaaagtgtcagtgnacctgcatttgggaggggtggaccagccccgttctacacatgaaatgttgttctcattgttttgaagtctgtatcctgtgttgcaaataatttgcacagtatcaccttccagatgtgtttgtcctgaagattcagaatgaccattttccacaaaaggaaagaaacacagtctgagacactttggtgttggtgaccatccttcttctgtgcatgttatgcgagtccaaaatgattttgaaggagacacaaaattatattcacaggagtaatagaaaacttcccctgtaggaacctgggaaaatggcttatatttttcttcatcatatagaattccatggtttatgttttggaaaatcacaaaatgttgcttctcccccaacagaggatatccgtgagattagaattacactgaccaggagccacatgcttggtagttccaatcttatataactaaaaatacttcagtggtggtggtgttgctttgaatctgctctcgtgccgaattcttgcagccggggggatncactaggtcta

SEQ ID NO: 582650 - DNA, 812 bp, Homo sapiens
  misc_feature (172)..(172): n is a, c, g, or t
  misc_feature (174)..(174): n is a, c, g, or t
  misc_feature (191)..(191): n is a, c, g, or t
  misc_feature (278)..(278): n is a, c, g, or t
  misc_feature (801)..(801): n is a, c, g, or t
gttctgaataaagctttgttggtttgtgccactttaatttaatggtaaatttgtgtccaataagtgtctggtgatattacaacatggatctaagcattttggtggttctgaccattgtccgtttctacatggttatttgattgttaccctcaagttgatacaagtctggcantngtactcaactgatgaanctggagcatatactgacaacaggaatgaagtaatgtctccattgtcaataggtggagggggcccacatttttctgcagaaatagtgnacctgcatttgggaggggtggaccagccccgttctacacatgaaatgttgttctcattgttttgaagtctgtatcctgtgttgcaaataatttgcacagtatcaccttccagatgtgtttgtcctgaagattcagaatgaccattttccacaaaaggaaagaaacacagtctgagacactttggtgttggtgaccatccttcttctgtgcatgttatgcgagtccaaaatgattttgaaggagacacaaaattatattcacaggagtaatagaaaacttcccctgtaggaacctgggaaaatggcttatatttttcttcatcatatagaattccatggtttatgttttggaaaatcacaaaatgttgcttctcccccaacagaggatatccgtgagattagaattacactgaccaggagccacatgcttggtagttccaatcttatataactaaaaatacttcagtggtggtggtgttgctttgaatctgctctcgtgccgaattcttgcagccggggggatncactaggtcta

SEQ ID NO: 582651 - DNA, 363 bp, Homo sapiens
  misc_feature (182)..(182): n is a, c, g, or t
aactggacgcttacagtctacgtggacgacgaccggtagtacaccaagtaaactgactctgaaactcgtggtgactgctagagactgggctgcaacgcgaggacggggggcaactgtgagaccacggactttacgacaagggacaacggcttcctctgacggacacgtaggactttacacgnctgacgaccccacggacgactgggacgcctgattttcaaccatgacagactggaggacgccaaacgtgatttccagacacaacggacacctgatgtgtcgcagacacgcccagaggacaggacacgcctggatctcctgacggacgactggacggccagaccaaggggacctggacgacgt

SEQ ID NO: 582652 - DNA, 151 bp, Homo sapiens
aagacaccatactcagcaatcacaagagcccgccgccagtgggttgtgtgcagactggttgaggtggagcctgctctctcgttctctgacacagagagctgccctgcctaggagcacccaagctaggcaggggtctggagcacgggttctg

SEQ ID NO: 582653 - DNA, 275 bp, Homo sapiens
  misc_feature (274)..(274): n is a, c, g, or t
ggccagagcagcttctgcccggactgcctctcccccgctaggcgctggagcctctggctggaggctccctcccttggccgtcccaatagagcccgagctacttccactggccaggctcccgagcatctgagtgaccccagcctgctgagcagtgctggcctccgctcctcaggggcttagtccgtcccaccccttcccttccctggcgccccgagcccaggcctctcagctgtcagctggttttgatgacctcccactgccccacacgccgcgng

SEQ ID NO: 582654 - DNA, 142 bp, Homo sapiens
gacgtcccagtctacgctgctctgtctgctgtcgtccgcatatacttaagcattgtgaagcatggtaatgaaaaaaaatctagctttcatatctattcagtcgtcagttgaatgtatatgagtaattaattccaccccctgc

SEQ ID NO: 582655 - DNA, 446 bp, Homo sapiens
cgatggtacgtacgcccacaaggactccagcctgggcacagcgactctgtctcaaaaaaaaaaaaaaaatttagtagggttttcacccattgataagaaatctttaatttggatcagagcccacatttgaggcatcatatcccaggatcggaggcccctacccatgggccttctaggcaggagctccacccgtaatggcccttgctctgtcctggggagcacagtttaggtcggactcttgtagaccatgttcatccggtttatgtgagttctggctgactttgagctatcctgtataaggtgtgcctgtaattaccatacttttcccagaccttcagaggaatacttgggggccctttcctaggcgtggatgcttgctgagcaggcttggaggggggggtgattggcttcatctgcctgtgttccgtagcccattttattcctcc

SEQ ID NO: 582656 - DNA, 450 bp, Homo sapiens
acgggtaagtgtcctctgggctcagtcatcgctctctctttctatctcggcccaatatcactgcctcagggaagccttccatgataccccagcccctcccccgcaacacacacacctggccaagtcctctgtatacacacatgacatttctattttcccttcatcacacttaccacagcttgtatttacgtaattgtttggttaatgcctatctgtcttacttgactataagctctatgagtgtaagaccattatacctctatcacctaactcagtgactggcatataaaaagcaatccacaagatctggcatggcagctcacgcctataatcctcgctacttgggaggctaagagaggagaatcgcttgaacctgggagttggaggttacagtgagccgagattgcgccactgcattccagcctgggtgacagagcgagactccgtctc

SEQ ID NO: 582657 - DNA, 302 bp, Homo sapiens
tcgtacgtccacagcgtgaaattttgaaactgtggtatctctcctgcattcatgactccgctctgggacttctgatagccaatctcacctccatcagcttctttatcctccttccatctgattttgggttcatggaagccatcagcgatctcctccaaatccaaggcaatggaacctctgggtccccatccttagcatagctccctagtgtctaacgtcctctcctggctgcattccttccttaattctctttcttgccatgccttaagagaggacgtcgtcacggtaacaccttttttttg

SEQ ID NO: 582658 - DNA, 268 bp, Homo sapiens
aggatctaatctcgaaagtagtgcaggctggtctcaaactcccgactcaggtgatctgcccgcctcgccttcccaaagtgctgggatgacaggtgtgagccaccgtgcctggcctctttctccgttattaaattagggtagcctctttttttttttttttggattggccaaactcctttattctggtatactaaacccctctataaaacatttttactaatacaatatttacctcccagtcttaggaatacgtctctacactctactg

SEQ ID NO: 582659 - DNA, 318 bp, Homo sapiens
  misc_feature (22)..(23): n is a, c, g, or t
  misc_feature (28)..(28): n is a, c, g, or t
  misc_feature (43)..(43): n is a, c, g, or t
  misc_feature (165)..(165): n is a, c, g, or t
  misc_feature (173)..(173): n is a, c, g, or t
  misc_feature (181)..(181): n is a, c, g, or t
  misc_feature (189)..(189): n is a, c, g, or t
  misc_feature (194)..(194): n is a, c, g, or t
  misc_feature (198)..(198): n is a, c, g, or t
  misc_feature (315)..(315): n is a, c, g, or t
atgctcgatgtctagtaggatnncaccnaacattggcctcgantccacctctcctgtgaagatctggccagcacctccccgtgagtgctcctcaccttgccggcatagtggataatgcagaaatcagctttgtccttcagctgcttgggcttctggaacttgggntgggtgcnctgctccngcatcacnttctncacnagctcttgtcggtggctttggggaaccaccactcctcgtccagcagggccaaaatgcccggggggcctgctggcttctcaatgaggtcgatgcagggctgcagggtcaaggccaatnttg

SEQ ID NO: 582660 - DNA, 302 bp, Homo sapiens
  misc_feature (32)..(32): n is a, c, g, or t
gtttttggcccggggtttttaaaaaaaaaaanccccccccccccaaaaaatgtttttttttttgggccaacccaacccggttcccaaaaaaggccgggggttttaaaaagttttaaaaatcggggagcccttaaaccaccccccccccccaaagggaaaggggcttttgttttgtttttcccttgggggccccttttggaaacccccccttatgggccaacgggggccaaaattttaaaaaccctttgcgggtttttaaaccccccttttgtttccttttttttttttttgggaaaaattta

SEQ ID NO: 582661 - DNA, 310 bp, Homo sapiens
gaagggggtcccctgtaccgccacatcgcagatctcgctgggaccctgacctcatactccagtgccagccttcaatgtgatcacgggggctccatgctggaacagctggccatgcaggagttcatgattctgcctgtgggagccagctcttcaaggagccatgcgcattggcgcgaggtctacaccacctcagggggtcatcaggccagtatggctctcacagacagatcagactgcgccctgcgctcgagcgtctggcaatacaccactcatgagatcgagagctttgggacaggcaatctatctggcg

SEQ ID NO: 582662 - DNA, 1277 bp, Homo sapiens
ggccgagccacatcgctcagacaccatggcgaaggtgaaggtcaggagtcaactgggatttggtcgtatagggcgcctggtcaccgagtgcctgcttttaactctggtaaagtggatatttgttgccattcaatgacctccttcattggacctcaatgtacgatggttaacatgttccaatatgattcctacaccatggcgaattcctatgcgcaccggtccaaggctgagaacgggaagcttgatcatacaagtggaaatcccatcaccagtacttcgcatgggagcgaggataccgcttccaaaaaattcatacgtgcgcgagcagattgctagagtcgtctagacgtacgattcgttgaggatgtaccacatggagacgtacgttcaactcatcgcattggaaggaagggctaggggggctcaatattagtcaagggaagcgcgatgcctaaaaaagtggttcatcaatcatcgtgccactccgtcctgcgtgagtgcacaccacatgatctcagatcatgggatggtgagaacccgagtgcagtcaagctatggacaaacgagtcctcgaagcatccatctagcaaataagccttccatgacgacctaccaaaattgtctataagacaacccaatgggccgaaaggatacatactcatttggagccacactatatgtgtagtccgttggaacggacttcaagtagacccatcatggtaccattgcacatctacttgcgcacccaaggaaagacttgtgggataggccccctctcggggaagacattgttggtcgtgaattgggccccgcaggggggctccatccaggataacgattcattccccctgcactactaacttggctgcttggccagaagtgacttgtcgggccacacgggtacaatccccttggaagtctagaaactgggcgaaagctccaacttgggcgaattggggccatttcccgttggttccccccaacttggaccaaagccggttggtcaaaggttggggttggggaaccctttgaaaccctgggaccgggtcttaagaaagaaaaccttggcccgaaattcacatgtactcgcaccaccttcaacacgcaaaggcgtgggttgcaacggccacggagcgtccggaaagggggcccccccttcaaagggggggaattccgtggggtgcttacaagaccttgagagcaaaccgatcgttgggtcgttctccctcgctggagacttgtcaacgcgagcgaaaacgccaacgtcctttccgagc

SEQ ID NO: 582663 - DNA, 428 bp, Homo sapiens
ggtttagcacgtggtaagtggtttcagaaacatgaaaagctataaatgtaaaatatacaagacaagaacaaaatagaaaaaaaggctgggtacactggctcagtgcttgtaatcccagcactttgagaggctgaggcaggaggactgcttgagcccaggagttcaagaccagcctgggcaacagagtgagaccctgtttcttaaaaaaaaaaaaattagctaggtgtggtaatgtgtgcctatagtcctagctaaccgggaggctgaaggatggtttgaggctggaagttcaagaccagcctgggcaacaagagcgaaattctgtcttaaaaaaaaaatcccatcaagagctttatggtctacttggcctgagctgctgtagaaaaaactgataccacggtgctataagataccacggtgctataacg

SEQ ID NO: 582664 - DNA, 566 bp, Homo sapiens
  misc_feature (98)..(98): n is a, c, g, or t
tttggattgaatttgttttcagaagtggaagaatctgccattgagaagcactttctggactgtggaagtatcatggccgtgaggattgtgagagacanaatgacaggcatcggcacagggtttggctatgtgctctttgaggtatgggagactaatgcattgtcactgtccttcgaagtgccctgggaggcattgacactgttgcatgtcatcattgagacataactttcacttccattctcaaattccatcttaagaaaactgggctaggtgcagtgactcatgcctgtaatcccagcactttgggaggccgagacgggtgaatctcttgagctcaggagtttgagaccagcctggcccacatggtaaaacctcgtctctactaaaagtccaaaaattatccaggtgtggtggcaggtgcctataatcccagctactcaggaggctgaggcaggagaatcgcttgaacccgggaggtggaggttgcagtgagccgagatcgtgccactgcactccagcctgggccacagagcaagactccatctcaagggggaaaaaaaaaatac

SEQ ID NO: 582665 - DNA, 184 bp, Homo sapiens
cgacttctagaaggatcctcccatagatatgtgagcccaaagatgttatttcttacatttcgttgcatattgaaatactacttacgatagacatccttggcctgagactccttgccatagtccttaactactacacaactgcaaccaaccactttacggggtttccccttctgtcaattgatac

SEQ ID NO: 582666 - DNA, 727 bp, Homo sapiens
agaacagagcgccttacgaaaggcggcataactagggagccaacgaagagagtggtagatccattttctaatgaaagattaggtatgatgtgaaagcacctgctatgtgcaagtatcaagaaatatggggaaagacgctcgtcacccaggacccaatggcaaccgaagatggcaatcatgaatgtgtctcaaggtgctcggtgctgctattggacagctggaggtccgtggcatgcactgtctgcaagcagactgactggaaagatatgctactatgttagtacacacactcttcgaaatggcatgcagtctcatcctagataagaacttgctctactaggagtggtaatagacaaaccgtgggcccgttgaaactaaaaccgtgtccacaagtagaggccattcggtaggtctttgatcgctcggctagtatcaaaaaaaggtggtggtgtctccctaaccgtggagtccacataacaaataacaatggggcctgaggcaccaacaatatggggaattgtggcaacagagcccacacaaccggtgttacggggagtggcctccgtaggagagagaacagttaaacaccggcgacaattgtcggctatttccacattatgggggcattagtgccgggcctcccctcggttgttgccctagggttgactctttgggggttcttattggggaccactttaaaagaagaccacagaaccggggcccaaaa

SEQ ID NO: 582667 - DNA, 563 bp, Homo sapiens
aaatccaatccaggttcccaaatcagcccgcacatccactagtgttcggggcttttctattggtatttggttttcgtccgttgttcttatctatgcgagtctttttagtttttactctcttgtctgattttttttttttttttttttaacttcccattatattgtccgcgaacgcggtaaatgtgttagctgtcattcgttaggattattagtgcgggtattaggcgaagagggggccgatgacttaccggcttaacgcctcgttctctgacttagcgatggtctcttgtctgatgatttttgagtgtaattgtttggtcgggtgtcgctgacttctggttttattgtggttcgttcgtatgtgcgagcggtaggaggtcgtctttcttcgttcggcgcgtttgttaaaggccggtcgttatccggaacggtgtactgaacgttatatggtgagggacagttggacttttgcccctaatcctctttaacctacgggagacgaatggggttcgtacgcgagcgggtatgatgccgaatgggtgatagaaccgggcgcggagaac

SEQ ID NO: 582668 - DNA, 879 bp, Homo sapiens
acgtgtcccttctctgttcaccacgtatcacgaacccaacaacaaagttaagctgtcacgcttcttgagcttttccgggcagagaccagagtcggtttgagttgcatgactgacatcttctggctacagtggatattacaggaagactgaaactccgcaaaagtgtgtttgaaaaaaagaaaagcaccctggaatttggatcattaagtatctgccatttagaatgtgcccacaactgccaaatcaataatagaataaagcaaggggaatccctgagtcttcatggagtaagagccacaccttcttaaggggatcaaggggcaaagtgacttgaagacaatattatcatgataaataaagaaataagggaaagtgtggaaggttttcatctcaatggacatgaaaaagtgtgcattattagagtcgagtgcatttaataagccaggattatctcctagagttgcacagcacgacacagcaagtagagtcggcatttggagacccttttggaaagaagagacaagctctctctaagctatatcactagtcccaactttcctgggctccagccatccctcgcacctcggccttaccaatcattcggattacaggcgtgaagcctttgctccacgctaatatttctattcgccgcgtttggggggactttgaatattacaaataaacccttgggtctctttggccccaggggaggaacttttgcggccgctttccttttatggagggttaatgtataatcctcccttcctgaactccttgcctcggccttactgctgccacaacggtttaatccacttaaacgccggtccctcgtttttccaagaattggggatatcccccaacacacggcttctaaagcct

SEQ ID NO: 582669 - DNA, 882 bp, Homo sapiens
gtgcttgctaacgtgggtatatttataacaatataactgagttatagttggcattagtaaatatttgctgtcactctaaatagttctgttgtatagcctgaaaaccgtttagtggctcattgatcagattcctgactaacccctctcttagagctacagcgagctgcattaccagctgaaaacacttcttagggatcaagatatagagtgtaatttttcaaaatcgtttttaattcaaactgtgttttagtgtaaaattgttaaccttgtaagatggatacggtgtataagaatgtaggccttaactatttcacagtgagtcaaaacaaagcagctttaaagaaataattggaagcacaatgtgcatggcactgactgaatgcggtaactactctctaaaagtttctacattcagattatatgcctgattcatagtaaagtacctctgaataaacactgtatatagaaaacctgacttcagtgaatatctcgtcattttacatgggccagtttatgtactgctatttgcacgtattatttcctatagctacatgttcttttgtagctttggtagttctatttgtatactagatcatacctgatggaaacgctcaatctggtagggtgacagcatgttcgagcatttgtatagagaactggtcagtaatccttccatgtgtctcttccggttaaccagcagtggggtggtacgccaaatttgccgctggtggccaactgtgcaacgaaaagagccctcttctagcacacaaaaacccagaaacaaatctgtcgcccccagaagtaacaaccgcggcgggcgcgaacattaagccagacgctgtgggctacaaacaccgcgagccgaacgtagtctcattgacc

SEQ ID NO: 582670 - DNA, 965 bp, Homo sapiens
gctgttgtgttttcgtctggctggttcctgttatgttccctgcctttctttgtctggccctggtctccctctttttttcttcgtttgtttctctcttgtttcgtcggcccttttttcctcgtcctgttcagggacctggtctctttgttgtcctttgtcttgatcgctgctctatctttcctgtgtcgttttgttgccagttgctatgttggccaggtctcttgtctttctctctattacgctgtgttgtgtgttcttcgtgtctggacgcggatggtcgtccctgtgtctcctggtcttgtcctcttctatgctccaatgctgtggttgtttctctggttgcccgctgtctgttatcttccatgatcccccgtttcctgccagccccttgtccttaccccagttcaccaccagcccatccattaggccagcaactgcctgtgtacgaactctatctcctgggctgtaacgtggctatctggttatggtttggacactcagggatagaatgatctaacagccatcactgatatacatgcgctgctcgatctttgtcagcctgtctctatgtgtggatatgcccctcgagccttgtgctgccgcatcatgtggccccacccatagtcaacgggaagaagcgaggaatgcctggacctggagtgcccctggagccagatgtcaagagggctgacagcttcctattcctgtgtgtattctgtccagcttcctttagaataaaattggatgcccagaggatctcccaatccctggcttggggtcaagaaagcagccagcaagacgttaggggccttagggcatctgggctagttgttccattgaagccgaactctggaccctggcccttacttgcttctctagctctctaggcctttgccagtcttgcacctgtccccaccctccactcagcatgtcctgcacgcaaacactccaccctccaccttcca

SEQ ID NO: 582671 - DNA, 427 bp, Homo sapiens
cagtggctcgtgcctgtaacgccagcactttgggaggccaagatgggaggattgcttgagcctatacgttcaatatcagcctattccacaggacaaaaataatttctctttctctttttttttttttttctgagacagtctcgctctgtctcccaggctggagtgtagtggcatgatttcggctcactgcaacctccatctcctgggttcaagcgattctcctcctcagcctcccgagtagctgggtttataggcgcccaccaccacacccagctaacttgtgtatttttagtgaagacggggtttcaccatgttggccaggctggtattgaattcctgacctcagatgatccacctgccttgacctcccaaagtgttgggattacaggtgtgagccaccgcacctggccaaattcttgctcttaaa

SEQ ID NO: 582672 - DNA, 561 bp, Homo sapiens
  misc_feature (228)..(228): n is a, c, g, or t
  misc_feature (240)..(240): n is a, c, g, or t
  misc_feature (245)..(245): n is a, c, g, or t
  misc_feature (259)..(259): n is a, c, g, or t
  misc_feature (271)..(271): n is a, c, g, or t
  misc_feature (288)..(288): n is a, c, g, or t
  misc_feature (295)..(295): n is a, c, g, or t
  misc_feature (301)..(301): n is a, c, g, or t
ggaagagggatattcattagtctccaagatcaccatccaattcccttatccgttaccacaccagcaaccataccgttaccatgaagaccatgggccggcaccaccttcaccaagtgacccatttaatgtctccatcagattaacccaccttatgtacacaccatgtgtgacatagtggagaatatatatcacttatacatcactccctatgtagtaattatatcaganatattaaactcnatatnatcatgaggaaacnaactatgggacngactataagagaattanctggccnggcgcngtgtcacgcctgtatcccaacactttgggaggctgaggcaggcagatcacaaggtcacgagttcgataccagcctggccaatatggtgagaccccatctctactaaaaatataaaaattagctgggcatggtaacaggtgcctgtagtcccagctacttgggaggctgagatggaaggatcacttgagactgggaggtcaaggatgcagtgagccaagattgcgccactgcactccagcctgggcaacagagcaagacac

SEQ ID NO: 582673 - DNA, 152 bp, Homo sapiens
tgaggattcaccacagacacccccactgtaccggcaccctagcaggagggctcctgggaggagtgtagccctgggccccctcagagaggttcgcagctggcatgtgatcaggccctggggactctgagggacccagcctggcacacagcagg

SEQ ID NO: 582674 - DNA, 312 bp, Homo sapiens
tatgaagagggagttcaccctgtcacccaggctggagtacagtggcatgatctcgtgctcactgcaacctccatctcccaaactcaagcgattctcctacgtcaggctcctgagtagctgggaccacaggtgtgcgctaccacgcccagctagttttttgtattttttatacagaccgggtttcgccatgttgcccaggctggtctcaaactcctgagctcaagcgatctgcccgccttgtcttccaaagttgtgggattaccggcgtttaatcccctgtcttccaccgaatcagatcttagtgagctaggc

SEQ ID NO: 582675 - DNA, 519 bp, Homo sapiens
ctataaattcagaattctagaatttagtaataataaacttttataatatgcctacggtagtatcattctctcaatatatataaggatcacctatgtaagcaaaatcagatggttctttctatattattctattgtctggaaatactacaatatgtttatcctttaacctgtagatgaaccatttacaaatgtttctcattccttgattattcacaagtaaagctgctatgttcatttgtatgcacatgtattccatttctcttgcagtcaactaagcaatggaatattctaggtccacattgtaagtgtatgtatcaactgccaaactgcaatccaaactgattatccacttcatactcccacctaaatcatgcatcaattcagggtgttgtatgtcctctcaaacattcagaatagacatttagtcggatccactatagtgactgtgcagtgttattgcatatagcattttaaagttccatacccaggtggtaaatgatgcataaaacagtgtaaatc

SEQ ID NO: 582676 - DNA, 239 bp, Homo sapiens
gcgcgctcctcgtcagtccctgagaccctaactagtgaggtttaccgtttaaatccacgggttaggctctcgggagctgcgagtcgtgcttttgcatccggtgaaatggggtggaattttattcgtttagaagcaaataacaagaagaaagagaaagtttgtactgaggtggattgagttataccgtctgagtgttttcatgtgttagagtgggatcagtgtgaccgagagaagtggca

SEQ ID NO: 582677 - DNA, 150 bp, Homo sapiens
tgttgcctaagtcaatcaccctcgtttcatctggtcctattctcttgtcggaaatttctcatgcaacctttttttatatctgaaaatgattgtttaaaatattcaattaaagttatactgctaagttcaatcttcttccatgttatggtt

SEQ ID NO: 582678 - DNA, 341 bp, Homo sapiens
gtagaaaaaagaggtaaggcggaggtggggttagggggagtctgcgagggggggaggaggagagcggaggtgatagagagagcgcgatgtctggaggcgtccccgtgcgagggacggttttgccacatgtgcgttggctgttcttagagggctaggcgcgggggggcttgggctgttggctgagtatggggagcgtcgtggttgtcttcggcgcggtccggtgggttgcgggaggcacagcccgaagggctcttcgcgtccagggacccggggtcgttggggggcgtcggtttgccagggttgtgacggccaggtactggaccacgcttggatctgtgatg

SEQ ID NO: 582679 - DNA, 1005 bp, Homo sapiens
  misc_feature (1005)..(1005): n is a, c, g, or t
gtggcgggggacctcagcagcgtccgagatgtcatactctcgctcggacttcctcgtctctacgtcggtggtgtgccgcacgtcgcgatgcacagatccgctgcgacggtggacatgttacactcctggggtccacagatagtatggttggtaagttctgtgtgaagataacatgggccgagaatcgacttatcatgtttaaagtggactgatgatgagtattgatgtccaagtgagtctgtcaaggagcggggcagtgtatggggctgtgggcatggatgtttgggggacattgtcgatggcaggtggccgtgtgttacgttgagcagggtaaattcaaagtaacagggggcgaaatgtggcatacattgtcatggacacgcacagagaggtgttgcttgtggggttggaagatagacagcaagctaggtggatcgggcaagggttgaagtgtgggtcagggctaagatgattataagttggtgagaattttaggatgtgggggtcgtcatgatgcaggaagtgggaatgatgaagatggtgtgcgcgattgtgagattctgaatgtattagtttgggacagaggtcatgacacgggtaaggcggggagccacaagatcgaactggaatggcgtacttggttgtgcttacacgggtcggggacgctgggcgaaccagctgccggatgcagacgcacggaggaaggcacattgggggaccgggaaccgcggaagcaacaccacgcgaggtgaaacaccagcaggccgcacacgccgcatggcaacagcaagcggacagaaggaaccaaacacctgcagaacccaacacaggaaacgcctgaaccagcacctagaccaaggcagaacgaccgacaaacatcggtgacacacaacgaccaccgagggcaaaaccagaaaagacgaccacgcacacaagcacaagaagaaagcacgacacagcctgcgcaaagaacgatcacaggcatacctacgtccacgctcggcn

SEQ ID NO: 582680 - DNA, 350 bp, Homo sapiens
  misc_feature (84)..(84): n is a, c, g, or t
  misc_feature (158)..(158): n is a, c, g, or t
agctcggtacgacgctctatctgtggggagatgcattgcggactgcatcgtacgctccttcacttgggtcagcgcgctcatcangtctgggtgttggcgtgaatccaagggacacgaatcccgttttcctgtgcatcattattttctgctttgcatcnataactgcttgcatctcagcatgatccttcttcagttcctcttccacagacattagactgcttgatgtatgctctttcactcttgggctaatcttttttcttccctgctgtcttcggagccgctcctcgctgtcctccagtcgggccttgtataccagcagcagcttctgcatctgctgctcctgcaccagc

SEQ ID NO: 582681 - DNA, 1106 bp, Homo sapiens
atatatttatactatatgattctcctatacagccctacacccctgtgtactcatctatatctatgatcaaacatacttttctatgcctactgtaccccttctactcatctacttagactccccttccaaacctaggggggcatgtaggtgtgagagaagcacacaggctctgacgatttcatcatagctctcctttcctaggagcccacgagagagggcacgcagacagggggtaggtgtctaccaaccaccccaagcactagaggacagacacggggctcttactacatttacaccccatccctttctacccctgccccacaggactagggccactatctgggtaggggcagtgggtcccagataggatcacactgacgactgtaacgaactacaaacaaaatttctattcacattaacatatcggtgtactcaaacacacacaacacacgacacaccaacacaaacacacaaaagaaaccaacaccaacaacatgtgcacgcgcacaacaacaagacacataaagacacccgaacacaacaacaaagcagaaaagtggcaccaacgagccccaacaaaacaaaacagagacaccactgacacacaacacacgaccacacagggaagaacacccgggcaacagaaaaacacaccaaagcagagatatacaccaccacacaaaaacacacacacccacgcggaaaaacaccacgaattcaacaacacaaccacccacaacgaaggacactacagcagcaccaaacggcgaaaacatcaccaagcgggcaccacaagggaccaccacaaaaaagccaccaccaagtaaacaaaaacaacaaaaacaaaaaaaaacaaaacaacaacaaaaaaaaagaaaaaaaaaacaaaaaaaaaaaaacaagcaacaaaaaacaaacaaaaaacacaaaaacaccacacacgatcaaaaaaaaagagaaagcaaacaaagcaacagaacagaacaacctaacaatctaaaaccaacgcagcaaacaaaaaacggacgacaagacacgaccgctcacacacacagaaccaaaaagcagacacaaaacaaacagacgacaaccaaaaagaagagaaa

SEQ ID NO: 582682 - DNA, 379 bp, Homo sapiens
gacatctgcacctgccatgctcgttccagcactattcacagtacccaagattggaatcaacctgtgtctatcagcagatgaacaggtagaatgtggtatatataccccgtggaatactatttggccattaaaaaagacaggattctgttattctcagcaacatgtatgatcttagaggacattatgttaagtaagccaggcacagagggataaatactgcatgtactgtactgatgtggagggtgagaaagatctcatagaagtagagaggtgctcatgcctctaatgtcggtgctttgggactgtaaggtgggaggatcacttgaggcgtggagtttgagaccagcctgaggaacatctctcaaaattaaaaaaaaaa

SEQ ID NO: 582683 - DNA, 923 bp, Homo sapiens
cataaatattatatctagcatttaccatctcacttctaggaatactagtatatcgcttcacaccttcatatcctccgctactatgcctagaaaggaataattacgtatcgcttgtttcgattatagtctactctcataacctctcaacacccatcgtcccgtcgtgtagccagactattgtgcctatttgcccatactagttctttgcacgcctgcgcatgccatgcgtgttgggaactacaccctagctatgtctcaatctccaatcatcagtatgctcctagaactacgatatcataagcctaaacctaactccaattgtctaaaaactaatcgttcaccaactcaccattatatattaactagccagctgagcatgcacttttccaacaaagcacataattttgtaaatcaatcacaatccacctccacaggctctaatttattttactcatcactccgccctactagttttttaagccaattatcatagcatacatacctatttatgctgttcctccacatcgcttttcctccgacctcctaatccaatcaccccctcctaattagtaactacctgactcctaccccttcacaagtcatggcaaaggccaactggccacttatccagtgaaccagatatcacgaagaaaagtctacctctctatgactaattgctccctacaatatctccttaattataaacattcacagacatagtaactaagtcagtattttatatcttcttcgaaaacaaacttatctcacttggttatcatcacccgatgaggtaccagcagaacgctgaacgcttgcccttcttcctattctaacctatttggttcctttccctctccatcggactaattttatctcaaaaccctgtcctaaaaattttttacactctccctgcccaatattta

SEQ ID NO: 582684 - DNA, 351 bp, Homo sapiens
gctaatattgactaatgccacaatggacttgcatcgagcagcgatgataatgacatgagccgatgggcagctcatgacacagtcgagtagaagcacgcctgtcagatgcctgcaaacatagctgagaccgggtctaacaatgcagtccgaacagatggccaactgttacaactagtgatctgtcctcgaaagtgttaaacatatcagcgatgccacgtgagagcaactacgcacaatgcttagagactttaatgctactcaatatgcagaggtaggacagcagcgcactccggaggagatctgatcgatgacaatctgttatgaaaccggctgtcagattctgccttgttt

SEQ ID NO: 582685 - DNA, 850 bp, Homo sapiens
gtctgcgtactgtagtggctgctgcttgggcccttgagcggattgtaagctgctggttaagcggctgggaagagcggcgagagggttcggcaatttttcgtcgggatccccgcaaggatgagtgctgccagagagtctcacccgcatggggtgaatgcgttcagcctccccagatgacgatctgggatctagcaattgggaggcagcagacttgggtaatgaacgagagaacacaaaagttcttgagaacttatgggtgcaggaaatgaaagaacatactggccgtcttgtaaactacggagatcacaaatcaaccatctcactttccgaaccggggaagaagcaccagacaacaattacttgaatgaactggagtctcaatatcacgcaacagtatggacagtacattatccaggacagatatcggcgacatttgtggaccttggcttcagtgaggtacgaaagaccatgatgggagcaggtggatgtggctggcgatgatgactgatgacggatgatcgatttcaccttgatcctgaaaaggtccagatgacttcttgacaacgcgattcaagagtccagagacaaggacagaatctgcttgacacgaacctcccaaagctggttgaagcaccccttgatggaatgttgggtgggatcccccaaaatacaacatagaatgccagcacacgcattcttcacactgctgtttgtcaactcccagtggtttcataactccccaaagcttagtctttgcattacaacgtagccttgtggtacactgccatcgtggaggcactggtcctgacagcgaccttgtattaactgtcaaaggcttcactataaaagg

SEQ ID NO: 582686 - DNA, 81 bp, Homo sapiens
  misc_feature (49)..(49): n is a, c, g, or t
cccagccccaaccagacctctctgtacttctgtgccagcagtttattcntagcgggagggtacaatgagcagttcttcggg

SEQ ID NO: 582687 - DNA, 445 bp, Homo sapiens
cgccgtgcggtcctttcctctgcagtgagccgatttgctctgccagcagctgtcggtgccgcgctcgacaccgagtcctagctaggcgctcacagaatacgcgctccctccctccaccttactctgttcgcccgcctctcggtcacccggaccatccacggagacttgagggatccctctctagggaggcctctgcgcagcatagcggctcattcggggacttgatatggagtctccaccggaagaggggtccccagcatcgacagacttcgagttctcctgatgttgttccatacaatggctcaaatcatggcagaacaagaagtggccaaatctctcaggcctttccactaaccctgaaaaagatatatatgtggtgcgggaaaatgggacgacgtgtctcatggcagagtttgcagccacaatttatttgtaccttatgatg

SEQ ID NO: 582688 - DNA, 274 bp, Homo sapiens
ctcccgatgagaacttcactgagcactacggtctggctgggtgagcatgccagggaggcaagacaccaacggctccagttcttcatcacgacagtcaagacagcctggctagatagcaagcatagtgtgtttggcacagttctagagggcatggagggggtgcggaaggtggagagcaccaagacagacagccgggataaaggcctgaaggatgtgatcatcgcagactgtcggcagatcgaggtggagaagccctttgccatccccccccccc

SEQ ID NO: 582689 - DNA, 191 bp, Homo sapiens
taagaccttcacagagttgctatggtatagaatcttttataatttttaaatataggccacgcgtggtggctcacgcctgtaatcccagcatctgaggaggccaatgtgggtggatcacctgaggtcagcagttcaagaccagcctggccaacatggcaaaaccccgtctctactgaaaatacaaaaattgg

SEQ ID NO: 582690 - DNA, 680 bp, Homo sapiens
gtctcagctacttgggaggctgaggtggaaggatcgcccgagcccaggaggtcgaggccacagtacaccatgatgcaccactacactcaagcctgggcaacagaatgaggcttgtctccaaaaaaaaatttagaccaggcgtggtggctcacgcctgcaatcccaacactttaggaggccgagatgggcagatcactcgatgccacaagttcaagaccagcctcagcaacatggtgaaacctagtctctaaaaaaaaaaagccaagtagaggctcgctcctgtagtctcagctactgtgggaggctgaggcggtggaagggtgggcttccgctccagaggcagagattgcagtgagccaagatcatgccactggactccagcctgggcaacagagtaagaccctgtttcaaaaaaaaaaaaaatttaaaattttttaaacctttacggggtgaacctaagggggacggaaagggtcaagaactggattcaaggccaggtgcaggggtctcacactggtaagcgctggtaatcccaagggctatagagaggtgcgaggacacatggttccccacggtccaggaattccaaaacaagcctggaccaaatggggaaacccgttctcattaaaacaccaaaattccaggatggtgattgggccaataatccagcactcggaact

SEQ ID NO: 582691 - DNA, 174 bp, Homo sapiens
cagtcaccctgggcactccagctcctcctactctctctccatcttgaattagacacgcatggtcttagaagtggctgcaagcgggccctcacaggcgccaccaatgcacttccattctggctctccctggacagcttgggatgagttttctaaacgcagaagtgagcggaggat

SEQ ID NO: 582692 - DNA, 183 bp, Homo sapiens
atgtccagtgaaatggctggtgaaaggatgttgaatatagttcagaattcattgacacgcaataatttccagaataatctcccccttctctgactctccaatcttccatgtcttctgctttccttctgttcacctaattcatctatcatttgaccacattgggagtatactatttgacacatc

SEQ ID NO: 582693 - DNA, 675 bp, Homo sapiens
  misc_feature (39)..(39): n is a, c, g, or t
  misc_feature (133)..(133): n is a, c, g, or t
  misc_feature (256)..(256): n is a, c, g, or t
tacatgtaagtacaagaactgaccacattctggttaatntacatttgaaagcaaaaagacatttcataacagagttacatttaacttactgagaaagaatcatttttataaaactaataatatacttattatnagccagataataataatatacttattatagccagataataattagtagcagaatgagcttctttgacacttcataggatcataagtttaaaggattagctgagaatgaccatgctagtgtttntgttttaaaagtaagaataatcccatataaggttagtgatcatttaaggtgttgatgaatcagtaaaattaaccccaaattttactcttcaggcaatggagatgggcgatcctgtatccataccaaggtcttgattgtgagctttctcttgcccttccaggtataacagactatacccagtccagagcctgggcatgcccagggggcaggtgggctcctggtccgtctgactgtggagaaccaggaggaagccaccgaggtatccagggtagccgtcttctcctgtgtcacctttacgtccgggaggcccaggagacccagggacgccatccacacccctcctgccatccagcccaggctctcctttgcaccctggtcctggggggcctctcattccagggagccccatggctccttct

SEQ ID NO: 582694 - DNA, 1544 bp, Homo sapiens
  misc_feature (284)..(284): n is a, c, g, or t
  misc_feature (700)..(700): n is a, c, g, or t
gcccctactaaatcgtttctctctttacctcttttttcgccgccctttattttagcggcagagatttgttggttgcgatgccacaaagaccatggctgtgtttcctccttcggaggatttttggtgttggggagccccgctggggaaagtgttggggaacccctgggtccaaggaaattgtccgcacggtacacaaacaccatgggggttggccccatataacaactcccccgctcattccgcagctgttgcccacgttctgtggcgccagacagagaaatggncccgcccgtggtgctaattatttctgtgccgtggtaggagatagcccgttggcgccactgggtgtgccagcgtttttttctgttgtatagccccccagaggaatttccccggcccaacatgtgcctttttggcgtcttttgtaagagcccacaggcccacaaccccacgagaattgggctggaaaaaatgtgtgggagccccccgtgtcgcccacacttggggtgataaaaaaccacatgggcctgtttgtcatggccaccttggtgtgttaacccgcttgtcgttgaaccgctgggggtgtgcccccccaacatagagatgtgctccacaaaatgcctggcacccacaattggcgcaacccccacgttcgtcacaattctcacatcagccggcacacgccacatccccacagttnttttttgtgaattttgtgtggcaccccccacacactgggcgatgtacaacacagagtttgtcgcgacatctacaagcttatcctcacacgtcgctttctctcaccctctggtgtggtggtgtccccttggtgtgtgtgagatgagccccttgggcacacacagggggacatcacagagaggaagatcctctgtgtggtgtcacactgtctctgagacgcgacactacactctcacacacaggcgcacactttgtctctgagggggggctctctggggccttctctcccctggggggacacccacacaacagagttttgtcgacacttgggatagttttatagtcccacagaccggtgtcccctatttgtgtgtctcacaatagggtatacacctgggttgtttagagcgggattgtggagaggaagagacggcagatttttctctcagagagagcgctccgcgtgtgatagagatatatagggctcgccccccctctgtgagagatagaggattatatatagtgagaggaagagttttgtgtggtctgtgtgaatatttctcgtcttgtgatagaggagagagagggtgtgagaggaagaaagaggagagagaggaatatactctaatatgataccccatatccctttggccgccctgccagccatagtccatagctccccagaatattccagcgttccagcgttaacatgcaccagacacgttaaagacctttctcggtgtagaatatgtgtttccacattggtggataccatagtgctttgtcccatagggtacctgtaatatttttccatcatatttccaagtataagtcattaacatcca

SEQ ID NO: 582695 - DNA, 877 bp, Homo sapiens
  misc_feature (3)..(3): n is a, c, g, or t
agncccagaaagaagacgagggccaaactggcagaaggacagaaaaagaacacgggggctgaccccgcccaacgccgccattgtgcccccatgagccacggctgggccgaccacgaaactgtggggagggaaacgagtaccctaaagggccctcaaaagcacttcgcggggcactccaggcgcgacccagggtgacgggtaaaggaaactctacaagggcccgccgagaaacaacttgggcaaggaaataacggggctttccacgccatacagtcgattgcgcgcacttgcaagagcccaagggcgcaaaggtaccagagccggcgactgaggcgcacaaagcggcccaccgcataagggggcacaaaagcctatcagtacggggccataaacccagccaccacgccgccccggggtagaaaagatccaacagagggcccataggggcggtagaaagaccccccccccgcccgatggccggcggcagtctcttgcccacgctgtctcggcgcgcccagaggggggtgcccaaacagtctgtcccgccccaaaggcgtggattctggggttgagtgacacgtccgacccggggcttctgtacaatttgtcacgaagggttagattacgcccaccgacacctgttctgtacagtctcccggctatttaaaggcagggagtataacgaccaaggtctgttcttcaggaacaccacttagggagacgaacatttacaagagactattcacaggtgggggggagttcgtccgtgttaacgtccagcacgtggggcggaatgtgcctctatcccttgttctccgccacaaatcaatttcccaggaactcgaaaatttaaaactttaagaccgaccacaaaaca

SEQ ID NO: 582696 - DNA, 149 bp, Homo sapiens
gctcggcaccccgcccggtgttgcgcccatccaacatactatcttttttaaaagatctattattattacttttttgactcagggtctcactctgtgtccagcgtggagtgcagtggcatgatcctagctcactgcagtctagacttcct

SEQ ID NO: 582697 - DNA, 270 bp, Homo sapiens
gacgtaccgtgagctgggaatgtaagaaacagaagcttctgggtcatcacaaactggtgccttcttgatcttcaccaccatgtgttccccatcagtctcgaaagtgacctcagtgcctgcaggacagagtcacggtgccagatgctgcaagcctggcctggtagacagggatggagctgagagctgtgaactcctgatgcccactagagggcgtgcctgattcccgggcctgcctaattccatagcgcagttatcctctggttccattcc

SEQ ID NO: 582698 - DNA, 333 bp, Homo sapiens
tgaggggaaacgtgcaagaggaacagtggtgagaagggggattgtcccccactttccacaaactataaacagcgacatgtaacacagagaatcacaaataagagggtctttcctcatgtcttctctcaacccattctttcataatgagttccagttggtccctaaaggtgccaggtgatctggaagttctgtgctgggagtggggttgagtgagttggcctcaaagttgtgccagatgcttcccgagccagaaacaaagccagctgtgcgggcgtccatctgcaactcatgtactcccccacgctccagtgggaaaggtagggcccgtgttct

SEQ ID NO: 582699 - DNA, 140 bp, Homo sapiens
tattcgtgttgcacctccccgtgtatcatggtatattattttcttcaacatagttcaatttcagttttcaacacagcactccatgtacttcaacacacagcaattccatggtctccaacaaatgctataacagataacat

SEQ ID NO: 582700 - DNA, 122 bp, Homo sapiens
ctctagcatagaaatcgttagggatattagaaattgctgtgagatgaagaagagtgagtgtactatatttcagcactttcaggtatgcagtttacagcattgatcccggtaaccccattatg

SEQ ID NO: 582701 - DNA, 240 bp, Homo sapiens
tatccgaagacatcagcgcgatcaggagcattatccttgcgttgaatctaggctaccgatcttcagccgggagaacacgccttacatctcgggcgtatcggtagatgttgatgtcgatacgcgggtgaacatcgaagtacacccgggtataggagaaacgcttcagccaaattcgggtcctccaattactgaggcttacttaccagttgttctgtaccagagtactgagatgtgtgacgg

SEQ ID NO: 582702 - DNA, 221 bp, Homo sapiens
tatggtcgacaatgctgatttgtcacctaattgtacatttacagatcacgccataatcagccggatcggtttgcttgggatgaactggtgcctggttaatccacgctgattaaatcgctggtcggtgacctataactgattcaggttctgcggaaagattcagaattactgaatattggttattttgccctgcatctaatgtgatgcactgcatggtcctg

SEQ ID NO: 582703 - DNA, 451 bp, Homo sapiens
  misc_feature (86)..(86): n is a, c, g, or t
ataagacagaatagtgtgtaaagtgttttagaagtactcctattcaaaataattttttttttttgagatggagtttcactcttgtngcccaggctggagtgcaatggcacgatctcggctcaccgcgacctctgcctcccagattcaggcgattctcctgtctcagcctcctgagtagctgggattacaggcatgttccaccatgcctggctaattttgtattcaaaataacgtttttaagtcagtttcctacactggcctgggcaaaatacctttgaccaaattctcctgagtctccaagccttggggtttgagggttccactcatcaggctttcacttcagacttactaggaatccacttactcctttcctctttcttctacctcagattctgagatcctctttactttttctgtcctccctgggattatcagggcactgggcactttt

SEQ ID NO: 582704 - DNA, 391 bp, Homo sapiens
tcatagctgctcctgagggaaaacgcggccagtgatcagtataagtgtactggttaatacctgaaataaaaaccaggcacagtgactcacacctatgatcccagcgctttgcgaggccgaaacaggcggatcacgaggtcaggagtttgagaccatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaggaaaataaaaagggggggggggggattaa

SEQ ID NO: 582705 - DNA, 346 bp, Homo sapiens
acatatgtacttacgtgtgtctgtgagtgtgtgtgtgtctgagggttattctgaacagcttgtaaatgttgtagttgtttaaaatggaaaataaaagctgagttcttttggcgaatatattgcgtcaaaaatacactgttggcagtggataaaacactgaggaaataaattttttttcattttgaaaaaaaaaaaagaagaactcgagggggggcccgttacccaatctcccctatagtgagttgtgttacaatctactggccggccttttacaatgtcgtggctgggaaaacattgtcgttacccaacttaagcaccttgctttacataccccttttgtcaagtg

SEQ ID NO: 582706 - DNA, 516 bp, Homo sapiens
tgtgttccctttgagtccagtgtgggacacggtttaactgtcccagcgacatttctccaagtggaaatcctatttttgtagatctccatgctttgctttcaaggcttggagaggtatgtgccccttctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggaggggagaagagagtaggaaaaaggagggaaggacagacatcaagtgccagatgttgtctgaactaatcgagcacttctcaccaaacttcatgtataaataaaatacatatttttaaaacaaaccaataaatggcttacatgaaa

SEQ ID NO: 582707 - DNA, 282 bp, Homo sapiens
ctggctcgttctgcattcctccccgcagtcctggggaaggggatccgtgcagcccaccctgtgtgaaagaggtggacacgtggcggcaggaggctctgtgccgcacattggctggagccgttcattgtaggaggtggagggaaagaggccaaggagctggtgagatgtgatccctcgctggtgatcaggatctccttgtgttcttgtccaccagtggtgttgaagcccgagcaggtaagcctgcgggcctggactggaagctcagtccaaggtgagcagtgc

SEQ ID NO: 582708 - DNA, 539 bp, Homo sapiens
  misc_feature (517)..(517): n is a, c, g, or t
tgactcgagtaatgcaggaactgtgagcttctgcgtctgtcaggtacaaggccagtgctcatggtgtgccagtgccagtgcctgcccagtggcttccaacatctgcagccggtccatggacagctgggccacaagggtgacatcgtgaggccgggggggtggcggttcatggggcaggaaagtgacatgcacacggtgcacagtgagctgctgctcgcggaactcaaagcaggggtcttcctcgtccagttgtgccagggcctgctgcaactgctcagcaccaggtgggggctggctggggtacacaaagagctctctccgcagcaggtccccatcgtactcctggagagtcaggtagaaattgcggaagaattccacatgcttgttcttcacccgaagcttctttggtgagttccagtggaccaccttgaggtcagacgcctcagagtagcagcgctcggccagtgtgtgatctgacaggtgcacattccagacacaaggcagacgctgcactagnccccgggtgctccttgatcaca

SEQ ID NO: 582709 - DNA, 88 bp, Homo sapiens
tctacctctgtgctgaccctttgtcctccgatccctccaggcggggatacggggccaacgatatttacaccgataaactcatctttgg

SEQ ID NO: 582710 - DNA, 294 bp, Homo sapiens
tggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcacagctacccggggaggctgagacaggagaattgctagaactcagaaggcagaagctgcagtgagcagagaaaaaacaaaagcactccagcctgagataaacaagcaagaatccataacaaaaaaaaa

SEQ ID NO: 582711 - DNA, 504 bp, Homo sapiens
  misc_feature (14)..(14): n is a, c, g, or t
aactccactcactntatttatgctgagagggaacaagctcctggccgggcctaatgggttccaggtgtgctctgtgccctgcagcggctgaaccggcagcagtggtggtggctgtgactgtgcctggctggctgagaagacccagctaggccagtcctctctagcccagccctccagcctatgaaaactgtagagctggagcaggccctacccagtatggtgggacagatgttagccttgtgctcagagggccttgggttcaaaatcaggaggcgttgtccgcacgcccagcagcacacacggggggctcccagactctcctgcctttatcgcaacaggttctggggctgcccagacatttttcacagatctgtaaaactccctttcacaagaggtcggctgtggaagtgacctcccagagaggctcgggaaccaggtgggagcccagagggcatgaatgaggtttcttttattaccattatatattaattatcctgttattta

SEQ ID NO: 582712 - DNA, 237 bp, Homo sapiens
gctgagactccccctctgatgctctgtctcctatgtttttgagatggagtttcactcttgttgcccgaggctggagtgcaagtggcatgatctcagcttactgcaacctccgcctcccaggattcaagcaatttctcctgcctcatgcctttcaagttagctgggactacatggcatgcgccgaccacgcccgcgccaaattttttactttttacgtagacgatgggtgtttttttc

SEQ ID NO: 582713 - DNA, 880 bp, Homo sapiens
ggtttatttgggggaaatacacactgaaatattaaagagtaaaggaatatcatgtctgtagctaaacacttattcagaacaaatgcatctgtatatgaagagtgaaagaaggataaaacggatgtaaatgtttacatctgaagaatttgggtggaaggtattcagaagttctttgtactttgctgtcttttctgtaaatctaaaattatgtcaaagtacaaaaatgaaaaaaaaaaacaaggttttaaccccaaagccagggtcagtgctcaagggaaatcagtagtcatggtcacggtcaagacagggatacccagcctcacaattccttatttacccattatatgggattatgcaagccaaccctttgggacaatacaacacgtactcatgatcactggttttcacacaatgatgttatcccaaaataattatagctggtttagaaaactcaggagaatccagttggcaaaactattataagcaataaacataattccatgaatatatggagatacagcactttctagagaacatttagtatcctacagccagttagacgatgtaaagaacctccttttgcaggacaaactgtgagggggacaactccttccagatttaacattctcaatggggatggtgtaaaccggggatcaaatttcccagtggcttcaagagtttaaggggcaaaaacaaacaagcaataccaacaagaacaaaaaacaagacgacaaaaaacacacggtgtgacagccacggggcccacaaaaagactcttgacaaaccgacgagaagagacgcggccacaagagaacgacacaggcgaaagagggaacacaggagacagggacaacaaggcgggagaatcaccaaacaaaag

SEQ ID NO: 582714 - DNA, 197 bp, Homo sapiens
ggaagttgaggctgcaatgagctgtgatcacaccagtgcactcgagcctggggcaacagaacacgaccctatctcaaaaaaaaaaaaaagggggccaggtttaccagcatttgggaaggccaaggcaggcagatcggctgggttgagcaggccaaaacctgctgggccaacatgggggaacccccatttctattaaa

SEQ ID NO: 582715 - DNA, 301 bp, Homo sapiens
ttggagtcgcgacacggtagagccgagagacacggtagatgccgcgagacaaggtagagccgagagacaaggtagagccgagagacactggtagagccgagagacacggtcgagccgcgagacaaggtagcgccgagagacaaggtagagccgagagacacaggtagagccgcgagacaaggtagagccgagagacaaggtagaggcgagagacaaggtagaggcgagagacaaggtagagccgagagacaaggtagagccgagagacaaggtagaaccgagagacaaggtcgcgccgagg

SEQ ID NO: 582716 - DNA, 188 bp, Homo sapiens
ggagtccctgaaggccatgattgcctgggaatggacgatagagaaggggggggtgtgtgaggaggataagacggacaagaaaaaaacgcggaagatatcacatagtgcccagacctatgatcctcgagaaggttacaaccttcagccccccgaccttagagctgttaccctgttccggtagctgcagg

SEQ ID NO: 582717 - DNA, 105 bp, Homo sapiens
cccccccccccccccttttttaaacaagtgttacttgggccgggaaaattttgctgtctttggaattttaaaacttttaaataaattgggaaaggggggaactga

SEQ ID NO: 582718 - DNA, 934 bp, Homo sapiens
gggtacacgggactcagacatgttccgtgctgaagccagaggacggcacagacgacaatgtgggttttggactcggcatgaactctcttcgggggtcgagcccaggcccactggtctggctttttccagtggccatggcccctgaaatctaccgagaacaactgttcgttcgggggtgctctgtggacgcaggaatcaggaggagagcctgtctgggcgtagttacttcgagacgcatctgtacgttcgtacgcacgcctaccagtgcacaccagttgatttgagcggcacagcctgcagaggtaccccacatggtctgaagacatcaaggaatcgccaggctgttcgccagagaaaggatgagcccggaacggtcggtagctagcgccgggcggtcgctgggggaagcgtggacacccgtgcgagcccgtgtgccatcgtggtcccaagcgaggctggtgggccctgagggttgtccaccggtcgcgtcacctcattcactcttgtcgctcgcctgccggctcaggctccgcgcggagcggcaccacggtccttggcgtgacggaagctcggcctttgagcgagcgccggtgagcccgcgagcacgcgtggttgcccgccttgtccagcggctcgctaatacgtccagtagcgtggcatgtcgatcccgcagtcggctcgtcgttactagacgtctatttgagagtgtgcattgtttccgtttgggctgaggtgatcccggccatgggtcccccgcgtccaagacgaacctgggcgatcctgtgcctggcgataccttggcaccaaggaattgagacgcgcgctgaaagaccggccatagagttgggaattagtttggacccccggaaaaactttaagggaacgtcgttcctttgagaggaccgtatggcgaaccatccggaaagaagtgaca

SEQ ID NO: 582719 - DNA, 1972 bp, Homo sapiens
ggagagatggagatgtgcacgacggattcatttatgagctgcggaacaggacgccctctgactgctgacaagaacttgtcctggacaacagctcggctcgaactgaaggcaacactcgaaggccatcacagatgaactctcgaacgcaacctggcaacttctctaacgctacaactcaaccgctacgcgccctcaccgtcaactccgcacaaccttacgcaaagctctacacaccacacactctaacgccaagcctctgacactaacgccgcactacaccacgcagctcctccaccggcaggccctgcgcaaacgctacttcgcgcccgcacaacagcctgctcacggacacccatacaccgccactcatacaacacttccacacgctcgcgccacccgacacacactctcacacgcacccatccagccgcacacacttagcagacccaccctggcacacagaccaggcggtctaacgcacacaaagccccgtccatacagccacgcgcgttctcagcaacagcgctctctctgcaaaacctctcgggcggaaagcgcttcaactccctacacccccttgtacagcccggaacgactaaccgccgcaagcgaacacgcacacgtggcttggatcctccaaacagacgctgcccctacccgccggcccaacacgcttccaaccaacttacgtcgttccgcacgacccacgcctaacttcgaaccccccgcacgcgaaacagaccccacaccgggcacagccgcccccaccttggaaccctcccggcgaaatacgcatcaggacacgcgagccttacctccgctgcacaaacgcgcgacactgcggcgaaactccgaacttcgcacagccgacaggcgacccccgacctgcgacacccacgacaatcgaatacacgctactaagcacacacccccacgctcccacaccacaacccaccacccccaacgcgccctacacagcccccacacgcacaccgccaaacgcaacacccacccaccagcgcacccacaccaccgcacccacataccccaccaacacgccaacaacacaggccacggcacccacctgaccacgaccggaacaccaaccgccacacgacccccaacacaccaacacacacacaacaaaccagaccacaccgcacccagacccacaccgaacccaccgacccgcacccccaccacccacgcgcacacacccctgcgccagccagaacagccacgcagccccgagccacaccagcacagcacacacacgtaccagacaccacagacccacgcccactcacacacccacgcaccgccagggacgacgcacgtcacacccgcacacagcacacaccacacaacccaagcaaagaaagaagccaaccagcacgccacacgcaatccgcacgcgcacacacccacgcccacatcctagcaccgaccaggcagaccaacctgacaacccgagcacgccgacgaccacaccgaacacgaccgacacaacacatccaagcacgacagcagaggaacgccacgagagcgcagggggaacgaaaaaccaacaagctaacacgcacccagacgcaagcgaccaagcagaccaacaacagcgccaagcaccacacacaagcaccgagaccaccagcaaacagacagacggcgagcacgactccgatccaccgagaatgcccactaagacaccagtcagagcaatcagtagaccacaacgcgcacacaactacaccacccacgatcacgcagcaccgctacctcgtgccacgaccgcacgaccgaaacagatcgaccgagcagacgccaacaccaggatacagccgacgccgagaagccgcacagcgccagcgaccgcagtcgcagggcacgaccgcgcggaacagactcagcacaacacacgaacacaccgccaagccacaccgcacccacccccgccgcacgcacagcgccgcgc

SEQ ID NO: 582720 - DNA, 147 bp, Homo sapiens
cggttgtcagcccccttcctttcccccgacctaaaacataaaagacaaggcaaagcccgcataattttaagatggttttttaggacattagtccaccatttttttggtttgctggctttccgaaataaagtccctttccttgctcca

SEQ ID NO: 582721 - DNA, 883 bp, Homo sapiens
  misc_feature (12)..(12): n is a, c, g, or t
  misc_feature (65)..(65): n is a, c, g, or t
  misc_feature (67)..(67): n is a, c, g, or t
  misc_feature (85)..(85): n is a, c, g, or t
  misc_feature (88)..(88): n is a, c, g, or t
  misc_feature (93)..(93): n is a, c, g, or t
  misc_feature (103)..(103): n is a, c, g, or t
  misc_feature (107)..(107): n is a, c, g, or t
  misc_feature (111)..(111): n is a, c, g, or t
  misc_feature (122)..(122): n is a, c, g, or t
  misc_feature (130)..(130): n is a, c, g, or t
  misc_feature (137)..(137): n is a, c, g, or t
  misc_feature (147)..(147): n is a, c, g, or t
  misc_feature (153)..(153): n is a, c, g, or t
  misc_feature (162)..(162): n is a, c, g, or t
  misc_feature (184)..(184): n is a, c, g, or t
  misc_feature (298)..(298): n is a, c, g, or t
  misc_feature (326)..(326): n is a, c, g, or t
  misc_feature (331)..(331): n is a, c, g, or t
  misc_feature (337)..(342): n is a, c, g, or t
  misc_feature (345)..(345): n is a, c, g, or t
  misc_feature (350)..(353): n is a, c, g, or t
  misc_feature (395)..(397): n is a, c, g, or t
  misc_feature (406)..(408): n is a, c, g, or t
  misc_feature (415)..(416): n is a, c, g, or t
  misc_feature (430)..(430): n is a, c, g, or t
  misc_feature (443)..(443): n is a, c, g, or t
  misc_feature (452)..(453): n is a, c, g, or t
  misc_feature (457)..(457): n is a, c, g, or t
  misc_feature (460)..(463): n is a, c, g, or t
  misc_feature (465)..(465): n is a, c, g, or t
  misc_feature (493)..(493): n is a, c, g, or t
  misc_feature (500)..(501): n is a, c, g, or t
  misc_feature (505)..(505): n is a, c, g, or t
  misc_feature (510)..(510): n is a, c, g, or t
  misc_feature (516)..(517): n is a, c, g, or t
  misc_feature (521)..(521): n is a, c, g, or t
  misc_feature (523)..(523): n is a, c, g, or t
  misc_feature (527)..(527): n is a, c, g, or t
  misc_feature (532)..(532): n is a, c, g, or t
  misc_feature (553)..(553): n is a, c, g, or t
  misc_feature (590)..(590): n is a, c, g, or t
  misc_feature (681)..(681): n is a, c, g, or t
  misc_feature (707)..(707): n is a, c, g, or t
  misc_feature (718)..(720): n is a, c, g, or t
  misc_feature (729)..(729): n is a, c, g, or t
  misc_feature (738)..(739): n is a, c, g, or t
  misc_feature (741)..(742): n is a, c, g, or t
  misc_feature (754)..(754): n is a, c, g, or t
  misc_feature (758)..(759): n is a, c, g, or t
  misc_feature (778)..(778): n is a, c, g, or t
  misc_feature (781)..(781): n is a, c, g, or t
  misc_feature (786)..(786): n is a, c, g, or t
  misc_feature (793)..(793): n is a, c, g, or t
  misc_feature (797)..(797): n is a, c, g, or t
  misc_feature (799)..(799): n is a, c, g, or t
  misc_feature (805)..(806): n is a, c, g, or t
  misc_feature (808)..(808): n is a, c, g, or t
  misc_feature (812)..(813): n is a, c, g, or t
  misc_feature (818)..(818): n is a, c, g, or t
  misc_feature (846)..(846): n is a, c, g, or t
aacactacaganaatttctagacttgagtgacaaaagaataccacattatttgcacttgtaattngnttcctttttacgcatgtnggnaaganaaaaaaaaantagnatanggctgaaaganaaaataantaaatantatggaaatntttatnttgtaaggngagggttatgttaaaagaatangattaacatatttagtaaacctattttttgtttaacactagttaatcaaagttattttttttccttttgatgacctattttttcatatacagactggaaataacaaaattttanatgtctttttttttttttttttcgggcnggggngggggnnnnnnaanggggnnnngggggccatccattcagattttaagcattttgatttatttannngggggttgnnngtggggnnggattactttgaanagtatacgggggnggggggggnngggnatnnnngnacagcggggagtacaatcagtatctgcnatatggnngggntgggnggaggnncttngngggnctcgnggaaggtgccttgtgtcttgngtgagtccactcttcttgcgctttgggctggggtgcnatagctgttatcataggaatcataactctgttcatcataagcagtgccatatccatcatcatagtcatattctccataagtctcttgtgtngggggtggcggtggaggtctgtaccnaattggggggnnncctcttganctaaaaaanngnngtcctattcccncatnnaggaccagggtgggcctgnttntttgnttttttntttncnaatggnncnccannccccngaacgggcggtcccccccccaccccggnaatgcggggcggaacccccctgtcgcaagggggtttc

SEQ ID NO: 582722 - DNA, 635 bp, Homo sapiens
  misc_feature (207)..(207): n is a, c, g, or t
aaaccagattgtacatgcttctttgcacgacactattatagacctcacctatggatactgcactacacgaccgaatagatgggaacactcaaaggtcaggaaagtcccgccccttggaagcctgacaggagtaacattaactttactcataagcttctagcatcgacctgaaagtagcgtgcatcgacatttcactcgtagctactntacgcagactagaattattcatgatccacacataccaagccgctagagagctctccaaaaccttacttgaaaccacttcccctgaaaaccttaccacatttcacaacgtggcctgcaagccttggttcactcgaattgttagaaactatttcgaaaatgcgttcgcagtgagagcacatattcaaccattgaatgtgactgtaatgtagccacttgaacagcgaagtagagcgtggtctttagtacggtacataggatagcacatcttgtaacgagatctcgcacctgtatttgagctcgccttaaaggccgcatgtgcggcaagccctccgactcggcgtggggtcagactaagtaccttgtgcacgcattgactcttgaagaatctaaggcaggatactggatataatactgcgctcatactcatg

SEQ ID NO: 582723 - DNA, 421 bp, Homo sapiens
atgaggctgacaggaagcggggagggaggcaaggagtggggtgcagtgtgccaaaaggggaaaaagccagaaaaggcattattttgaagaattcaagcagaatagtgggacctgaaatggattatgaaataacggaaacaaaaacagaaatgacaaagaggtcaaaccctttctgatatgacagaggatgggcttatccagaaatgttcccaacagttctgtagttagcttctccaagaactgtggggaccaacaggaaaatgctcactgctcttacctggaagctaaagtggcttccaagcacatgtgtgcccagcatagtgattttttttttccctataaaatccctggagacccacacgttcagaactcttgcttcttgggaataatgtgtgtgggtaccaaagctatgcaaaaggaa

SEQ ID NO: 582724 - DNA, 646 bp, Homo sapiens
  misc_feature (105)..(105): n is a, c, g, or t
  misc_feature (636)..(636): n is a, c, g, or t
gatcgaccgtcttcagactgttaaggattgtggtagagaactgtgacagccactctcagatcaccctgaaccaaaggcccctatcaagtaacaatatagccaagnaaaattccagtcaatagagacattgactggctggctggcttcccaagggatagcaccagacaagaaatgcaaggatgaggaaaccaggcacgggagagagaggggcaacagaggtccagggtttggttatctttttatttttcactgggaggtggtaagttagccctgttgcccatgtatgcagatgggagaagtgatttagaaactccaaagcaattggtaatccccaaaatgggtgtatctggtttgaaatgaaaccttattttattggaaatggttggtttcccaattctgtttgccattggccaatataattgtgggtttgcacatggccagcacatgccaaacagaagtagacaaaggtctcactctgtaagtgggaccttggggaggagctgcctccatcataaagggaggggttagtaaaaatggtctcttaagcctgttcctgctacagttatagaggttgctcagaaccttctcagcaaatatagcagttatctattgttgtgtattaaaccatttcaacantaaaaaaaaa

SEQ ID NO: 582725 - DNA, 215 bp, Homo sapiens
tgtggaggctacagaaggtttgggggatgatgctcttggccagggacaggaagaaggaggtgctgggatgtagaagaagattggagctcctcctgagctggatatatcccctggggcagctgggtggggcttgaagatggtttctttgggcccccaaccaagggaacaagtccaactcagatctggtgtaataactctcagcttccagttgatca

SEQ ID NO: 582726 - DNA, 102 bp, Homo sapiens
gcggccgcctactactactactgctcgaattcaagcttctaacgatgtacggggacatgtttcattgcctgaataaaaactgtttaccactgttaagaaaaa

SEQ ID NO: 582727 - DNA, 1172 bp, Homo sapiens
aaaggcagtggtgttaaacaacgtggatgtctgtgggacaggccagggaaggagggcagagacatgggtctccatgttcaccttgcctgcagaactagcctaatctgtccctgcttactggtcttgtgccacttgtgcaatcatggggaagtttgactaccccgcctacactatgtggctatgtgagctatggatactacgtgtgccacgcccaggataggtatgccagagtttcattaaggcctgctggtgtcggtgcttggagtgctatgtagtacaacctcgcgagcagtactgtggcagcaggagggcctggaatgcctaggtatggttcttgtcatatagacctctacttgcccttgtagcacttaacctttgcatttagcaaccttgacctagcactaggccctcacagactagttaggacgggaagtacgcctacttgcatgggcaaatattatacccactgccctgtgaatctcctatgtgccttgtttaacagattccagggccaagaacctcggcagggctgacggaacgcaagctaaggtacgcgatggcgttactgccgcgtatcacggactggcttctgtgacacagggacttgccgtgtaacttctgaaaccaccgaatgccctttaaccacctattggctcaagggcgcgcgtggggtaaatgcataacaaacacaaaaccacgtgcagggcaaaggtctgggcaaacgccataaacgtggactgcactccagaagactcaagcccctataaatcctaaggcctctggggacgacctggctgccatcctcaataaccgggcacactgggcattcccacggacagccctggtgcgggagcggcatatacacgggaccgagaagaggccaaccacaggacgggactcaagaagacaggagacgaagtcacacacacaacaacaggccataaaccaccgcaataacaacaatctggcacacaacccgatgcatcaaacacgacccaaaacaagagaggaaaggggcacacgggccgccaatagtcaaacggggtgaaaaacgcaagagaaaagcagcacaccgctacaccagacaaacagaggggacgaaaaaacggaggacacagccgaagacacagaaacagaacaagaggccacagcgcgccagcagatcaactgcg

SEQ ID NO: 582728 - DNA, 1023 bp, Homo sapiens
  misc_feature (1)..(1): n is a, c, g, or t
  misc_feature (487)..(487): n is a, c, g, or t
ncctgtcgctcgtgttttctcttctatttatgtttcgttctgttgtgatctatgtactctgtgactgtatattgtcctcgcctcgtggtgtccttcccgtcattttttctgtgttgtgttcccttgtctcctgtccataccttccagctttagatagcacaagggctcttccctcctgcccgctcatgccccctggtggcccatggccccaggtattcctgtgacctcccgctctcttcggctgctttctcacgtcgtctccagaccccggtgtcgcttccaggttcttctgcccctactcccttgagaccttccctgctgcgctacccggagtacgccatgcccttggacctgggtccccggatccccaacccctggaggtttacagctgacttcatggtgacccatgcccacctggttttcttgtttctgaccgcgccgcaacctcatgggggaacagtaacctgcccgaacccaggagatttcnggggcatgcgctgctgctcggcagacttccacgtgggtgcccacgtgaacacgttctggaggaccccgtgcccggggccacctgaagggctcagccaaaagtcgttcctttgggagaataagcacatcacgtggtttgccccctggacggcggcatccgggctgctgctgcccaagcaggagaagacctaccggcggctgctgatgccccagaacgcgctgacccccaagctgccacaccacgccggcctcaacccccgcgccttccggatgctgcaccgtggaccgccgcaccctccagaatgccgtgcgcaacgtgctggatggggagctgctccaccgctacctgtacctgagcaccctggagcgcagcgagctaacccagaagatcggcaccacacccagacataatcctggacgacttgctggagacggaccgccgtcaccgcccacttctagccccgtggaagccgtcacccccagcacccggaactacctcccaccccctttttgtaccaaaccaccaggaaaaacctt

SEQ ID NO: 582729 - DNA, 995 bp, Homo sapiens
tcaacatggctgtgtcattctggcttacatatgttttgatttaacagaaattctagtcataggggataaggggcctaatgtaagacagaggcttcatgttatgacaagtacatacactattatgtggtgatcaagtttttagaaagagtgacattaagaagcccatagtgccataatcatttgcagtcaaactggtgtcttatctctgctgataagtctcctgtgagatagactagtgtagaagggtaggtggttctcgagtctaccttggagtgcataagacttacctagacacggctgtgtttctaacacgttcagaatttccatagcttctgtagcccatgggatgggcctcgagagtgtggtattgggcttgtggttcctggaagcacatcacgtttgtgatagaagtagtaggttccagagaccaccggagacgagaactgcttcaatcggaatgggaatgtagcaaggaagaaggtacaattcagtattgtctggaggcagagtgggcatctttgtacctgaggtacagaatagcgatggtctcttgcctagataacaatgcccaggcgataaacggtgtgtcagaagtagtaacgagatgccttatagattcaggaggattgatctaaagcctctttcaagagctaggtttctcggtccccatcgtctgtcacgtgccttgctcgtggagagcgatgcttggtaacagggtaatccgtaatgttctagatgttacgttcagggatttcctaaagagccaatttttcggatagttccccctttgcaccatgccgttcaccacttccgcctgcgggttggactgtggaacgcctaggattcttgtccgccataccggtcggacaacctttcagtgccatcaggttaagggagtattggccaaggagaagaagacgaggatcctaaatttggtgttcattagtcgaacgtaaggaacccctattagagaactttgggccacgagtcagggg

SEQ ID NO: 582730 - DNA, 208 bp, Homo sapiens
  misc_feature (29)..(29): n is a, c, g, or t
gccttgccaacatagtgaaaccccatctntactaaaaatacaaaaaaaaaaaatttagctgggcgttttgggcacctttaatcccagctacttggggggggtgaggcaggacaatcgttttaacctcagggggcagaggtttaagttagccttagaacgtcccacttcacttccagccttgggaaagatttcgagactccctctaaaa

SEQ ID NO: 582731 - DNA, 105 bp, Homo sapiens
cgcacacagtggtctactggctgttttctccctggcattacatgagaatatcatgccctacttttatgaccttggcttctacatttgtatggtaacctgtgaaac

SEQ ID NO: 582732 - DNA, 1160 bp, Homo sapiens
gggacttggaaggcaattctgataaagagttacagagacatttcagccatcattgcaaaagccaaccattccaacagcagtatgtaggcacattcattttcatcaaggcatcagccatttcattccaacaacaccatttttcaaactgtttcactgtgtcatcacaggtcatgtggcacattcagctgctggcagaggtagtagcacattgcacagccattttcaccgtttccacatagcacatattcaaatcatatcattcatttccattgcgtcaagtcattcccaaccaagctttacaaagggtatctcattgtgtcatcatcaatggtcaaccatcacacatcaaccaaaaccagcaatgcgtcatcgttcaaaacaccaacacactggtcctctccattctcacacgcacattcagcgagcttatttaatcaacaatatctatgatagcattaccagatcccagggccacgggcacaaggccaagcaacacaccaggtgtcatccgtccaaaaatgagcaatcaaacaatggcacggccaggagattaccacattcacaatctatcggtgttctctcccacgagcaattggacatattaacgcaccatatgagagcgatttaaacaatagagggacacttcccacatttcaaaacccacacaagcaaagtctttgcacccctgtgctaaggattactttgacaactcgtttgggggcacaccatgggggccaatatactgacacatcacagatggccagggattatgttcctccattcgaaacacaggacaccaagatcacattatcacagaactgttggagtcacaaacaggaatcagagacatcaagaggagacacccagtacgtcagagcatcaattaacaaagggatcggaccacggggacaaacagacacgagccaaaagaacagaccctcacaaatggactagaaaaggaacagatcaagtaaacctatcaacttacaaagagagacacatacgtcaacctcgaccgttgagcaacaaccccccatatccaaccaataccacatgaaccaaattcccccctgcgagacatcacaaaacgagggacccagcgagaacaacacaacacggggaggacaaaacaagggcaggagcacaggccatagcaacga

SEQ ID NO: 582733 - DNA, 104 bp, Homo sapiens
agtcaagagaggaaggaaggaggatgagggtccctgttcgagtgatcaagtgtactgggttgcccagtactggttcagattttgacataggaaaagtctcacat

SEQ ID NO: 582734 - DNA, 1525 bp, Homo sapiens
  misc_feature (410)..(410): n is a, c, g, or t
  misc_feature (412)..(412): n is a, c, g, or t
  misc_feature (423)..(423): n is a, c, g, or t
  misc_feature (425)..(425): n is a, c, g, or t
  misc_feature (525)..(525): n is a, c, g, or t
  misc_feature (1269)..(1269): n is a, c, g, or t
  misc_feature (1439)..(1439): n is a, c, g, or t
gagaaatcctctgctgaagacccctggtctgatctgcctccaacatgtataagttttatttgaaatacataatcttttcactatgctttggtggggtttcttttagagtatgtgtaaaaatgtgatgctcagataagtacattgtatatcagttcagtgttagaaatgcagtctcgttgagattaaaggtcatctttattttaaatgcagtgataaagtgtcaactcttcggagaaactaggagaacaacaacagaaagctgtgttgtgtctttttgtcgtctcaaagtatatctcccgtatgagatttcaggtccccatgttttcaccaagcaatctgctatgtcagccaacccaacatcactttctacaggaggttatgatttttgccatttactagaggaagatgtntnatgaaatcaantnggggtttgaattcaggtgcagtcatcagttctttaggggctgcaatgttttaaaaaaaataagtcatcagattttaagaaaaaagtgatgatttcttatngatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatccctgaggactgtgtagactttatgtcagttctgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaanccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccnaaggtcaactgtaatgagataattatccctgcctgtgtccatgtcagactttgagctgatcctgaataataaagccttttacctta

SEQ ID NO: 582735 - DNA, 698 bp, Homo sapiens
aattctaggcgctattttcaacacaatcgtttgggaattgcctcctttttccatagccaaggtgtgtagaaaaaaaaaccggccgcagcttcaaggaacatgacccttcttgtaatgggttccatgcaaacctactctggcaagcttggtaaagaaccccaaatccccgtaaagttaggctgaggtgaacttctcaaccgaagaaaacccgttgttctaaaggttgagtcaggcaaggcttcggtaagtggagagtgaattttcgtaaggacttgtgtttgctgttcaaacaagtatgcgcctagaagctccatagaccaggattttctttgtgaatagaactgtgtaggtaagatgggcttcagccactgaactgcataaagaaccgggccttatgtacaggcattgagctctctcattgtctgtgtagagtgctatacttgggaatataaagtaggtgaccgtaacagtgttaggaggtaaacttggctcctgtgcttctcccgggctgtgtgccaccaggcacagtacgtaccctaaactcatggtgaggtctgataacataaacaccctttctgaataattccctccgcaaattattaatgtagataagaattcttccactggatctaacgatgacgtttatgtagcatgttttctctggagtattctataagttgtatgtttagccaatcaag

SEQ ID NO: 582736 - DNA, 815 bp, Homo sapiens
  misc_feature (696)..(696): n is a, c, g, or t
  misc_feature (718)..(718): n is a, c, g, or t
  misc_feature (721)..(722): n is a, c, g, or t
  misc_feature (736)..(736): n is a, c, g, or t
  misc_feature (739)..(739): n is a, c, g, or t
  misc_feature (751)..(752): n is a, c, g, or t
  misc_feature (754)..(754): n is a, c, g, or t
  misc_feature (777)..(777): n is a, c, g, or t
ggtgagcctcggggaggacttgggctttgaccttgaaggagatgggagccatgtagggttgcaggcagaggagggactggccctgactcaggtgcttacaggtgccctctggtggctgctgccaggaggagactgcaggggaaggagaaccaggaccaggtggaggctgtttccccgtctctaaaatgggaggaaagctaggatgcatgccagtgctggcacacgcctgcactccatgtgagccgtcaatgcggaggaccctgcttcctgcccgccgttattgcaacaatgacccagtagctccgagtccaagggcacagcctctggcacgatgcctgggctcccatctcagctctgccacttgggcaaacatttactttctggagcctcagtttgcttatctgtaaagtggggagtgaacagtgccctgcacacagatttgttctaaggactccagaagttgctattaagaagagggactgggcttggtagctcacgtctgtcatcccagcacttgggaggccaaggcaggaggactccttgagccgaggagttcgagaccagcctgggcaacacagcatagtgagagcctgtctctatgctgtgttgcaaggcaggaggactccttgagccgaggagttcgagacagctgggcaacacagcatagtgagagcctgtctctaaaaaaaaaaatgnaaattagtggggtggtggcaanctnngtcccaggtaccanaangtggggggaggnnantgagctggaggtggggggggganttttctgcatgttcgtggggagaatggcgttttagaaa

SEQ ID NO: 582737 - DNA, 228 bp, Homo sapiens
gggtttatcgatttcttcgcttgcaagctttttaactggatgtggtcctacttacctattttggctttagtggcctggtgctgtggggggtgttcctcaaaaatcttggcccactctaatatccgggagcgtttccccaaggtttaattttagtaggttaaatagtttgaggtcttagattgaagtgtttcatccggattggattttggtatgtggcatcgataaaca

SEQ ID NO: 582738 - DNA, 1152 bp, Homo sapiens
ggtggaacgaatggatgaagaatttaccgaaacataatgcaaaactactgatcctcactcgccagagtagctacgtggaggcacttgaccggatgaggcccagtgtgtgtgccagtcatcgagcgtgtgcaggcgctacctggaggagacagggcactaccagagggagagtctgagcgacgatctactctgactgctgcaatcactgtcaggaccatagtactagaggttatagatttcacgaacgggcgccgatcgagacgcacagcgtgaaccccgaccgtgtagtggtcgtccgtcaaagattgtcgtgacggcaaaagagcgcaggcgaggaacagactggagggtcgagagacatcgtgcctgtggttgagtgggagggagacctgctgacataagttacagtgctacggcgcaaggaggcgaacacaggagccggaaatctcgggcacaatgctgtgccaatccatcgtggccaacagtcgtagccaaccaatggctctgggaacggtcgctcgctggggttacgctaggtgcccggtcggacccgtcgatcgctccatgatgcgctacattatgctaaggcggagcaaaacttatctcaaggggcaatagcatagaaacgctggcgctaggatagcgatgactctctttataaaaagacacgggcgactcgatgggttgccaggcttgggggcgcatttcattgatgccattcgccgctcgagagggtgccttgtagcacgacaagggatcagcgagcatcaatagcggccctcgtgttcgtgggaaacaagtctctaggttcaggatgcttgcgacaccagaatggctcgacacgggcaagcatttcttggcggttcccaaagggtgagacgtgccatagcattagtcgcccacgtcgcggtggccaagtggcaaagcggccaaaccaccgaagggaaaggccgagcggaaggaacaggcggttgagtgacgccgggacaggccgcgatgcagggggtcccccgccgatatcgcgagcgcatggcaccaattccaaacccctggggcacgcgcgttgccatggaaggggtgggtgatcagtaaccctagtgagatagaattcgtggcccaatgtccatcccgaggggtaaggaattcgcccta

SEQ ID NO: 582739 - DNA, 939 bp, Homo sapiens
atgtccatttccaacatcacagtctacatgccctctgtgttgacactagtagggatcccaggcctagaatctgtgcagtgctggattgggattccattctgtgccatttatctcattgctatgattggaaattccttgcttctgagcatcatcaaatctgagcgcagtctccatgagcccttgtacattttcttaggcatgctaggagccacagacattgcacttgctagcagcattatgccaaagatgcttggaatattctggtttaatgtgcctgaaatctattttgattcctgcttgcttcaaatgtggttcatccacacattgcagggtatagagtcaggcatccttgtggccatggccctggaccgttatgtggccatctgttatccactaagacatgccaacatcttcacccaccagcttgtcattcagataggaactatggtcgtactcagggctgctattcttgtagccccatgcctagtactgataaagtgccggtttcaattttatcacacaacagtcatctcccactcctactgtgagcatatggccattgtgaaactagcagcagcaaatgttcaagtcaacaaaatctatggtttgtttgtggccttcactgtagcaggatttgacctcacattcatcacattgtcctacatccagatatttatcacagtttttcgtttgccccagaaggaggctaggtttaaagcattcaatacctgcattgctcacatctgtgtcttcctccagttctacctccttgccttcttctccttcttcacacataggtttgggtctcacatccccccttatatccatattctcttttctagcatttacttgctggtccctccatttctcaatccacttgtctatggtgcaaagaccacacagattcgcattcatgtggtaaaaatgttctgttcataa

SEQ ID NO: 582740 - DNA, 182 bp, Homo sapiens
tgcacttgactgtaggtgtaagtcagaaattgaatctatagtacaaaaaaagtctcagtagtctttgtgaaaataaacactctcagaggaacggttcacaacaaatattattgcaagtttatgtagaaaaagaacgtatttggatttttcctggtaacgaaataggttataacaaagatgaa

SEQ ID NO: 582741 - DNA, 377 bp, Homo sapiens
gctgtaggaattcggcacgagctcgccacgacatatgagaccactctatagaagtgctgtgccgctgtagatactcatgagtgctatgccaaagtgttcgatgaatttaaacactcttgtggaagagactcagaatttaatcaaacacaattgtgagctttttgagcagcttggagagtgccaatttcagaatgcgctattaggtcgttacaccaagaaagtgccccaagtgtgaacttcaactcttgtagagggctcaagaaacctatgaaaagtgggcagcaaatgtgtgtcattctggagcagaatgcgcctgtgcacaagactatctattcgcgggcctgaaccaggtatgtgtgttgcatgagaggcgctgc

SEQ ID NO: 582742 - DNA, 3065 bp, Homo sapiens
  misc_feature (2025)..(2025): n is a, c, g, or t
  misc_feature (2875)..(2875): n is a, c, g, or t
  misc_feature (2956)..(2956): n is a, c, g, or t
  misc_feature (2958)..(2958): n is a, c, g, or t
  misc_feature (3027)..(3027): n is a, c, g, or t
  misc_feature (3039)..(3039): n is a, c, g, or t
  misc_feature (3047)..(3047): n is a, c, g, or t
  misc_feature (3065)..(3065): n is a, c, g, or t
ggcacgaggccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccgagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtcgtaggaagaaagtgctgatccacgctgcagcctggatgagccttgaaaacaccatgcgaagtggaagaagccggagacgaaaggccgcgtgtgtgtgatctcatctatatgagcagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccntgggctggcccaggaccgcgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatccgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggtcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaatttgcaccgagccagtgtgttgatcgaagaccacgattgcctgtgtttctgagatgcgtccatggaaaaatggaaaaaantgtggtgcgttgacttgctggaacccttcctaagccgcagtgaaaggaggggctagatctgtgtgtgttcatgcagctcananacctgatgctgaacggataagcaaggccatctacatacaaaagtacacacaaattaattcagaattgangttcttgcaaanacattacngtatgtatgcaaaaatcn

SEQ ID NO: 582743 - DNA, 135 bp, Homo sapiens
aggatatcttggggattgctttctgtctgaatttaattaaaacactgaagttgcccaacttcaagtcatgtgtgatactctctaggctctctctctctctctatagatagtatattttgtgtgtttcataaacac

SEQ ID NO: 582744 - DNA, 462 bp, Homo sapiens
accccagcagccctacatcgcggggcagcagcccatgtaccagcaggtgagccattcccggggcctcacagcggcacccgcagggcaccctcaggcttcacggtttagcaatgggacccctggccccagtggggattgtcccgtacgtctgctcacagggggagacgcatacccgaggccccttctcagcagacagaacgaggacacaagtctcagggcagatacgcgcatccgcaagtgtagacaggaaaaaccgtgaatttacttgaaaggcaaaggccgcatgagctggctgcatgagctgcagtccgtggacatggattacaagcacttgtgggtctttggctctgctgggacaaaagccttcctccctgggctggggaagggagaccagggccatgcctgctttcctcctgcaatggcaccctctgcgtccccccccacagagagagcgtcggtacc

SEQ ID NO: 582745 - DNA, 752 bp, Homo sapiens
  misc_feature (562)..(562): n is a, c, g, or t
  misc_feature (643)..(643): n is a, c, g, or t
  misc_feature (645)..(645): n is a, c, g, or t
  misc_feature (714)..(714): n is a, c, g, or t
  misc_feature (726)..(726): n is a, c, g, or t
  misc_feature (734)..(734): n is a, c, g, or t
  misc_feature (752)..(752): n is a, c, g, or t
agtcttcattgttttgattctgaagcataacgtgccaccgggaaagtgagtttctttactgtttgccagcagcacaggaccaaaagtgaatggtgggggctcaggagctcccagcttggagagaaggcccttccagacccaggaacccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaatttgcaccgagccagtgtgttgatcgaagaccacgattgcctgtgtttctgagatgcgtccatggaaaaatggaaaaaantgtggtgcgttgacttgctggaacccttcctaagccgcagtgaaaggaggggctagatctgtgtgtgttcatgcagctcananacctgatgctgaacggataagcaaggccatctacatacaaaagtacacacaaattaattcagaattgangttcttgcaaanacattacngtatgtatgcaaaaatcn

SEQ ID NO: 582746 - DNA, 225 bp, Homo sapiens
tgagatcgtgtcctttcgtacaggcaggaatttgagagtagattaaaccgacctggattactccggtctgatactcagatcacgtatggactttaagtcgttgaacaacacgaatcctttaactagcggcttgcaccaatcgggcatgtcctgtatccaagcatcgatggtctgtaaacctctatatgtcgcatatgtgactctagatactaggacttggcgctg

SEQ ID NO: 582747 - DNA, 533 bp, Homo sapiens
tagggggctgacgctctctctgtggggtaactttcttgtgggtgacgctctctctgtgggggacgctctcttgtgggtaacgctctctctatggggcagcagcccatgtaccagcaggtgagccattcccggggcctcacagcggcacccgcagggcaccctcaggcttcacggtttagcaatgggacccctggccccagtggggattgtcccgtacgtctgctcacagggggagacgcatacccgaggccccttctcagcagacagaacgaggacacaagtctcagggcagatacgcgcatccgcaagtgtagacaggaaaaaccgtgaatttacttgaaaggcaaaggccgcatgagctggctgcatgagctgcagtccgtggacatggattacaagcacttgtgggtctttggctctgctgggacaaaagccttcctccctgggctggggaagggagaccagggccatgcctgctttcctcctgcaatggcaccctctgcgtccccccccacagagagagcgtcggtacc

SEQ ID NO: 582748 - DNA, 1324 bp, Homo sapiens
ggcacgaggccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccgccgaggaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagagcttttttattttaccatctatcgtgtggagccttctgttttcctgtgagacgccctccagaccccagagtagttcctgagcgctgccttccgggaacttcccctcagctcaccttttgagttggagactgtttccaggatcctgtgttttccctttcttgtttttcacttgtgtttttctggaacccgtcctaagttcttaaaaagagtgtgtgtaagggaaactcagcgtccttatgagtttaaaaacatctgtgttctgccctcaaaaaaa

SEQ ID NO: 582749 - DNA, 261 bp, Homo sapiens
ctcgtctaagacccgtgtcacgagacccgtcccacacggaccggtgtgccctcccgatcatctttccggttccagagaagtgggcgggatgtctccatctctgtctcaagcttcagggtgcgctgagctgcaacttcttacttccctaatgaagttaagaacctgaatataaattggttttctcaaatattggctatgagaggtggatggattaattaaataagtcaattccgggaaggtgagagagcaaataaagacctg

SEQ ID NO: 582750 - DNA, 711 bp, Homo sapiens
ggcctccaccgccttccccggctgcccggcagcctcccctcgctcgctctcctcttcctctagggccccagcgcagctcgggagcccgcgcaccgaggcgctaggggcaccgcgcactagagggacacccgccgcgcctggacagccccggcgggcgccccctcgcacctccatgccccgagcgggccggctccccatcccccgcgcctgtgtccccaggcgcagggcctggcgtccaagacccagaacccgccggggtcccctggggacgcgccagcccggcaagtggctcgacgatggaggaagccgcagaagcgcccgctccgcaacacaggtcaccacgcaaccggacagactcccattcggcaagaagaaacttcgtacaaacaagacgagcacggccagactttccgccgaaacagaaacgcggggaaggttacattcacgacaacaccgtgcacccgggctgtttccaatctaatccgtaggcactgaagaatccgtaccgtgagaggacttggccgcgtgtcatgggacgccttcactagctggaaacctggagttaccttacccgggtgtccaccgcaattgagggactaggggtcactgtatggctagctggtaattatgaccggggggatacctcaagccgagacttacttccatccaattatctacgataacaaggacctacaccaagggattccccag

SEQ ID NO: 582751 - DNA, 122 bp, Homo sapiens
aaaattgctttgatggtttgcctaacagtaatgatgtcatgtatcgcctggatgtgttcattttggatgtctgaattcctttaaatgttctgcatttttgaaattaagtgtttttatgttaa

SEQ ID NO: 582752 - DNA, 774 bp, Homo sapiens
gagccacgtgacccccgtgcggccaacgggtgcgccgggatttgggggataaagcgcggcccgcgcacagttgcggcgggagagcggggggccgagagcgtgactcgcccgctccggctgttcccccgcgcgcctccccgcgcgctcgcgcagccatgtccgaggagaagcccaaggagggtgtgaagacagagaatgaccacatcaacctgaaggtggccgggcaggacggtccgggtgcagttcaagatcaagaggcacacgccgtgagcaagctgatgaaggcctactgcgagaggcagggcttgtcaatgaggcagatcagatcaggttccgacgggcagccaatcaattgaaatggacactccagcacagctgagatggaggacgaggacaccatcgacgtgtccagcagcagacgggagggtgtgccggaagagccatgctggcagggcaaaagttctagagggccgtcccagccggccgggtcatcctcgcattgtggtgaatggtgagccacgtgacatgccggaaccacaaaggtgtctgcgggaaactcgaggacattcaccagatgatttcctctcttgatgtcttcagtgcaactcacaactatatctgcagggatgatctgtacttaattgggcactcagatgtatcttgtcacggtaaatgcgtggagatatgggggcacttggggccctttgtgtttcccctttaaatttttaaccaatttgctgatggcgattaccgccggatgaccgagtggccacg

SEQ ID NO: 582753 - DNA, 423 bp, Homo sapiens
gggtatgaaataaatgaagagagctttctcatccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactttttggcccccttggcccacatcatttttgaattaacacatcttttccaagggggccaaatttggggtccattggccaattcccccataaggggggcggtttaaaaatcaatggccctccttttaaaaacttctatctgggaaaaccctggggttcccccaattaaatcctttggaaaaaaaccccctttttcacatggggcttaatatcaaaaggcgcccccccaatgcccttttcaaaaatgggcccctctgggctggcg

SEQ ID NO: 582754 - DNA, 401 bp, Homo sapiens
ctgtttgagctgttggtactgggatacaggcatatcacacgcctggtaattttgtatttttaatagagacagggttcgccatgtggccaggcagtctcaaactcttgacctcaagtgatctgcccatcttggcctcctgaagtgctgggataaaggtgtgagccaccacacctggccatcttgactatctaattgtttacttctttttttgttttgttttgtttttcaagacagtctcactctgtagcccaggctgattatctaattgtttacttctttttttgttttgttttgtttttcaagacagagtctcactctgtagcccaggctggagtgcagtgtcgtgatctccactcactgcaacctctgcctcccaagtcccagttgagcagttctcctcc

SEQ ID NO: 582755 - DNA, 448 bp, Homo sapiens
  misc_feature (249)..(250): n is a, c, g, or t
taactaatagcttatagctgtagctataggctggcttatgacttatggctatagctataggctgacttgtgacttatagctatagctataagctaacttatgacttgtagctatagctataagctaacttataacttatagctatggctatgagctaacttataacttatagctatagctataagctaacttataacttatagctatagctgtaaagctcactatagcttgaacttatttggttggtcnntgaattttcaaaatacaaatttagattaaatatgtgatttggtttttatttctacttttatccatgtcattgagtacttttcaggctgattgtaaaacatctttaaaaggccttttattatattgaagcactggtgttaatttctccttaaattgctttgaattgacttgtacttataataaaactaaaaaagcaaaa

SEQ ID NO: 582756 - DNA, 583 bp, Homo sapiens
  misc_feature (122)..(122): n is a, c, g, or t
  misc_feature (297)..(297): n is a, c, g, or t
agtcctccactcgacctccacatcagagtataattgaaagacgcctatcagacatttctatcaccaataatgccaacctctgtatacagcagcaggctgggccccaaattcagaagattcantgttgcttgcatttctactatacgggaacacgtgacagctttcggtaacgtatcactgtggctacttcctcggttctacttttccctgtgtggacaatgtaattacctcggtttacacgtgctctttgtgtgagtacgtatatggtgactaggaatacaaggagaaagtctgganaagcaccaagcacaaagcaggcctgaggctccagcaacagtcattcagaaacaactgcccactttatacgtaaaagtatgaaaggaatgccaatgtgagcccatgtcattaggagaggtaaggataatatacaccttgcttaaccatcacttaacctttttattgcacataatgaaatttaagccctaacctaggtctgtacttgtgtaataattatgcactctaaattagcatctgcatttagatagatggcaagcttagaaatcagtcctgcatttgacctctt

SEQ ID NO: 582757 - DNA, 316 bp, Homo sapiens
gagaaggagtacaggagctgatgaatctgtcatgctggccctgtgatgtggagatctgccacctaccgcaagctagtggagggcgaggagtgcaggctgaatggcgaaggcgttggacaagtcaacatctactgtagtgcagtccaccgtctccagtggctaatggcggtgcccgcggtgtcggcagtggctttaggcctgggtggaggaagcagctactcctatggcagtggtcttggcgttgggaggcgggcttaagttccagcacgtgggcagagcccattgggggggtgggccttacacagctctagttgga

SEQ ID NO: 582758 - DNA, 1059 bp, Homo sapiens
  misc_feature (587)..(587): n is a, c, g, or t
ggaacagggttcctgtagcaaagatcaccaatgcttggtttgagctgagacaatcagatggtgatgtgtgaccctcgaccgatggtgaaatacatggttctgctgtctgtgcgttcatccgctgtgtgactttggattcctaaaagatttcagatttgcattgtcaattgctcacatcaatgacacaatccgttccatccatgtattagtcgcgtaattgagtggtcccccacatggtctatctacaagtgctctaggtcacttcatagcatagctcaagtggcttcctctacatgtggggtggaccttggattgcaagaatccgtgtgtcgatcgcgataccaagcaagatgactagtaggtcgccaatcgtcgtggaagcataggactcgacacggcctaatttagggtgaaagagacgcgtgagggttccgtgcgtgcgcaccgagcacacgttatggagcctgaagtgtattgcgctagacaccgttgcccttctcgcttcacgtggctaccgcttgcgtggtacgagggccatggcgtctgaggctgacagtgcccccaggctcaggtgccctgactgtggnctgcagcggccgaggaaacgccctctgtgctgcggggggtctgtgtgcgggggttggggtgcgtgcggcagaggggctggactggactcccatcgtccgttgggtgacatcctccttactagtgtgtgggacatgagcgcgcttcgacgcaccacgcgctagtggtggacagtttcttgtacctggagggcttactacttgtatcaatatgctcgatggtgaccacatgcaatctgtggagcaaacgttgctgctggggctcatggcaacttcatgcaggtcaactttatgaaccaattgcttagcacagagtttggtgatcgcccttctcgaccttgtacatgaatggtacgtagcactggcgtaactggcttgcctatcatgaaccattggcaaacttgcactttgttgtccatgagaaacccataagctttctgcacccacctggcaggattgccggttattggccact

SEQ ID NO: 582759 - DNA, 384 bp, Homo sapiens
gttgtagtgttagacaccccaccttcagacttgtaccttgaaagcttaatctcgtaataaattaatccactggtaataaagggaaatgtatgtcctgtggctaaaggatcctcaaacttgccatccccaaggaaaatcatgtatgagtatggctaaatgatggtctgtatcttcttggtaatggaaggggggttagatgttggcaggtaaccttgatggggagagtaatcatcctctaaagtttacacccccttataagcctaaggccatttaaatggagtaacctgagagagcattaatagatgtggctctagggtataaaatccattatctgatcattttccggacttcccccggattccaactaattggtgctggaggggt

SEQ ID NO: 582760 - DNA, 293 bp, Homo sapiens
ctgaaccacaagtttacatttaaccaaaaaaaggttcaccatgactgatgccatgttttcactgtttcagaatgtgggagtctttaagcaactacaggcttacatttttctcttaaaaaaaaaaaggaaaaggaaaaggaaacccaaggcaggttttggcccaaacttaaaaagtttattttctccacatccttgaaacaaaaactaaactaattggtgaaaatacgtaagcccaaaagaaaaacaaaacatgtctctttggttagaaatagccatctacaatttacctttaa

SEQ ID NO: 582761 - DNA, 341 bp, Homo sapiens
caatagatcatcagacgacgcgaaacgatcacatacacgatgcttagatgtgtcatacaggaacctacataccgcgataatcgtgtggtgtatggaggaggggctgctgaaatatcctgatgcccctggcagttagccaagaggcggataagtgccccaccttagaacagtatgccatgagagtgtttgccgacgcactggaggtcataccccatggccctctctgaaaacagtggcatgaatcccatccagtctatgaccgaagtccgagccggacaggtgaaggagatgaaccctgctcttggcatcgaccgtttggcaaggggagctctggcaagggg

SEQ ID NO: 582762 - DNA, 261 bp, Homo sapiens
gcctgacaatggtgaaacgacaagtttatagcccttcgaaaggcagatggcttatctcatcttattacctaaactgtgattctaaaagtcagataaatatcatcaataaaaagatacttatatttaacatactttatcgacagcttccctgcctctagctatatcctagggtctccaaaccactctaaacacatccagggctttagtctactagagtgtgcactcccacatagaatactgtcactcaagaaggaaaatcag

SEQ ID NO: 582763 - DNA, 1575 bp, Homo sapiens
gttcgtgaaaggaattagggtgtgtcatgtgttgccatgaaacaacgaaaccaactaccctacaatcatgtatgcagggggtactagaggtagaaataataatgaagggcaggataaacatttgtatcctcacgtactatccatacaaagtcatagtacctgaagagtttaagcttctagggcgatgtcctcggcatagcagattgcgtcgtactaacttatgtgagtaggtcattcctcgatataaaatgcgagctctctaaccatctactaaattgcgtacacgatgcactgttcgtgcaacactgagctgcgcttgtccctgtcctgattgacaggtgattagcaagggggcagccatcgtcgactctagtgattagtacacccgctttactacgcggcgcacttattagactatgtggcccacctttacttacacgccacacgcgtgagaaatgcgtccacgtgacgtaaccattaagctctttcgtttacataccgcttgtatctgacattgacgaaacgcgttctcacgtgctaaatacgataaagagcgtagctactataaattaatttatttctaccaagaatagagctactatttggaggcattattggaacataaattcgcgggcatggacacaaataaatatcacggggggtggaaaaccattggaaaggcaggctcgccattcggtgtgtcggttatctagaaatttcctcggaaaattctttaataaataaacgagcaggcttgggaaaaacctcttactcggtttcttacccttggaatcggctattggcacccgaaatctcgattagaacatgacatgtacattttcgaggtttatttaactatccctataaaagtccgttatatcggttaaaaccggggtccatgggggcgactctttataccttactgcaacacggcccgaaactgttgcaacggacagggtatgtaccctaacaacgtttggccccaattcaaggtttgccccaagaatgacgtggggcaacacggcaacggagataccctcgcagaggctctgtgaaaacttattggcgaatatcacctaaaaaccaatgcccttggcacaccctggttattctcaccccctgtcaaacagtgggcaccttagatctaaacctctcgggcggacaacaaaccagctcatgttgggcattaggcaaccgtgcagggcgacaacagggggaccgtttatacaacacgcgcgcgccagaactggggaaggagaagcaaacatcgcgccacacgtggcgtctcgacaagacgacccacaatagccacacacgaagacaaaacaaccacccacacacagacggcgcggcgcccaaaaagaccaacacaaggggcacaaccaggccgacccacacagggaaaagaggagagcacaaacgcggagtaacaagaaaaaggggggcgaaaaacccagggaggaaaagaagagagtgtcgaagaaaaagagcgcgagagacgaagacaaacacacagcaaacaatgaaaagagaaaccacacgagaaagaaacaaacagacggcagagcagggaca

SEQ ID NO: 582764 - DNA, 862 bp, Homo sapiens
gttatggtggcgcccgccccgcatctggcggctgtctggggccgcccttgggtcgcgctttgtgtgtcctgcttggcgcgcggtgggttggtggctctcgtgagggcgccctctcttggcgtgcgttaggctcgcggtcgtgccgggtgtgaggcctcgatgaccggcggcacccctggggcaagggggaggactttcgggccggcacacggtggcccggtgccggggtgggcgcgattgagtgccggtcgtggcagaacgtcgcggggtcgaccgctcgctggtggggagcgcgtcatttcttggtgcgtgcggtccgccgcctgtgttcatctctcgtggcgtcacgaaggtgttgcccgtccatgcggtctctgactcgccgcgtggtggtgcatgtggttgctccggtcggagggagtgcttcccgtcgggggattgcctaggcgtctgttctgcaccccgtggactgttgggccctgtgaggcggctaccgctattggcccccgttggtgtcccccgctcccgcctggtgcgcgggtgtaggtccgcctgcgccacggtgggcccgagacctctaggtttctgtagctgacgtgtctgcgccccctaaggggagaaaaggcagcttctccccggcagtcagcgtgtgcaaggcgcctcagacagagatgtcggcggctttgattctgggcggcctacatgtccacctgcgtggaagggcacccccggcgggacgccagggagtataaactcataagtgtgcgcatgcacccccgaacgtgaaagaatttcacgcgagtgatccgctgtctttgttctatcaattgaccgtgccccccccaacaccccaaccaaacgg

SEQ ID NO: 582765 - DNA, 620 bp, Homo sapiens
  misc_feature (179)..(179): n is a, c, g, or t
  misc_feature (325)..(325): n is a, c, g, or t
  misc_feature (358)..(358): n is a, c, g, or t
  misc_feature (391)..(391): n is a, c, g, or t
  misc_feature (398)..(398): n is a, c, g, or t
  misc_feature (445)..(445): n is a, c, g, or t
  misc_feature (456)..(456): n is a, c, g, or t
  misc_feature (459)..(460): n is a, c, g, or t
  misc_feature (467)..(467): n is a, c, g, or t
  misc_feature (498)..(498): n is a, c, g, or t
  misc_feature (510)..(510): n is a, c, g, or t
  misc_feature (518)..(518): n is a, c, g, or t
  misc_feature (539)..(539): n is a, c, g, or t
  misc_feature (549)..(549): n is a, c, g, or t
  misc_feature (561)..(561): n is a, c, g, or t
  misc_feature (571)..(571): n is a, c, g, or t
  misc_feature (616)..(616): n is a, c, g, or t
cggcccatctcgtttatttttatctggcatataaattgcatatttttatgtgaaatgtggttgtatacattagaaataagatttacacatttcaaagcacactactgcaaaaataaattatctttaacctccaaactctcttttgagctttgcctgctcagatctcaatctcaccagtngccctttatgctaaggatttctcaagaccctcttcttcaagtgagttgactcttcctttttcctccccatgaggctgctgacaattttacattatgttcttacttaggacacttttactattcatcttcggttgcatctgactttnctttgggttggcctttttttgcttatcatgctncccccacctataaccaattaggtattattattnctcccancgcctataaccaactagcagatgttcttttctgggatactttctttnaagatgctganttnngctttcnaagaacctggaaccttgtcaccaagaaaggntttcttctttgngggatttnaacaaaaaagaaatggggggnccccatttcntattggaattancaaaaccggnggaccattacccccaccacctttcatttcattggggaccccaggntcca

SEQ ID NO: 582766 - DNA, 122 bp, Homo sapiens
gctagcggtcggtgttccagctgtcgcgtgtctccagctgtcgcgtgtctcaagctggtcgcgtgtctcaagctgtaggtctgcttgaggatctgcccagtccggcggctgccgtcctccag

SEQ ID NO: 582767 - DNA, 1060 bp, Homo sapiens
gaagatgccgcaatggcaagaaggccaagggaaagaaggtggctccggccccagcatgtcgtgaagaagcatggaggctcacgaaagtggtgaatccccatgttagagaaaaggcctaagaattttgggcattggacatggacatccagcccaaacagagacctcaccctgctttgtgaaatggccccgcatatatcaggttgcagcgtgccagagcagccatccgtctataagacaggatgaaagtgcctcacatgcgataaacacagaaacacccaaggcaccatggaccgaccaaaacagcgatacatcacgctgcatgtacagcatggaccacaaagctacagaccagacggaccaacagcaaagacgaacggacacgcacgacggaccgtgtagagcccggagccgacagaaaagaaaggctgcactgggccgaacgagggacgatcccacagcgacaggacgacccaacactgatccgtatccagagcacagcgaggttcacaacgagcggtcgaccgagccttggatggcagcacacagacagacaaaggctcagaacatgggatggctgatacggccacaaccgaccggttggaatccacatcggaggcctggattgtccgttctttgcagccgttgagcgaattgattgctcggacacacaaattgggcgagggcatacccaatttcacgatggcattccacgtcagcagggtgacaacaggagctaacgcacagtgcgcgcaacggggcgtaggatccgaagatgcgatacatgaatgcatggggcactcagcgaggatccgcagactagtaggtacgccagcgggtcgccacacatcagagcaaaggaacaacaaagagagcagccacaccggggcaacgacacacacaacgcggcgcacgaccgcaaacccacgaggacaccccgaagtcacaccgacatcaacacagaacatcacgacagacagatacagcaccgagacaacatcggcaggcttagacacagtgacccgaggcacagtcacacaagcgacacgaggcagtcagaaac

SEQ ID NO: 582768 - DNA, 271 bp, Homo sapiens
tgcgtgagtagtatgcggtcccagtctctaaaacccagcagacccatcgactggcagcctccatggtagacctaccacgtcactactagacactgccaccaacacagttggaagtcaacctggaggacatccctggtgaggggctgctcatatcctgggccttcactgatcgcccagatctcaccctaacggtgcttccccagcttcagaccagggagagaggtgaagaacaagtggagctctccacaattgaggaactgatcaaggatgc

SEQ ID NO: 582769 - DNA, 422 bp, Homo sapiens
atttgttaattgacagataataattgtgcatattcatgggatacatagtgatgtttttaatacatataatgtatggtgatcagatcaaggaaattagcatatccatcatcctcaaacatgtagaatgttttgtggtggggaccatccggaaccccctcctgggtaattggaaccccggatatattattggtcccttggagtcccctcccgggctgtagaacacaagcaagatccctcttctctagctataattttgtatccttgaaaaaatccctactccttccttccttgcctttactatcctccgttatactttttacttctatgagatcagtgttttttagcttccatgtatgggtgaaaacatggtattcaactttctgttcttacttcacttaatttcctgggaatactatccagcc

SEQ ID NO: 582770 - DNA, 4675 bp, Homo sapiens
gcaggacacagccctgccccacagccaagcccagcagagtggccccactggccagccgagccagcccccaggcacagccaccacgccactggagggtgacggcctctccgcgcccaccgaggttggcgacagccccctgcaggcccaggctttgggagaggcaggagtggccacaggaagtgaggctcagagcagcccgcaattccaggaccacacggaaggggaggaccaggacgcttccatcccctctgggggcagaggcctgtcccaggaggggaccggtccccccacctctgctggtgaaggccattctaggactgaagatgctgcccaggagctcctgttgcctgagtcaaaaggaggcagctctgagcccgggacagaactgcagaccaccgagcaacaggcaggggcctcagcctctatggcagttgatgctgtagctgagccagccaatgcagttaaaggggccgggaaggaaatgaaagagaagacccagagaatgaaacagccaccagcaaccactcctcctttcaaaacacactgccaggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggcgaaggggaagcagattgcgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccagtctcagaccagtatccttcaggggttctcttactctgatttgcggaaatttggcatcgtcttgtctgctgtgatcactaagtcctggcctaggaccgcggacaacttcgatgacattttaaagcatctgctcacgttggcagatgtcaagcacgtcttcagattgtgtggaaccgacgagaaaatactagcaaatgtcacagaggatgccaagaggctgatagctgttgccgactctgtgttgacgaaagttgttggtgacctcctaagtggcacgattttagttggacaactggagctgattataaagcacaagaatcagtttcttgacatctggcaactgagggaaaaaagtctttcaccccaggatgaacaatgtgctgtggaggaagcactggattggagaagggaggaactgttacttctaaagaaagagaaaagatgtgttgatagtctcctgaagatgtgtgggaacgtgaaacatctgatacaagtggactttggagtgcttgcagtaagacactcacaagacctcagcagtaaaagattaaatgacaccatgacagtgagactgtccacctcctcgaactcgcagagggcaacgcattaccacctgagctcccaggtccaagaaatggctgggaagatagacttgctcagagacagccacatcttccagctcttctggcgggaagccgcagagccgctgagtgagcctaaggaggaccaggaagccgcagagttgctgagtgagcccgaagaagaatcagaaaggcacatccttgagcttcaagaggtgtatgactatttgtatcagccttcttacagaaagttcattaagttgcaccaggatctaaagtcaggagaggtcacccttgcagagattgatgtcatcttcaaggactttgtgaataaatacacggacctggattcagaacttaagatcatgtgcaccgtggaccaccagggccaaagagattggatcaaggaccgagtggaacagatcaaggaataccatcacctgcaccaggctgtccacgcagccaaggtcatcttgcaggtcaaagagagcctgggactgaacggtgacttcagtgttctcaacactttactaaattttactgataacttcgacgactttcgccgtgaaacactggaccagatcaaccaggagctcatccaggccaaaaagctgctccaggacatcagcgaggcccggtgcaaggggctgcaggctctgtccctgagaaaggagttcatctgctgggtccgggaggctcttggaggcatcaatgagctgaaggtgtttgtggacctggcctccatctcagcgggggagaatgacattgatgtggaccgggtggcctgcttccatgacgctgtgcagggctacgcatccctgctatttaagctggaccccagcgtggacttcagtgcattcatgaagcatctgaaaaagctgtggaaggctctggataaggaccagtacctgcccaggaaactggtgagtcttattctgtctctaatgcagattttgttgaatagagcattgcttagcaacgttagggcagtgactgtggaaatggtggcacacctgtgtggtaggtttgtacacagccgttttcaatgatatttaaaaagcttttcttcataaatggaaattcaccatcttgttacctagaaagcaggatacaaaattacatgacacatagtaatctctaaggtgcaaaacacacgtggaaaaaagacagaagggaaatatgctgaaacgttgccaggagttttctctgaatggttgtaattgtcattttattctgttactttttgttattttctataattgatagaattttttatcagaaaaaagtaaacatttaaaattagccaggcatggtggtgtgcgcctgtaatcccagctactctggaggctgagacagaattgcttgaacccgggaggcagagatagcagtgaactgagatcacaccactgtactccagcctgagtgacaaagtgagactctgtctcaaaaaaaaaa

SEQ ID NO: 582771 - DNA, 245 bp, Homo sapiens
atttaccgtgccacggatataacccactgcttgaacttttgccagatgattcttccatagatgtctcttctccaagcaccaggtctagctctttctagaccagtctgaagaagccttaagaggccatcttctcgtttcctgagacatctttgtctaatgcatccgtcgaatctactaccttatcttaccgctctggactttgcattggcaatctctgccgcttggtcttgccatatgccatgttc

SEQ ID NO: 582772 - DNA, 537 bp, Homo sapiens
  misc_feature (50)..(50): n is a, c, g, or t
  misc_feature (53)..(53): n is a, c, g, or t
  misc_feature (61)..(61): n is a, c, g, or t
  misc_feature (68)..(69): n is a, c, g, or t
  misc_feature (81)..(81): n is a, c, g, or t
  misc_feature (332)..(332): n is a, c, g, or t
gagatccagtgtggcagaacaagaggttatctggaattcccacggtaacngcnaagaggcngaggtgnnagccactgtgtnactgtgttcttcatctattcaggaaccgacgagaaaatactagcaaatgtcacagaggatgccaagaggctgatagctgttgccgactctgtgttgacgaaagttgttggtgacctcctaagtggcacgattttagttggacaactggagctgattataaagcacaagaatcagtttcttgacatctggcaactgagtaagcatcgagtcgatacgcacttcaggctcctgaggcattaagtagctggaanacacgtttgtgtttgcgtgtgcatttttgtaaaggagataatcatcttagccttgataatgagtatctcttcttgctcataagttgataggggtggttcataattctcaagaacatcacgggacagtgatcaaataatggccatctcgaagaaggggtatgcgcaaaaccatcctagtcttctcctggtggcgggaagaagccga

SEQ ID NO: 582773 - DNA, 142 bp, Homo sapiens
ttgacactctggtgacgacgcgccaccactgccacgttccgcagcttcaggtcggcagcgcagttccgctgagacggcccttcatggctggtatcgctgctgatgccgcttggccaagtgcttacctggccaggtagacacc

SEQ ID NO: 582774 - DNA, 327 bp, Homo sapiens
  misc_feature (129)..(129): n is a, c, g, or t
  misc_feature (142)..(142): n is a, c, g, or t
cgttgaatggcctggctggaaaagacagtacagtgtaaccgtgatgtggtcactttgtcctgatgccagcctttgaagatgcaaaaaaagcagggaccatatgatgtgagtggtcctaccaggaggtantctgggcgcacanaatttatctgagtctgctgctgtgaaggagatactgaaggagcaggaaaaccggaagggcctgatagccgccatctgtgcaggtcctactgctctgttggctcatgaaataggtgcaggaagtaaagttacgacataccctcttgctagagacgaaatgatgactggaggccattccacgcctcc

SEQ ID NO: 582775 - DNA, 482 bp, Homo sapiens
  misc_feature (182)..(182): n is a, c, g, or t
  misc_feature (187)..(187): n is a, c, g, or t
attttaacctcctaacaatgaactcctttcccctgaatgagaatgcccatcttcctcaaggtgggttgtgtaaaatgaaggagggaggccttgtgaagcgcagatcatgcagtgggcctgtggacagggccgtcttttggcggtaggcctgtgtgctgttgcagagtagcgtgttaccctcntcgcnatgctctgtgagccaacctcatggttctgcctctccaggtcttctgcagtgtgcagaggctcagccaggccttcatcgacctgcactctgctgggaatatgctgttcaggacgtggatcccatggcctactgctcccccaagcagagtgtgtccctccaaatggactttggcttggacctggtgacggagcttaaagaaggtggagatgtcactgagctgctggcagccctctgcaggcagatggagcacttccctgacagctggaagagatttcgtacccagcccacggcataa

SEQ ID NO: 582776 - DNA, 116 bp, Homo sapiens
  misc_feature (74)..(74): n is a, c, g, or t
gcggccgcctactactactactgctcgaattcaagcttctaacgatgtacggggacatgtgagcccggccggcnatttcaggccatctcacgtgtacataatcagagccacaataa

SEQ ID NO: 582777 - DNA, 525 bp, Homo sapiens
  misc_feature (146)..(146): n is a, c, g, or t
  misc_feature (150)..(150): n is a, c, g, or t
  misc_feature (158)..(158): n is a, c, g, or t
tgagtttaaaatccactttattaaaatgcttagcagaatatcaggttcccaggaatcacagttcatcttgatcagggagaaacagccatgggggtttgatcatccaattcaggggtaagagcttggtgtgcctgttgtcacagcantggnaaatctangcattgagggagggtggggctgctgggacggtcagtgcttgcagctcacagattctggggttctggttaatgagttccagtccacagtagagctttttcttgcagactgataacttcgacgactttcgccgtgaaacactggaccagatcaaccaggagctcatccaggccaaaaagctgctccaggacatcagcgaggcccggtgcaaggggctgcaggctctgtccctgagaaaggagttcatctgctgggtccgggaggctcttggaggtaaaatcagcctttggggttgcgtggaagtgtggagaaagttttcagatggcgcactgtgtggcattcctaaactctttggcaatacctcccctt

SEQ ID NO: 582778 - DNA, 1056 bp, Homo sapiens
  misc_feature (308)..(308): n is a, c, g, or t
agcggggggtggccgcggccgccgagtcggtctgcgcagcctcctgcgtttcctcgcttggatcttggcactgaagaggcggtggccggcggcgatgcgagaaaagtagcgatgcaacctgcaccaaggggccggactacgctcatgcttcgagagaggacgaggtcagtgacacggaatgatttcgagtgtcgactcagtattctgtgtctgtgctgtatggaatgcgggtccagctggagaaactgagagatgagcgtggagctctactataagcttcgttagaatcacgccagtggatcgtaacntcattcagacaacggattatgcacgaatttggctgaaggtcgttctcaactgaaccttggctctggcattggtacaaaggccctcaagccagcattctctggtgaccttatgggaacaacttacgagcaatgaaggcttctgagccgttagaactccgtttggtcagctgaagggacattcggggccagtctgtgatgaagcgagatgtcgtaaactaagaggacagtaacggcaacaagaaaagcatgtgatggtatagcacggcgtgtgatacgagcttgaatcctcgggtcgacttgtgagagaaagttggagcccgactcttcatactctcaatacgttctataagaatacctcgtgggctactaatgcaagtgagccccctttttgactgggcaagagtttgggatgacgaattgccggcatgaatttgtactcagttaccaggtttccatgctgttcaaagcaaaagggcatgccttcttgccggacccaaatgtaaagacgccgggtattaggctggcattaccagccctgttacagcaagtcgcctggggaagggctccctaatttaaaaagggctttcagaaacgttcttgacgtcgagtttaaattacggggcaccgggtggcggacttcagccacgattggcgcaaaaacacgggaaccggcgggcccttatgtgggccggtactcactggagcccccttagacagggggttataaacccgggtgggaattcccccc

SEQ ID NO: 582779 - DNA, 4815 bp, Homo sapiens
gcaggacacagccctgccccacagccaagcccagcagagtggccccactggccagccgagccagcccccaggcacagccaccacgccactggagggtgacggcctctccgcgcccaccgaggttggcgacagccccctgcaggcccaggctttgggagaggcaggagtggccacaggaagtgaggctcagagcagcccgcaattccaggaccacacggaaggggaggaccaggacgcttccatcccctctgggggcagaggcctgtcccaggaggggaccggtccccccacctctgctggtgaaggccattctaggactgaagatgctgcccaggagctcctgttgcctgagtcaaaaggaggcagctctgagcccgggacagaactgcagaccaccgagcaacaggcaggggcctcagcctctatggcagttgatgctgtagctgagccagccaatgcagttaaaggggccgggaaggaaatgaaagagaagacccagagaatgaaacagccaccagcaaccactcctcctttcaaaacacactgccaggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggcgaaggggaagcagattgcgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccaggtgaacaatctctcctcctgggaaacggattcgggctcacagctgtgttctgccatgacccagctaagggctatgaagcacccgctgggtctcagctcctccgctaactcagagattgggaagtgggcaccctcctccctcgccaagggcaatggcgctgaaatctagttctctccggattcctcagtgtgctgcacagtccctgctgctcgcaccatcctgcatgtgttccatatggaatcacggccgtgcgcgtgtggcacaagtcacacgggcttgcaggccgttcctcagatggccctgtcatcactgtggctgctggtttgattgattgttaacacttgctcagtaggtgtgcgggaagagactccaaaggttgacagaacatttatggaagcaaaatatgtgaaatggaaaattgtatcaatttatttagctcttttcggcaaaggggaagagattgtgcccccctgtctcccaggaacagtctcgcaggcaatgccacatgaggaagctccctgctggccatggctgccctgctcacatttcctaattggacacttaacccctgtacaagcacagccttgcggccacaggggaagtccagaaacattgaggtcattgaattccggggaccaaggggttctaattttttaagtgactgatacctttgataaggttttcctttccctttttcgttaactctttgttgagatattgttcgtatgccatacggtacatctgtcaaaagttccagttcagcaggttttggggtagtcacagatatgtacagtcatcaccacagttaatgacagagcattttcatcacttcaaagagaaacccggcccctttagccatcatcctcctcccctctagtcacccactcccctctgcaggcataaacaattgctgaacataaacaactgcttctgtggctttctctgttctgactgtcatatgaatggaatcatatcatatgtggccttttgggtatggcttatttcactgagcataatgtttttttgttgttggtggtggtggttgtttgttgtttttgggaccgagtttcactctttttgcccaggctggagtgcagtggtgcgatcctggcttaccgcaaccactgcctcccgggttcaagtgattctcctgcctcagcctcccaagtgctggaattacagctactttttgtttaaagagtcttttaattgtttaaagaacaatgtgccgccacactcggttccttttgtatttttagaagagacagggtttctccatgttggtcaggctggtctcgaactcccgacctcaggtgatccacccaccttggcctcccgaagtgccgagattgcaggtgtgagccaccgcgcccggccgagcataatgttttgaaagaccgctcaggctggacacggttgctcacgcctgtagtcacggcactttgggagcccaggagttcaagacaagcctgggtaacagagtaagaccctgtctctataaaaactaaaaaataaacaaaaaaaattagccaggcatggccgggcacacctgtggtcccagctacttgggaggctgaggtgggaggctcccttgggcccagaaggtcaaggcagcggtgagccatgatcgcaccactgcacttcaacctgggggacagagcaagaccctgtctcaaaaagcaataacaacaaaagtccatccatattgtagcttgtgtccgtttacgttaagtattccttacccaaaatgcttgagaccagaagtgttttggatttcagatgttttcaaattttggaatatttgcatttacataatgagatgtcttccagatgggacccagagtctaaccacaaaattcacttgtttcatatacatcttatacacatagcctgaaggtaattttatacaatatttttaacaattttgtgcatgagacaaagtttgtattaagtatttgtatgttgaatttttcacttgtggcatcattatactcaaaaagtttggattttgtagtattttggatttggggattaggaatgctcaacctatatttcatttttttccatggccaaatattccccgtttatccatgtgtccattgacggccatctatgttgcttcttcggctattataaatctgctgatacaaacattagtgtacataaaaaaaaaaa

SEQ ID NO: 582780 - DNA, 4752 bp, Homo sapiens
gcaggacacagccctgccccacagccaagcccagcagagtggccccactggccagccgagccagcccccaggcacagccaccacgccactggagggtgacggcctctccgcgcccaccgaggttggcgacagccccctgcaggcccaggctttgggagaggcaggagtggccacaggaagtgaggctcagagcagcccgcaattccaggaccacacggaaggggaggaccaggacgcttccatcccctctgggggcagaggcctgtcccaggaggggaccggtccccccacctctgctggtgaaggccattctaggacagaactgcagaccaccgagcaacaggcaggggcctcagcctctatggcagttgatgctgtagctgagccagccaatgcagttaaaggggccgggaaggaaatgaaagagaagacccagagaatgaaacagccaccagcaaccactcctcctttcaaaacacactgccaggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggcgaaggggaagcagattgcgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccaggtgaacaatctctcctcctgggaaacggattcgggctcacagctgtgttctgccatgacccagctaagggctatgaagcacccgctgggtctcagctcctccgctaactcagagattgggaagtgggcaccctcctccctcgccaagggcaatggcgctgaaatctagttctctccggattcctcagtgtgctgcacagtccctgctgctcgcaccatcctgcatgtgttccatatggaatcacggccgtgcgcgtgtggcacaagtcacacgggcttgcaggccgttcctcagatggccctgtcatcactgtggctgctggtttgattgattgttaacacttgctcagtaggtgtgcgggaagagactccaaaggttgacagaacatttatggaagcaaaatatgtgaaatggaaaattgtatcaatttatttagctcttttcggcaaaggggaagagattgtgcccccctgtctcccaggaacagtctcgcaggcaatgccacatgaggaagctccctgctggccatggctgccctgctcacatttcctaattggacacttaacccctgtacaagcacagccttgcggccacaggggaagtccagaaacattgaggtcattgaattccggggaccaaggggttctaattttttaagtgactgatacctttgataaggttttcctttccctttttcgttaactctttgttgagatattgttcgtatgccatacggtacatctgtcaaaagttccagttcagcaggttttggggtagtcacagatatgtacagtcatcaccacagttaatgacagagcattttcatcacttcaaagagaaacccggcccctttagccatcatcctcctcccctctagtcacccactcccctctgcaggcataaacaattgctgaacataaacaactgcttctgtggctttctctgttctgactgtcatatgaatggaatcatatcatatgtggccttttgggtatggcttatttcactgagcataatgtttttttgttgttggtggtggtggttgtttgttgtttttgggaccgagtttcactctttttgcccaggctggagtgcagtggtgcgatcctggcttaccgcaaccactgcctcccgggttcaagtgattctcctgcctcagcctcccaagtgctggaattacagctactttttgtttaaagagtcttttaattgtttaaagaacaatgtgccgccacactcggttccttttgtatttttagaagagacagggtttctccatgttggtcaggctggtctcgaactcccgacctcaggtgatccacccaccttggcctcccgaagtgccgagattgcaggtgtgagccaccgcgcccggccgagcataatgttttgaaagaccgctcaggctggacacggttgctcacgcctgtagtcacggcactttgggagcccaggagttcaagacaagcctgggtaacagagtaagaccctgtctctataaaaactaaaaaataaacaaaaaaaattagccaggcatggccgggcacacctgtggtcccagctacttgggaggctgaggtgggaggctcccttgggcccagaaggtcaaggcagcggtgagccatgatcgcaccactgcacttcaacctgggggacagagcaagaccctgtctcaaaaagcaataacaacaaaagtccatccatattgtagcttgtgtccgtttacgttaagtattccttacccaaaatgcttgagaccagaagtgttttggatttcagatgttttcaaattttggaatatttgcatttacataatgagatgtcttccagatgggacccagagtctaaccacaaaattcacttgtttcatatacatcttatacacatagcctgaaggtaattttatacaatatttttaacaattttgtgcatgagacaaagtttgtattaagtatttgtatgttgaatttttcacttgtggcatcattatactcaaaaagtttggattttgtagtattttggatttggggattaggaatgctcaacctatatttcatttttttccatggccaaatattccccgtttatccatgtgtccattgacggccatctatgttgcttcttcggctattataaatctgctgatacaaacattagtgtacataaaaaaaaaaa

SEQ ID NO: 582781 - DNA, 1048 bp, Homo sapiens
gaacccctcctttcgccttccccgctcctcacctccgctcgagcacggcgcgcgcatacggtcccagccaccgtaacactacaggctgttaccccccgccctccacctacacctggcggctcaggcagacggaggaggactgaggcacgaaggcgaatcgccgcacaccctgcatgtcgacggcgacactaccagattaggacagcggagaagcacgatcagcactggtgggacccgaagaatccagagacccacgaaaaagcaccggacagaccctaaaaaacataaagaccaccagatgggcggcaaagaacaactacagactcgcgtaacatgataaggtagtaggtgtaagcaggcacgaaggaacgaacggacagaaaaagacgcacagaagacccccgacagactgaagagaccggggaccgccgcaaccatgacaccgataggcagcgacaacacaagaaaggggcgcaaccacctgggcataggcgaatctacgcgaccacaaagagcgagaatgaacacctaaagcgattcaagacgacacacaaaacatagaacaccacatgaaacccacaatggaaatagactcgcaccagataaaaggacgaccacaaccatatcgcgcaagggaccgaccaaaagaagcagaaacaacaatggacctcggcacacagaacgagccgaaggaacactgcccgagggaaaccgacacaagtgacaccaactcggcaaccaaaggccaacatgacagcaccgacaacccagaaaagcaccacagaaaaacagagaaggaaagcacaaaggacaccaagaacaatgcagagaaaccaccatagagaacataacacatcaactccactgaggacgaaaaccaagaacaaaaagatcaaacgacacaggcaaacaggagagaaaacgaaagagaaacaaccacactaagagcacaaaaacagcaaacgccccaggaaaaaagaacaacgaagggaacaaacaaaacaaagagaacacacacacagaggcacacacataccacagagcagca

SEQ ID NO: 582782 - DNA, 217 bp, Homo sapiens
  misc_feature (78)..(78): n is a, c, g, or t
  misc_feature (202)..(202): n is a, c, g, or t
  misc_feature (213)..(213): n is a, c, g, or t
ggccaagagacagactctggcctggagccttcggaaggcaccggcctgcagaccacttcagacttctgacctccaggnccggaagaggaagcttggtgtggttctaagcggtggcatttgtgatcatttctcaccgcagccacagtagatggaggcaacacccgtgcatgttttgagggatggatgagtgtgtagccatgcncgtggttgganaccc

SEQ ID NO: 582783 - DNA, 2961 bp, Homo sapiens
atgcaggttgactcttgtagagatcccccacggacgacgtagtctggtataatcgctatatctagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccaggtgaacaatctctcctcctgggaaacggattcgggctcacagctgtgttctgccatgacccagctaagggctatgaagcacccgctgggtctcagctcctccgctaactcagagattgggaagtgggcaccctcctccctcgccaagggcaatggcgctgaaatctagttctctccggattcctcagtgtgctgcacagtccctgctgctcgcaccatcctgcatgtgttccatatggaatcacggccgtgcgcgtgtggcacaagtcacacgggcttgcaggccgttcctcagatggccctgtcatcactgtggctgctggtttgattgattgttaacacttgctcagtaggtgtgcgggaagagactccaaaggttgacagaacatttatggaagcaaaatatgtgaaatggaaaattgtatcaatttatttagctcttttcggcaaaggggaagagattgtgcccccctgtctcccaggaacagtctcgcaggcaatgccacatgaggaagctccctgctggccatggctgccctgctcacatttcctaattggacacttaacccctgtacaagcacagccttgcggccacaggggaagtccagaaacattgaggtcattgaattccggggaccaaggggttctaattttttaagtgactgatacctttgataaggttttcctttccctttttcgttaactctttgttgagatattgttcgtatgccatacggtacatctgtcaaaagttccagttcagcaggttttggggtagtcacagatatgtacagtcatcaccacagttaatgacagagcattttcatcacttcaaagagaaacccggcccctttagccatcatcctcctcccctctagtcacccactcccctctgcaggcataaacaattgctgaacataaacaactgcttctgtggctttctctgttctgactgtcatatgaatggaatcatatcatatgtggccttttgggtatggcttatttcactgagcataatgtttttttgttgttggtggtggtggttgtttgttgtttttgggaccgagtttcactctttttgcccaggctggagtgcagtggtgcgatcctggcttaccgcaaccactgcctcccgggttcaagtgattctcctgcctcagcctcccaagtgctggaattacagctactttttgtttaaagagtcttttaattgtttaaagaacaatgtgccgccacactcggttccttttgtatttttagaagagacagggtttctccatgttggtcaggctggtctcgaactcccgacctcaggtgatccacccaccttggcctcccgaagtgccgagattgcaggtgtgagccaccgcgcccggccgagcataatgttttgaaagaccgctcaggctggacacggttgctcacgcctgtagtcacggcactttgggagcccaggagttcaagacaagcctgggtaacagagtaagaccctgtctctataaaaactaaaaaataaacaaaaaaaattagccaggcatggccgggcacacctgtggtcccagctacttgggaggctgaggtgggaggctcccttgggcccagaaggtcaaggcagcggtgagccatgatcgcaccactgcacttcaacctgggggacagagcaagaccctgtctcaaaaagcaataacaacaaaagtccatccatattgtagcttgtgtccgtttacgttaagtattccttacccaaaatgcttgagaccagaagtgttttggatttcagatgttttcaaattttggaatatttgcatttacataatgagatgtcttccagatgggacccagagtctaaccacaaaattcacttgtttcatatacatcttatacacatagcctgaaggtaattttatacaatatttttaacaattttgtgcatgagacaaagtttgtattaagtatttgtatgttgaatttttcacttgtggcatcattatactcaaaaagtttggattttgtagtattttggatttggggattaggaatgctcaacctatatttcatttttttccatggccaaatattccccgtttatccatgtgtccattgacggccatctatgttgcttcttcggctattataaatctgctgatacaaacattagtgtacataaaaaaaaaaa

SEQ ID NO: 582784 - DNA, 487 bp, Homo sapiens
ggtgtattgagtggcatgtgatgctgtgatcttccgcccagctgtcgcttatcagtgctatatttatctggaatatagcggctccttttactgttctaaggtgcttgtgctaaggatgaagatcacacattcctcagctcttggtagacttatgggaagctcagctagtggcctgtctccccgatgtggtacttcaggaactctttttcacactcacatcacagtaccatctggagattgtctaagaggcagcctcctgacaccacaccattgcgacccatcggaggactcttcttctcctggtcattccttggtagactactttggaactaacaactaactcaccactgacctgtgattgggtacgactcaccattccatattctcctgtgagtctcacgaagatgcttcatttggtagaacggtgtacgtggtttccattccagcatgaatgtggtcggtcacatggaccactcaatcccgggta

SEQ ID NO: 582785 - DNA, 2914 bp, Homo sapiens
  misc_feature (282)..(282): n is a, c, g, or t
ggaacaggcccgggagtctgcagggcccctctctggggcgtgcttttccccctcagtctcctgggcacagcctggggacctgctcattggcaggacagaggctgcctgggctttcgggggagcacacagatgccgttccctccctccctcttttctcccgtatctcccacgttcagggtgaacccagaaaaccctggggaatggaagtgctttgggaatgtgggctcctgccaaggcctgtggtccctccatcgtagccactccttgagcagcctgtgccancagggaggagaggagggggtgcagcatctcgccgggaacctgagtccacagccgaggatgactgaccctccctcttgtgtgacaacaggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccaggtgaacaatctctcctcctgggaaacggattcgggctcacagctgtgttctgccatgacccagctaagggctatgaagcacccgctgggtctcagctcctccgctaactcagagattgggaagtgggcaccctcctccctcgccaagggcaatggcgctgaaatctagttctctccggattcctcagtgtgctgcacagtccctgctgctcgcaccatcctgcatgtgttccatatggaatcacggccgtgcgcgtgtggcacaagtcacacgggcttgcaggccgttcctcagatggccctgtcatcactgtggctgctggtttgattgattgttaacacttgctcagtaggtgtgcgggaagagactccaaaggttgacagaacatttatggaagcaaaatatgtgaaatggaaaattgtatcaatttatttagctcttttcggcaaaggggaagagattgtgcccccctgtctcccaggaacagtctcgcaggcaatgccacatgaggaagctccctgctggccatggctgccctgctcacatttcctaattggacacttaacccctgtacaagcacagccttgcggccacaggggaagtccagaaacattgaggtcattgaattccggggaccaaggggttctaattttttaagtgactgatacctttgataaggttttcctttccctttttcgttaactctttgttgagatattgttcgtatgccatacggtacatctgtcaaaagttccagttcagcaggttttggggtagtcacagatatgtacagtcatcaccacagttaatgacagagcattttcatcacttcaaagagaaacccggcccctttagccatcatcctcctcccctctagtcacccactcccctctgcaggcataaacaattgctgaacataaacaactgcttctgtggctttctctgttctgactgtcatatgaatggaatcatatcatatgtggccttttgggtatggcttatttcactgagcataatgtttttttgttgttggtggtggtggttgtttgttgtttttgggaccgagtttcactctttttgcccaggctggagtgcagtggtgcgatcctggcttaccgcaaccactgcctcccgggttcaagtgattctcctgcctcagcctcccaagtgctggaattacagctactttttgtttaaagagtcttttaattgtttaaagaacaatgtgccgccacactcggttccttttgtatttttagaagagacagggtttctccatgttggtcaggctggtctcgaactcccgacctcaggtgatccacccaccttggcctcccgaagtgccgagattgcaggtgtgagccaccgcgcccggccgagcataatgttttgaaagaccgctcaggctggacacggttgctcacgcctgtagtcacggcactttgggagcccaggagttcaagacaagcctgggtaacagagtaagaccctgtctctataaaaactaaaaaataaacaaaaaaaattagccaggcatggccgggcacacctgtggtcccagctacttgggaggctgaggtgggaggctcccttgggcccagaaggtcaaggcagcggtgagccatgatcgcaccactgcacttcaacctgggggacagagcaagaccctgtctcaaaaagcaataacaacaaaagtccatccatattgtagcttgtgtccgtttacgttaagtattccttacccaaaatgcttgagaccagaagtgttttggatttcagatgttttcaaattttggaatatttgcatttacataatgagatgtcttccagatgggacccagagtctaaccacaaaattcacttgtttcatatacatcttatacacatagcctgaaggtaattttatacaatatttttaacaattttgtgcatgagacaaagtttgtattaagtatttgtatgttgaatttttcacttgtggcatcattatactcaaaaagtttggattttgtagtattttggatttggggattaggaatgctcaacctatatttcatttttttccatggccaaatattccccgtttatccatgtgtccattgacggccatctatgttgcttcttcggctattataaatctgctgatacaaacattagtgtacataaaaaaaaaaa

SEQ ID NO: 582786 - DNA, 151 bp, Homo sapiens
acggaccgtactgctgcgtaactagagggagtgacggatggcgcccccacaccacgccgctcagcgggataggcttcttggcggacttcggagtgggaagcggggaatgtctacgtgcgtatgcacgtggcactctctacgtgtccggcca

SEQ ID NO: 582787 - DNA, 346 bp, Homo sapiens
  misc_feature (70)..(70): n is a, c, g, or t
ttcagcccaaaggccgtgttggttcgctggttgcaggggttacaaaggttgccccgcgaaaagtacttgntttgggctttcgggcaggggcccagccagggcccccccccctttgttgtggccagcattttgggggtggcagccgaggattggaagaagggggcccccttttcttgcttggtgggccccggggccctgccgttggctttcccccagaagccctttggccgcttggggggtaaacccccccatgtcaatgtttttgttgtcatggcggaggtggccggcccctgtttttgagccgcccgcctgtccccccccctgaataaactccttgttcccccca

SEQ ID NO: 582788 - DNA, 4705 bp, Homo sapiens
  misc_feature (4382)..(4383): n is a, c, g, or t
gcaggacacagccctgccccacagccaagcccagcagagtggccccactggccagccgagccagcccccaggcacagccaccacgccactggagggtgacggcctctccgcgcccaccgaggttggcgacagccccctgcaggcccaggctttgggagaggcaggagtggccacaggaagtgaggctcagagcagcccgcaattccaggaccacacggaaggggaggaccaggacgcttccatcccctctgggggcagaggcctgtcccaggaggggaccggtccccccacctctgctggtgaaggccattctaggactgaagatgctgcccaggagctcctgttgcctgagtcaaaaggaggcagctctgagcccgggacagaactgcagaccaccgagcaacaggcaggggcctcagcctctatggcagttgatgctgtagctgagccagccaatgcagttaaaggggccgggaaggaaatgaaagagaagacccagagaatgaaacagccaccagcaaccactcctcctttcaaaacacactgccaggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggcgaaggggaagcagattgcgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccagtctcagaccagtatccttcaggggttctcttactctgatttgcggaaatttggcatcgtcttgtctgctgtgatcactaagtcctggcctaggaccgcggacaacttcgatgacattttaaagcatctgctcacgttggcagatgtcaagcacgtcttcagattgtgtggaaccgacgagaaaatactagcaaatgtcacagaggatgccaagaggctgatagctgttgccgactctgtgttgacgaaagttgttggtgacctcctaagtggcacgattttagttggacaactggagctgattataaagcacaagaatcagtttcttgacatctggcaactgagggaaaaaagtctttcaccccaggatgaacaatgtgctgtggaggaagcactggattggagaagggaggaactgttacttctaaagaaagagaaaagatgtgttgatagtctcctgaagatgtgtgggaacgtgaaacatctgatacaagtggactttggagtgcttgcagtaagacactcacaagacctcagcagtaaaagattaaatgacaccatgacagtgagactgtccacctcctcgaactcgcagagggcaacgcattaccacctgagctcccaggtccaagaaatggctgggaagatagacttgctcagagacagccacatcttccagctcttctggcgggaagccgcagagccgctgagtgagcctaaggaggaccaggaagccgcagagttgctgagtgagcccgaagaagaatcagaaaggcacatccttgagcttcaagaggtgtatgactatttgtatcagccttcttacagaaagttcattaagttgcaccaggatctaaagtcaggagaggtcacccttgcagagattgatgtcatcttcaaggactttgtgaataaatacacggacctggattcagaacttaagatcatgtgcaccgtggaccaccagggccaaagagattggatcaaggaccgagtggaacagatcaaggaataccatcacctgcaccaggctgtccacgcagccaaggtcatcttgcaggtcaaagagagcctgggactgaacggtgacttcagtgttctcaacactttactaaattttactgataacttcgacgactttcgccgtgaaacactggaccagatcaaccaggagctcatccaggccaaaaagctgctccaggacatcagcgaggcccggtgcaaggggctgcaggctctgtccctgagaaaggagttcatctgctgggtccgggaggctcttggaggcatcaatgagctgaaggtgtttgtggacctggcctccatctcagcgggggagaatgacattgatgtggaccgggtggcctgcttccatgacgctgtgcagggctacgcatccctgctatttaagctggaccccagcgtggacttcagtgcattcatgaagcatctgaaaaagctgtggaaggctctggataaggaccagtacctgcccaggaaactgtgtgactccgccaggaacttggaatggctgaagactgtgaatgagagtcatgggtctgtggaacgctcatccctgaccctggccacggccatcaaccaaagaggcatctatgtgatccaggcacccaaaggtggccaaaagatttccccagacacggttctgcacttgatccttcctgagagccctggcagccacgaggagtcacgagagtactctttagaggaggtgaggagcttttnnacaagttgatgctgatgtctggcaagaaggatcgtaacaacacggaagtggagaggttttcagaggtcttctgcagtgtgcagaggctcagccaggccttcatcgacctgcactctgctgggaatatgctgttcaggacgtggatcccatggcctactgctcccccaagcagagtgtgtccctccaaatggactttggcttggacctggtgacggagcttaaagaaggtggagatgtcactgagctgctggcagccctctgcaggcagatggagcacttccctgacagctggaagagatttcgtacccagcccacggcataa

SEQ ID NO: 582789 - DNA, 110 bp, Homo sapiens
caggtacttcacagggattactgtgtgagctccgcccctgccagaagcattacgtgtgtgagctctcgcccccgtgccagaaagcattactgtgtgagctccgccccctg

SEQ ID NO: 582790 - DNA, 231 bp, Homo sapiens
tgctaatggagcacgaagacgacccgatgtggacgagcctttagagactcccttgacatattcttggacgggagcccactttctcagagcaaggcggcctttgaaggatcttgttcttcttgccggagaaggcaaacccgctttgagttgaagaggaaagacaggaacagactaagaggatgtttgagctggtgcccagaagcagcaggagcttgaagaaagagaggaacg

SEQ ID NO: 582791 - DNA, 2031 bp, Homo sapiens
  misc_feature (2)..(2): n is a, c, g, or t
  misc_feature (10)..(12): n is a, c, g, or t
  misc_feature (14)..(14): n is a, c, g, or t
  misc_feature (17)..(20): n is a, c, g, or t
  misc_feature (22)..(22): n is a, c, g, or t
  misc_feature (28)..(29): n is a, c, g, or t
  misc_feature (33)..(34): n is a, c, g, or t
tngctgggannncnggnnnncnccaccnngccnngctaatttttgtatttttagtagagacagggttttgtcatgttggccaggctgctcatgaactcctgacctcaggtgatccgcccatctcagcgtcccaacgtgctgggtgggattacaggcatgagccactgcgcccaactagtttatgactttttaaatgcaatttatgttctgtcattggagtggggtttggcaaagagagtaaataggtgcgtgttttcccactgccatctttacccagaagtttatgatgctttctttatcatgaatattggttaacaaggccaagcggggagggaaagacctgtgaactcttcctgagaaagaaatcctagcagctgtgtgctcttgagttcgctcagagaagtgaggagagaaagtcttaggaaagtgaaataaaatggaatcatgattagagctttgacttctgacactttcttttcgcttctaaagtggactttggagtgcttgcagtaagacactcacaagacctcagcagtaaaagattaaatgacaccatgacagtgagactgtccacctcctcgaactcgcagagggcaacgcattaccacctgagctcccaggtccaagaaatggctgggaagatagacttgctcagagacagccacatcttccagctcttctggcgggaagccgcagagccgctgagtgagcctaaggaggaccaggaagccgcagagttgctgagtgagcccgaagaagaatcagaaaggcacatccttgagcttcaagaggtgtatgactatttgtatcagccttcttacagaaagttcattaagttgcaccaggatctaaagtcaggagaggtcacccttgcagagattgatgtcatcttcaaggactttgtgaataaatacacggacctggattcagaacttaagatcatgtgcaccgtggaccaccagggccaaagagattggatcaaggaccgagtggaacagatcaaggaataccatcacctgcaccaggctgtccacgcagccaaggtcatcttgcaggtcaaagagagcctgggactgaacggtgacttcagtgttctcaacactttactaaattttactgataacttcgacgactttcgccgtgaaacactggaccagatcaaccaggagctcatccaggccaaaaagctgctccaggacatcagcgaggcccggtgcaaggggctgcaggctctgtccctgagaaaggagttcatctgctgggtccgggaggctcttggaggcatcaatgagctgaaggtgtttgtggacctggcctccatctcagcgggggagaatgacattgatgtggaccgggtggcctgcttccatgacgctgtgcagggctacgcatccctgctatttaagctggaccccagcgtggacttcagtgcattcatgaagcatctgaaaaagctgtggaaggctctggataaggaccagtacctgcccaggaaactggtgagtcttattctgtctctaatgcagattttgttgaatagagcattgcttagcaacgttagggcagtgactgtggaaatggtggcacacctgtgtggtaggtttgtacacagccgttttcaatgatatttaaaaagcttttcttcataaatggaaattcaccatcttgttacctagaaagcaggatacaaaattacatgacacatagtaatctctaaggtgcaaaacacacgtggaaaaaagacagaagggaaatatgctgaaacgttgccaggagttttctctgaatggttgtaattgtcattttattctgttactttttgttattttctataattgatagaattttttatcagaaaaaagtaaacatttaaaattagccaggcatggtggtgtgcgcctgtaatcccagctactctggaggctgagacagaattgcttgaacccgggaggcagagatagcagtgaactgagatcacaccactgtactccagcctgagtgacaaagtgagactctgtctcaaaaaaaaaa

SEQ ID NO: 582792 - DNA, 511 bp, Homo sapiens
gtcacagagcagcacagactgagtctgacagaaactctctatacaaatagcacaccttgtcccagctaaaaccctgggccctgggaggacaagacatccctcctctaacccctcgtcactagcccatttgtaaaaaccttgacaggccgggcacggtggctcacacctgtaatcccagcactttgggaggctgaggcaggcgcatcacctgaggtcaggagatcgagaccatcctggccaacatggtgaaaccccatctctactaaaaatacaaaacttagctgagcgtggtggcgtgtgcctggagtcccaactactcaagaggctgaggcaggagaatcacttgcccgggaggtggaggttgcagtgggccaagatcagcccactgcactgcagcctggcgacagaaaaaaaagaaaccttgacatctttactacaacttagcaacccgctcaggccccctctgcaacggagagctcttcttcctttttgcttattaaacttctgctcc

SEQ ID NO: 582793 - DNA, 559 bp, Homo sapiens
tagacaagtccctgaaactgtaagagctgataaaaacaagagcttagcagccactaggcaaagggggtaggggaagcaaacacagagtttcactctgttgcctaggctggagtgcagtggtgtgatctcggctcattgcagcctccaccttctgggttcaagcgattctcctgcctcagccccccaagtagctgggatcacaggcgtgcaccaccacacctgcccaatttttgtatttttggtagagacggggtttcgccacgttgtccaggctggtctcgaactcctggactcaagcaatctgtgtgcctcggcctcccacagtgctaggattataggcgtgaaccaccacacctggcccttgtaccctatgttctaaaagaaaggccttgacttgtctttggcatgaaatgaagaagaagaggaaagttaacatattccctcatggagggactggtcccagtatttacgaaatgctgcatggaggagtgtggtgcttacaattgggcagctccatggcatggcttagagacaaggtagagccgagggggatcctcta

SEQ ID NO: 582794 - DNA, 212 bp, Homo sapiens
gattctagaggatcccgtcatctaccactcctctatctgggacattctcattcattcagatatctcatggattgtctctctatctgggaccgtactctattcatacagtagctacttgtgattgtctgtctatctgggccattctcattcattcagtagctgatggattgtctagtatgtgctgaggagagagggaatagatgcacattgat

SEQ ID NO: 582795 - DNA, 227 bp, Homo sapiens
gatctccaggcgctgttggaggttggctgggttgctatgtatcctttggacctcatgcctggaaaattggtctgcgatatgtagatgttattgcatcagaacagggctttggtctgatggaccttgcactcacagtgatgtgagacagtgccatgccttatcaatgctgcattgcagctccactgcatttcagtcctacaatgtttcctgcaccatgttgtcctacc

SEQ ID NO: 582796 - DNA, 214 bp, Homo sapiens
agcaacaaactgtactaggatactaggaggagtttcagaacagcgatggagaaattcaataatatgcaattaacagaggaactgatacgtcctgagagaaacacattggttgtgagttttgtggacctggattcgcgaccgaacctggattcgcgaccgaacctggattcgcgaccgaacctggattcgcgaccgaacctggattcgcgaccga

SEQ ID NO: 582797 - DNA, 580 bp, Homo sapiens
ggcggacagtaccaagaccagtcttctctgatgccggactgtgtgctggcagtcccatgctgcccagcctgaggccacagtcccaagaagagtgggcaagaaagtggtggtagcaagctcaagccccaagagttcagggaggaaaaaacaggggctagttgaatttagccttgggaaaatccatctccggatgttgatcccatgaacttcttcaggaatctcccgtttcttctggacgtctgaagttggcaagcccatggacttctgtcgctggtcatacatcatcttttcccacccatgctggcgagtctcactgtccaggtctgacagcttggaaattctcagggttaatcttctatggtgttgatctcagggtcactggacaccaagcggctccaccactccatcttattgatcttctccagatgcacagtcaccaccttgccgtcctcaatgagccacgagctctcctccaccttcacttcattgtagagctccccatcaatgatcgctggctgccccttgagccccacccggaggtgccgccgctggatgtcaccaccatgtccttccctttcag

SEQ ID NO: 582798 - DNA, 320 bp, Homo sapiens
  misc_feature (146)..(146): n is a, c, g, or t
  misc_feature (263)..(264): n is a, c, g, or t
catcaaaaactggattcacaggaacctgggagacaaacacctgacaggaaggcctgaggttgcccgtcaacaaaaatcaggcatgttctgtgaaagtcagcatggcttccatctcagacatccttttctgtgcaaaaggaaaaagnttaccagaagtattggtacccaacacaaaaaaggaatttttgtgtgtttatggtccgtggacatttctctcctaacatctattgaacacctatttataaatattctattaaacttgnngggtgtggtaataattctatttcgcaactaaaaaagagtacttaagaatactccta

SEQ ID NO: 582799 - DNA, 695 bp, Homo sapiens
  misc_feature (155)..(155): n is a, c, g, or t
ttagcaggtctttaaagccagagcccaaaaatgcctgttgtattttgggaaacctccaatgttggatcctttagcacctaggaaccattacttcaccggggcatcctgcacctgtacactgttagctcccacatagtaagcggtgtatattacantcagtgtctgtaaattggtagttagatcaactttcacagaaaatagtctttaacgttcgattgtgtagagatatatatcttgcgtttaaaaaaatgacatacagtgtgtgtgacactacccagactttattcagcatctgtattcagtatcaaatgttttgtattttcgaggctgaaaagatatttgtaactttatcatatgccacataccaagacttcaacttttaaacagaattgaaggacatctcccatttgcatgtgcctgccatatatttaaaaaggttttcctgagatccaccccccggcctcagggaggatccacatgaaatgatcctcctgctagatttgatgttatcgcggtatagcctggtatatgtaatgtaaaaattttttcatttcatgttagatggataatgtgctcatggggtaaacaggtttgaaggaggcatatctccatgtgtttggagaaagccattcttcatgcctatgaactgccaaaggatccagactgggaatatttcctggatttaaataagcctt

SEQ ID NO: 582800 - DNA, 658 bp, Homo sapiens
ctagcagatcctacgatgacacttcagctgggtgacagagagagactccgtctcaaaaaaaaaagttgggaggaaattctgtctattcaacttggaaaatctcgacggtcgggctcatataagcccccaccctcatctgtcctgagtctctgtttccttggaaaccaggtgggaggcatggagtgatcacaaggacctagatttgaattaatcctggctctggtctcctgggatgggggacctaggggcggttacctctgcttctctcggccttggtttcctcctctgtacaatgggtttaaccctgcagctataaaagtcctgttgagcaccatgcagggtgaactggtgatttggtggtggaaccaattgccatgctttgaggctgatgcctgaccccaggccctgtacccacggctctctctcctgcaaccccacagcctcactcagggctgtcactgagccagtgctgaagggctcagcaccaggtcatgctgtgccttcaccttggctcagaggaatatttattggcctgggccttgggagcagttgcttgacctctctgaaactcggtttccctatctgtgcacacagtataataggagtaatagagccttcctccttcatcaaatatctgaagtgcaacgtgggtacgagc

SEQ ID NO: 582801 - DNA, 457 bp, Homo sapiens
ctctgtaatgcaagtgtcgggattacaggtgtgagccaccatgcccggctggatgtatatatttgtaaagaaacctaagccgtaggtttgaaaccaaagtttgcaaccttaacagaagccctctacttttcctgtttttgtgagcttgtaagctctcttggccaccagcaaacacaagataaaagggagagactttgtctgggtgacaggcatccctggccgctgtctcctgatgtgtgtgcttctctaatgtcgatggctctccacccgtccatcctccagaagccatctcgtaggagtgaccagcagggatcttcccacagtcccctctgtgcacacctgtgctgagccggccagactgagaacccatgtccagtgctttctgaggcccagctcctattctcagcatcctgcacaaagctgggtaccagttagtccgtttccttccaacaggcca

SEQ ID NO: 582802 - DNA, 183 bp, Homo sapiens
gatcacgcgcgtcataatcatacccttatctgcttcctagtcctgtatgcccttccctaacactcacaacaaaactaactaatactaacatctcagacgctcaggaaatagaaaccgtctggactatcctgcccgccaatcatcctagatcctcacacagatactcccagactacacattctt

SEQ ID NO: 582803 - DNA, 529 bp, Homo sapiens
acatcgttctgtaactgattccagagttatacacgataccaaaagtctctgggacacagctaaagcactggttcaaagggaaatcgatagtgctacatgcccacatcaaaaggttagaaagatctcaaattaacaacctaacaccactcctagaggaactagagaaacaagagcaaaccattcccaaagctaacagaatctcaagaaataaccaaaatcagagctgaactgaagaaactgagtagcaaaaggccatacaaaagatcaagaaatcccacagttggttttttaaaacaacaaagattattagaccactagctagactaataaaggaaacaaaaaaaggcagaaaatcgatataattacaatcagaatgacaaaaagggccttcaccatgggccccacagaattcaaaaacccttcagagactattatgaccccctctatgcacacaaattaaaaaccctagaaaacttagactgggccaaattctggagaacattgcacctcccaagattgccccaggagg

SEQ ID NO: 582804 - DNA, 209 bp, Homo sapiens
tgtgtgtgtgtatatatcagacagcgggaactccaaaagaggggaaggtgggaggtgggtgagggttgaaaaactacctactaggtacaatgttcagttgatgggtaggctaaaagcccagatttcaccaatacacaatatatccctgtaagaaatctgcatctgtaactcccatatctatttttaaaaagagggttacatatcacggt

SEQ ID NO: 582805 - DNA, 1989 bp, Homo sapiens
cagcctcagaccctgccacccccacccacatgccccagatcctcagccccaggtcacttactctctgcttctcaatgaacattcccgtccttctttctgcctgagcctgtacctcttcagggttagctcaggtccctactatccccgtctatgtcccactgtggtgtccttctctccaaaggcctagatgcatgcaggcccatcctggttccactctgagcctggcgcctgacgccagcgctgtgtgccagccttctaccccagtgagaacagattactctgatgtgctggcactcttctgtgattcctctatcggagggtgcagaatacacctaccactcagacgcttcccgggtttctccaggcccttggccatggatggggatggcgtcatccgtctgcacagagcaggcgtagacccaggctatactagagcagagtgcacgagaacaacagtaacctaggaccctgagtaacgctgaacaccctacactggtggtggcagctggccaagagacctgctggaagtaccagggacaccgtgaataggtctctgccagcaaaggcgagactcgacaccagcagtgctcaccggcgacgcgccagaaacctcccacacaagagagatcccagaacccacagcacgcacatgacgatgcgagtgcatgacaccatctgaccaccgccactaaagagagggaccaaccggcgagcaacacgccaacaagccacctatcaacacacaagatgcacagagcacccaacacaaacacgtacaccgaccctagaaagcactcacacacacacgcccccacggcgacaataatagccaacagagttccgccagtgttacggacgagtcacatccaaatgccagcacaaaaacatccagtgcgactgagacaacaacagcatggaaaaacacacgacacaacagaaaccacagcagacacaacaccagatagccacacaagactcaccagagcaccaacccaaccaacaaaccacacaacaacacccgatataatcaccaacacacaaccaacaaccaacaaacaccaccgacaaacgaaaacaacacaccacacacaacaccacgacacacccaccacgaagcaggcaggccaagccacgcaccgcgcaccacgaggaccgagatacggacagagacaacagtcagaagagaagagacgacgaaccacagctacgcaccgtacacgaccttgacggcacgtccgagcacgcgagcgccgcctgcagacacggagagatccgaccgatacggtgagcggggactgacgaccgcacagtgagcgcgcggcgacggagcgaacaacacaggagtccgaccaagcacagcgcagacacgaccagcgaaagacgcacagcacaccgccgacacacacccagaaccgcgaaccgaagcaaacgacacaccgcacccaccacaagacccaaacgcacgcatcgcaacaaacatgagactacctccatacgcgacctgcgcccgccccgtcgggaggacacagcctccggcggagagcgacaagcgagagaccacaccagcccacacacaccgaccatacaccaacgaccacaacgaaccgctcgtgactgccgaacacaagagccgagccgacagcactaccacaacagacaccagcgcctgcaccggccggcccacacgagtgacacccgcagctgaacgcaacacacaccccaagcacacaccgcccagacaccacacgagaacgagcttagcgaaaagacaacgaacacaaatacgcaaaccagcgcaaacacacaaacgactcctaccatcgaagctgcacagagcccgcgacttcggacgcagagaccgcagtaaacagatcgcccgaaccaccagacagaagcagtcagaaacacagacacgagcaacaaacaggcggagagcgcccagactgaacgacacgcagcacgaggcaacagtagagcacagacaaccac

SEQ ID NO: 582806 - DNA, 274 bp, Homo sapiens
tgtagaggtagcaatggatttaattggcccagtgaaggtaccgggtgatagtactatttcagatgaagtttgattatgccctacagacctggctggtcaaggatttgatatacacatattggcttgggattcgagctttcttttttatttaaatcacaaaatttatcatatatattatatatatccatatcatacatagctatatctgtatcatatattgggtatgtttcaaggcatttttttcgcatgagcgcagctgatgcgataaattgac

SEQ ID NO: 582807 - DNA, 332 bp, Homo sapiens
tgagcagcaacacacaggcttccaggaaaccagtgttctgatgaaactaggactgaggagcaaacgaacaaagcagcagtacagcggtgaagataggaaaagagtccaggagccagtacgatcaggcgagggaatctcggaagcagagacagagactgctaacaatatggtgactgacatctagtgaaaaaggatcccagagaaggaacgcgagtgcaatttggtgaacaacagcagcatacaggattccaggaaccagtgtttgatgacgctaggactgaggagcaagcgagcaagcagcagttcgtggtgaacctaggaaaagagtccag

SEQ ID NO: 582808 - DNA, 351 bp, Homo sapiens
  misc_feature (18)..(18): n is a, c, g, or t
  misc_feature (91)..(91): n is a, c, g, or t
  misc_feature (163)..(163): n is a, c, g, or t
  misc_feature (230)..(230): n is a, c, g, or t
  misc_feature (308)..(308): n is a, c, g, or t
agacggggtctcactctntcgcccaggctggagtgcagtggcgcaatctcagctcaccgcaacctccgcctcccaggttaaaacgactctnatgcctcaggctcccgagcagctgggaccacaggcacatgccatcatgcccggccaaccttctgtacttttnagtagagacggggttttactgtgccacacaggctggtcccgaactcccgacctcaggcgatcagctncctcagcctctcaaagtgctgggatcacagacgtaaaccaccatgcggggccccagtcttttcttcagagggctcctnagcacccccaaccccaaacctgaggcctgtgagagtctatccg

SEQ ID NO: 582809 - DNA, 1504 bp, Homo sapiens
gcatataccatctcacttctaggaatactagtgtatcgctcacacctcatatcctccctagtatggctagaaggagtaatactatcggctgttcataatagactactctcataaccctcaagcacccactccctcttagccaatatagtgacctatggccatgactagatgctctctagtcgcgactctggctgaaatgcaatgctggtgggtcatagacctcatactaagtacttcaatgcgtacgcgaacagagtatggtgcatcatgaacttacgctcatcaattaaactctgagaagcctcactgcacaatgggctgataaacctcacagtcgtacccaaaacaatataatcatttatctaactcatctgacctatgcacttctcccataaatacactagatcaatttgagatcatacagcgagacggcccgagcaagcacgtgaatctatgtaagcacatcaagtcctcaccttactaattttatgtctagaggcaaaatttctaagcaaaacaactccgtgattttcagcctgggtatcacccctaaaactattttctcctttcccgtataccacccttagcaaaggccgttccttccttattatacgtaaaagggaggcttagatcatcctttacactctcatcaagcaaatctaatgtggcattagtcagaacgccccacagtgtagtacctaagtggcaacctacctaatcagggcaccgatataacgctttagcatcctgttagttattaatctcatggccgtatccaaatctttccttcataattcattataccagagtaccaggacgcatgagtgggaaatcaccataattctaattatacatagcaatgcggaaaaagccatcaaagtatactagccctatagttttgggccctcagtcactggagccgggagtgaaaggcccaacataggtatagaacagggccggcgtaaagcgccgggcacaatacggttacggcattgcgaagcgatcacagagtacgggaccccctatcacacgggagatcgcaaggcgaataatggtagcagactatggaacaaacaaaccaaaggggggcagaacaacagatgcccacaagcgccaaaccccagaggtgcccacgagaaacttcgagagcactgtagggggaacaacatggatagcccacgggttcaaccacaaggcgtataaacagaaagagaaacgacgtgtcggaggccaaggtagtagtaccaagagagacagtagtaatagcactaatgggggagcgacatagagtcgaggagactcaacaacgcggagagaaaaacgagaagcaagatcagcaggagaggcaagtcaccactccgcagggccacgagacaataagaagacgctcgagataataagccgcggagacagcgaaccgagagggaaggaaggaacgggagaagcaagacactagcaacgagggcatcctcccccaacatccaccactacacgagaagcagca

SEQ ID NO: 582810 - DNA, 132 bp, Homo sapiens
atacgttcatgactgctaaagcatcagcgccgctgactgcatcacgccgctgaccgcatcaacgccgcctgactgcatccaacgccgcctgactgcatccaacgccgcctccctctgtcctggaggagggag

SEQ ID NO: 582811 - DNA, 782 bp, Homo sapiens
acggcgcttgccacccacacctggctagatgttatatattaacagccagagacattgaacaaagaaatgcctcctgtgattgaaattattctaagtagctcttagcccgttctacccaagatcacattagcagataacccctaccctcctgtgatattatcttgcttaaacctgaaccaaatatcaaaagatacaagttctcatgaattcaggatgcaactctattacataggcgcctctcgcgtctctattcgaagctccattgcaacagaccctagcacaacttcccctctccccgacgacgcacacgcggtaacaagacggttgacgcgtgttccattgtacaactataatcctcctaacacctttttctaggcgcaacatctatctgcactacccgggctagtcgtattccatatcccctaacacattaatcaccctagtgccttacctatagcatccttcgaccctttcccaagtttaactctccttatggaggtaataacactcggcggacaacgatatcgtaaccaactcatgacaacctgtgccaccttaccatgctgaattcataacctcctcggtcaaccttcactctgcatctcctcttcctgcacaactcttacttcggccccacgacgggtaacacctacgccttaggccaactcggccaaacccactcaaattgcttgctactatgacagccgcaccacatacaccaaacgtagcaagctcggacccccctccatcgaaacgcagcacagtcctcttgcacctcaccg

SEQ ID NO: 582812 - DNA, 729 bp, Homo sapiens
  misc_feature (206)..(206): n is a, c, g, or t
  misc_feature (226)..(226): n is a, c, g, or t
  misc_feature (231)..(231): n is a, c, g, or t
  misc_feature (277)..(277): n is a, c, g, or t
  misc_feature (294)..(294): n is a, c, g, or t
  misc_feature (306)..(307): n is a, c, g, or t
  misc_feature (313)..(313): n is a, c, g, or t
  misc_feature (341)..(342): n is a, c, g, or t
  misc_feature (354)..(354): n is a, c, g, or t
  misc_feature (358)..(359): n is a, c, g, or t
  misc_feature (376)..(376): n is a, c, g, or t
  misc_feature (387)..(387): n is a, c, g, or t
  misc_feature (389)..(389): n is a, c, g, or t
  misc_feature (392)..(393): n is a, c, g, or t
  misc_feature (395)..(395): n is a, c, g, or t
  misc_feature (397)..(397): n is a, c, g, or t
ttataaattattttctcattgccattggaatagatatctcagattgtgtagatatgctatttaaataatttatcaggaaatactgcctgtagagttagtatttctatttttatataatgttgcacactgaattgaagaattgtggttttttctttttttgtttgttttttttttttttttttttggctttggaccccccattttanctattggccaataccttttnttagnaatgtgctttttttggacacttttttatccatttacattctaaagnagtgtaagtggtatatnacggtttcttanngtacanggaaaaacaataaatcatatggaaattnntattatacttanggtnntccaggctaattgggtnctctaggggcntnatnntnantgaagtatatggtaaataccatcataaatcaatatagcttttcaaaattacatttacaagtaagtcatagcaactttcacagttggtattgtgaattgagaaaagcactgagtttgcctcaaggccataggcttaaaaattgtcgctgcgatcggggggacattcaaaagcaacaaaatttgatcacttttacgcctgccatttattccaaaactttttacacgagcaatttactcccctaagtccaggggcccccctaataaagaactacaattcttaataaggggccattcacatggtattgacacccttttcacaggtgcgttttgaac

SEQ ID NO: 582813 - DNA, 119 bp, Homo sapiens
cgagaacgagccttcccagcgcgccgcgctgcccatcaacagcaccctcagctacaggtagcagagaccagggcgcccgcggcggttgtccaatgacgacccttcgtcccacgcaatcc

SEQ ID NO: 582814 - DNA, 337 bp, Homo sapiens
accatgcacagcatagggagaacactgggggctgctggaggggaagggagaggtaagagtggcttcgcttcacctcttgatgctggcaaggcccatgtgctgtctaacaaggccatgcaggttctccaagctgtatctaccccaagagcattcatttacatggactctaccacgcctcgcttccaaacaatgatcttagagtaacttcacagtacaaagacagggagcattaacggcgttaataccatgaggataggagggtcttcctcttccactgtgtggctccatctaggccagaagggctctagaggggcggatgctattacgtgctgttgct

SEQ ID NO: 582815 - DNA, 894 bp, Homo sapiens
  misc_feature (781)..(781): n is a, c, g, or t
ctacctctcgatactaatctccctacaaatctccttaattataatcattcacagccacagaaactaactcatattgttatatgcttcttacgaaaacacacttatccccgacctgtgatatcagtcatgccgatgaggcaaaccagtcagaacgcctgaacgcaggacacatacttcctattgctacacgcctaggtaggctcgcttgcccctactcagtcgcgactaatttacaatcacaaaaccctaggctcactaaacattctactaatcaatcttcactgggccaagaactatcaaactcctgagctaacaacttgaatatgactaggcttacgcaatagcttgtatagtgaatgatacgctctttacggactccatttatgattccctaaagacccatgtctgaagcccccatcgcttgggtcaaatagtacttgccggcagtactcttgaaacctacggcgggtatgcgtcataatacgcctcacactcattctcaagaccctgagaaaacatatagcgtacccctttccttgtactatccctatgaggataatgtataagcaagctccatctgctatcgacagaatagacgctaagatcgcttcattgatactctgcaatcagccatatagccctcgtagtaacagccagtctaattgcaaaacacctgaagcttcaccgggcgcaggcatctcatcatcgcccacggaatagacatctcattactattctgtaggaaatcaaataagaacgcatcaagtcggttcaaatctcnctcaggattaaatcaatccataaggtctgggatagaaacacgggaacgttccccattacggggaatctggggaaccgccgggaaatcccaagagcaaagggggtccctttaca

SEQ ID NO: 582816 - DNA, 167 bp, Homo sapiens
agtaggaggtggcttggttgctgccccagatctgtccagcagggggcagtaagtgatctgggtagtatcccgggctgctaagccctgggcgggggtggtccttttctaacttcccattcacttaaccagctcttgtggggcatgggggggtctccattcccatttct

SEQ ID NO: 582817 - DNA, 346 bp, Homo sapiens
  misc_feature (9)..(9): n is a, c, g, or t
  misc_feature (12)..(12): n is a, c, g, or t
  misc_feature (142)..(142): n is a, c, g, or t
gaattttgntangaattccctttcccacgggtggcccacccccccccgccccccaggaccaaaaccaggggtggtggccgagggcaggaacgtgacctttcccttcggccagaagatcctccccaagaaagggaaagtggtntgggtcaagggccaggagcccctggagttttcctaccccgggtacctggccctgggggagggggccctgagcatcattgccaaccccggcaatgaggggccctacccctggggggggggccgccaacagggggggttgaccccctactcctggggaggccgggggggggggtgaggccgggtgataaagccctttttttttgga

SEQ ID NO: 582818 - DNA, 385 bp, Homo sapiens
  misc_feature (166)..(166): n is a, c, g, or t
gctgtaaaatttgaaattgaaagccccaggtttgaagcctaaagacgttagacatgaattaaaaacaaacaaaaagtcctattgacaatacacttcaaacacacagacacatacacatccccatatgagatagagtttactttgataaactgtttagaaataagancacactgaatggctctgatgagttgtctgactttggacaagtcacttctccaatctgggcctcaatttcctcatctataaacatgaagattgaattatgtcagtgattatcgaagtgggaacttgttagaaatgtaaattattgggcctcagcacagaaccactgtattaggtcatccacaggggttcccatgaagttctgaaaggctcaatgtccagt

SEQ ID NO: 582819 - DNA, 867 bp, Homo sapiens
ggaaacaagatggcgggttcgtggtgagaagccgtcaaggagtagaaattggtgatgcttagaagtcggattgctagaatagctagtttctcttcagaacatctttgtgcaatacctacttggataagcatcattgtaaacaccatggctgtagcctgccagtgagaaagtgggtgatgtctacacacgcagaacttatcttgaacacatttattgtccagatccaaaaatggagcttgatattgtgtctggtcataaatctacgtatgctcctctaccaaggatgactatatattgcgaaccgtgagagcttgctctgactttctgatggtgcacggtaccaagtaggtaatgtctaccagcacactgtcgtgtggacctagttccctataattgataacagcgatcaagaagtcgtagtcgcctcaggtcacgatcctggtgtcagtagaattgagactgaagaagatcgagcattgtaatcaaggtgctggaaagacgcagagttggaatgaaaaggttgaacaccgttgagagaaggactctatgatagaacaatttttatgacaatgttctttactacttaagcaccgtctcggtattcctcgatggggacggtgatcacagatgttcgtaaagaatttctgagtccttccagtaagggacagatgagtgcgtgagggttcactcgggaggaaagcccacaggaaaaaactgtgccctcattgggccagtttgaagcaacatgctgacagggtgtattccataagtagtatagtcaagggtgaaaagttgattgacctttctttgccttaatttgagaaatggtggtccttcaatatcaagtattctggcatttggacctgt

SEQ ID NO: 582820 - DNA, 1331 bp, Homo sapiens
tcccgggggaaaaaaaaactcttttaaattttttttggggccaaactctccaccccttataaaaattatatgtggtgtggccccccccactctcccccccacttacacagcggggaaatatttcttattttcttcttatttgtgtggggtctctcaaaacccgtgtgtggaccctctcgcggggggttaaaagagagagatttattgtgggcccctgtggaaaaaattattccaaagagagtgtgtgttctcccacagcgcggtgggtttatactccctctctctctatacagagagagaacccccgcagaggggaggagaaccttttctcacaacaaaattatacacctaaaaacacatgcgggtgtgtttttataaacacacacccaaataagagagtctccacacacacacaaaaaaccgcgcgagagaactcgtgtgtgataaagagtgtgtgtgtttaagagaagagagagagtggtgtgcggagacactctctaagagagactgtgtgccgggtgtatactcgtgacgagaccccctctctataagagagaagaggcgtggagtgtgtgtgaacacactctctctctcttgtgtgtctccgagagagtgagtgtatatatttatccacctctctctctcccgagagatatctctctccccaactacgtgtgtgtaacacactgtgtgagacacactctctttgtggagggggcccactctttctagagcgaggaaagaggcgcctcagaaagagggaggggcgcccaacctcttctgcggggtgtctacaaagaacaccctcttacagatagagcacactccccgcgagcgggcaatataaaatactccctgaaaaaaacacccccgccacaagagagacgcgcaacaacaaacattacgcagccctaacagcagagaggagaccccccacccccaccaagagaggcgggggggaacaaacaacggggccccgtgtgtggggcccaaaaagatacaaccacgagagacacaaccccaccgggcggaggggaccacaggaatcccccctccacacaaaaacaaaacacccgaggaaggcgaaacacaggcgcgcccaccacaaacagcggcggggaggcacaccactctcacagatgtctagccccgtcgaccgcagagagggggtgggcctcccccacaagacgagtgaagctacgcacccccacccaccccagtgggctcggccccacatatcaggggcagctggcaaaaaaaaaaacgcgcccccgggggggaaaaaaaaccacctgcgggcagcgccacagacaaaaaaagaccccccgcgg

SEQ ID NO: 582821 - DNA, 1177 bp, Homo sapiens
tgtgtgctgtgagctgcatgagtcgtgcttcgaacctcataggtatggcttagcacataccgccaccgtggcactgcaccggtccgagctgtgcgccggtatcgcgagtgggtagcgagcgccgatgccacggtgcaccacggaactccgataagcatcttttgacacgtcgcatggcatgatacgtgatgcggagatgctcgggcagtagtccgatagctattgcggcatatagaggccatggcatggaagcactcgcaagagcacccggctagctatggagtgcgcatcatacatgtgaacatggcgcacatgtatgcgtatgtaactgcgcgtagaacggccagacacaatttgcgagtagcgcaatagcacgcaggcatcacaccatcagacgcatggcagaaaggaaacttttgcgctcgaagtatcgcgcgttgattgcgacttcaatgcgcccggaaccgggatagctcgagccatgggcaaggatcgggtggagaaaggcggccgttccgacgcgaactcggaccttaatttaacatggggggccatagcgtaggtttaggctgtcaagcgcacgcagaaaacttgtttcgatccgccaggggactccccaggacaaaccgtcgaaactcgaagtggcgtagagacccagactggatgcagttcccctagggcaaaggtacacctccgaggtctgggtacatcagccgtggatggtgcagcccccttggggtaaactaccgctcatatgttgcaaggaaacttgggcgcgtacgggggaacgtttgactcttctgcacgtgaagagctctaacggaagggaacccgagcagggggcaccgtttagcagaggtctagggggaaggcccggacgtccacacgaactatcatgactttcccaagtctggtaacctcctgattgagtcgatcattccccctagggggggtcacgagtgcaccaattcgctcaacggagggaacggcgggaaaggggggcactcttcggaggccacccgggacatagggacaatggccggctcagagtatgggcgacgccccgttataattctcgggcgcgtcatgcggattgccccttggagagccagtctcccaagcagattttcttagcccttattcacatatcgcatggagcatcgcacttcgcttaggc

SEQ ID NO: 582822 - DNA, 1027 bp, Homo sapiens
ggaacgcgtgagatcgtaacgccgacgcgttgccgtattcccagacgatcaagatcgtacaggaagatgacataacatgatgacgacataactggcgtattgttgttcctgtaatatgaagcagatagagatagcttcaaggaatactcacatctgagggcatagactgagtaatcttgcaaacaccgtttacctcctggaaagcaaaggcaatgatctccattaaaattcagcaataatacttagttattatagcaattacaaagccataggtctttcctatctctaatatgttttaaacctttttaaatacattagtgtctataccatattagaactatttggttctaatcttatgactctaataaaagagataaaccaactcagtgaggctataggacaagagaccagagtcttgacatatattatttctataataaagtcatcattatctgggcagtcctgaggttccaaagtcgatatatcaaggtgaagcaatatctctctctatccacccagtcaaaattacccctagaaaactttctaaacccctataaagtacaccatatatacgtttggcatattcagatttctataaagtacattcctttgactgtccttattgagacaggatcttgctctgtcaatcaggctggacgtgtagtgggagactcttgagctcactgaaggcgtggattcccagggtcgagtgatcctccatttagcaatccgagataccatggacataccaggccaatgcaccatgcccaggaattacttaagtcaacataacatgggttcaacatgttgccaagcacagccactcctactgacatggcccctaagggtggaacacggcaacggccctgcggccacgattatagataatagccagtatcacgataacagatcttaggcgaatataattacccacctattgtgcaacagaccagcgcagcgaacatcatctagcacgcacctaagagagagatcacatattgaacactaggctacacacacacacttg

SEQ ID NO: 582823 - DNA, 145 bp, Homo sapiens
  misc_feature (6)..(6): n is a, c, g, or t
  misc_feature (32)..(32): n is a, c, g, or t
  misc_feature (64)..(64): n is a, c, g, or t
  misc_feature (113)..(113): n is a, c, g, or t
tcgaanttcaaagcttctaacgaatgtacggnggacatggggaagcccctgtgtgggaagcttngtggagtgcggagtcacgtgacctgtgcaagaaacccgccctctgtggnctgcatttgaaataaaacccgacccagcagca

SEQ ID NO: 582824 - DNA, 164 bp, Homo sapiens
gtgtgaagatcacttagaaggcgctaaaacaggaattaaaacacatgtcatgtagcctctggaaaatcccactgtacactcatgaaagacaaataatatctctctttttttttttttttttttttttttttttttttttttttttttttatttttttttttttt

SEQ ID NO: 582825 - DNA, 143 bp, Homo sapiens
tctcccaagctggagtgcagtggtgtgaacacagctcactgcagcctcgacctcctggactcaagtgattcctggctcagcctcccttgtagctgggaccccagacccattacattattaaatgtttttcaaagatggagtta

SEQ ID NO: 582826 - DNA, 1246 bp, Homo sapiens
tcactaataagcgggcacgaccccgtctgattatatcataccggggggggcgaatatttttacacggggctcgtctttgcacgtcgccttttggcggccccttatagacgcggttgcaacaaacgcggcggggttgccccgcggcgatttccgcgggaagttttgggctcacaagcgcgtgggcgtgatccaaggagaatcacctgcttcccatgggaggttcagccgcgatggagagttgtgtcacagatgggctactgttgggggtctcgccaccctccggacgaccccctgttgggtaaagcgccttttatgacagcccggggggctccctctcccccggggggggggaacaacaaacccgagcagcaggcgccgcggggtcttggggtgtttcttggacacagaagctccatccctcagcgtggggtgcaccccgcgagtgcactcttcccgggaagaagtcctcgggggacaccaccccccgggggaaaaaccacagtgtggtggggcaccaacaacaagcggggttattaacccccaacgtgttttaccaggggggggacatgatgtgtccgcgtggtaacaccccggagaggggcacaccgcgagaagagaggcgttctcaccccctctctttgtcccgggggggacacctccgtggggagccctgttggcccccccccccgccaaggggcccccacacagggtgtgataaggtttcctcccggggaggagtgtgcgcggagagagacctccgcggggtctcttctctgggggcgccttgtagtgggagggaatgggcctttttccccctctggtggcgccctcgagtaagggccgcccccaaagactttcccacacccacccctctccctgcggggagaaacttcccgagaagaacctcacagacgcaccccgcgcgggccgcggtggcttctttgtggggggagaggaggggggacccgccctcctccttctcctccgggcgcctgtgggtggggccacacaccagactccctccctccacaggggtaggcgcgggtgttttttgtgatgatgtctcctctttgtgttttcctctctgttggttgccctctcttttccctcccctcggggttctcttggtgagtgttcggcggggaggtttggggggagggtgcccccccctgctcgggccccctccccccccgcgctgtggtttttttgtccccttttttcaaaaaaaaaaactttttggttttta

SEQ ID NO: 582827 - DNA, 364 bp, Homo sapiens
agagaaggagaggtcgacgtggtatgttctccgcttcttcagctgtctctgtaggatctcaccttagctgaggtagtccaccaggtcctggagcctgagaatattctgcggtcttcctcagttggtaagtgagttccttcacttttctctcatgtttgcgtagacccttgacagcttcaacattgcgcttctgttcactttcaacttcaccgtcaagttcacgaaccctggcctccagtttctggatctgcttcttcccacccttcaggcccagctgctcagcctcatccagacgatgctgcaggtccttcaccgtctgttccaggttcttcttcatccgctccagatgggcgctggtgtcctg

SEQ ID NO: 582828 - DNA, 645 bp, Homo sapiens
ggtgacaacatgctggatgccaagtgctaacatgccttggcttcaaggcgatggaaatgtcacccgtaaggatggcaatgccagtggataccacgctgcttgagtgctctggactgggtcctaccaggcaatctcgaccaacatgacaaggcccttggcagcctgcctactccaggatgtcttacaagatcattctggaggtattggtactgtacctgttgggccggagtggacgactggtgtactcaaacccggtatggtggatcacccttgtgctccagtcaaatcgttagcaacgagacacggtacccactcatgtcgaagatgcacgcatgaagcattagaagatgaaagctgcttcctggagacacttgtgggcttcaatgtcaatgaatgtgtcttgtcaagggatgtactgtcgtgaggaatctgttgctggtgacgagcaaataatgacctcgactaatggaagccagatgatttcacatgcgtcagtgtgatcatccatgaatcatgatggcaaaataaagctgactgggtatggtcgctttattggattgcaagagggggtccaagttgcatgcaagataggggatgtgaagggaacagattgatcgggtgttctggtgtacatagctggaagat

SEQ ID NO: 582829 - DNA, 262 bp, Homo sapiens
ttgtgggtgatctgaggatccgccccggtagattccttcaactggcgctccaacattggccacctgttggcacaggcgccgggtgcgagcatttttttcatcacgccgcgggcttcgtcgataaacaggcggccggcagggtcagttccacgtcgcgatgccgacgcacaaacagcggcacggccaaccattcttcgagctgacgcacggtgtagctgatggccgacggtacacggtgcagttcctgggcggcggcgctgaa

SEQ ID NO: 582830 - DNA, 411 bp, Homo sapiens
  misc_feature (11)..(11): n is a, c, g, or t
  misc_feature (21)..(21): n is a, c, g, or t
  misc_feature (70)..(70): n is a, c, g, or t
  misc_feature (114)..(114): n is a, c, g, or t
  misc_feature (131)..(131): n is a, c, g, or t
  misc_feature (214)..(214): n is a, c, g, or t
  misc_feature (216)..(216): n is a, c, g, or t
  misc_feature (308)..(308): n is a, c, g, or t
  misc_feature (379)..(379): n is a, c, g, or t
  misc_feature (410)..(410): n is a, c, g, or t
gggacctaggnaaaatactgnaagacataagtcctgcctggtttttcctgccctacccttgtaacatccngggtcctcactctgtcaccccaggctggagtgtagtggcacaancctcggctcacctgcanccctccgcctcccgggttcaagcgattctcctgcctcccaagtagctggtattacaggtgcccatcaccacaccctggctaantnttgtatttttcatagagacagggtttcactatgttggctcagctggtctctgaacttctgatctcaagtgatccgcccgcctcggcctcccnaagtgctgggaatacaggtgtgagccagcgcacctggctgacatccacaacttaaggctagaaatgtaaantgttggttcgcagtgtaacaagcacattccna

SEQ ID NO: 582831 - DNA, 358 bp, Homo sapiens
  misc_feature (12)..(12): n is a, c, g, or t
  misc_feature (37)..(37): n is a, c, g, or t
  misc_feature (87)..(87): n is a, c, g, or t
  misc_feature (99)..(101): n is a, c, g, or t
  misc_feature (104)..(104): n is a, c, g, or t
  misc_feature (226)..(226): n is a, c, g, or t
gagagcacatcncggtgttagaatctgctggtaggcncttggagaggcgggttatttagagtggagactgcagaaaggcccctgganccgtggttttannngancgaaagatcatttttggtgctcttttaaaattttctcatatatccccgccaccccagttttttctgatgatggtctatgcaagttttgccctttgtttgtttgtggcggctgccggggcctntgtccctatggcccctcatttctttcaggctggcctgctgtctgccttgggctccctgcttttgctgttttggctgatggccccccctctttcccctgttcctgctctgaatagactgggacttcttgttgg

SEQ ID NO: 582832 - DNA, 158 bp, Homo sapiens
gctcgactaacaaccttatgatgttagatattatatatccacatattacagattagaaaaaaggaacaacatggctaagaaatgagtgtaaaatatttaggacaatgcttggcacataacaaacacaatacaggtcttagctgttatttttgtcgacg

SEQ ID NO: 582833 - DNA, 413 bp, Homo sapiens
gggaagcgcaggtattcactcccgcatcctggcatgcatagccacccgccaataccgcatcgcagcgatggaggcgcacacggagcggctcaaggccaacgacagcctcaagctctcccaggagtatgagtccatcgcgcctggagagcagttcacatgggcacattccagcctggaagtgaccaagccgaagaagcgctatgccaaggtcatcgcctatgaccactcccgtgtcatcctccagccccttgaaggcatcatgggcagtgattacatcgctgccaagtacgtggacggttaccggcgtcagcacgcgtccctggccacgcaggggccgctgcctgagccctttggggactactggcgtctggtgtgtgcgccgcggtcggcgaacatcgtcatgaggacgcggc

SEQ ID NO: 582834 - DNA, 900 bp, Homo sapiens
gccgggcgccatggatagagcaggaggggccggagtattgggaccgggagacacagatctccaagaccaacacacagacttaccgagtagaacctgcgcaccgcgctccgctactacaaccagagcgaggccgggtctcacacttggcagacgatgtatggctgcgacctggggccggacgggcgcctcctccgcagggcataaccagtttagcctacgacggcaaggattacatcgccctgaactgaggacctgagctcctggaccgcggcgtgaccaccgcggctcatcatcaccctagctcaagtggggagagcggccgtgtggctggagcagctgagagcctacctggagtggctgagtgcgtggagtggctccgctagatacctggagaacgggaaggagacgctgcagcgcgcggatcaggagcagaagtccctgtttccccgctcagagactcgaacttgccatatgaataggagattatcccagacccgcccaaatgtacgacacgtgagccaccattcccagtctctgaccatgagggcaccctgaggtgctgggccctgggcttctaccctgcggagatcacacctgactggcagcgggatggggaggaccaaacttcaggacactgagctgtgtggaggaccagacagcagtgaggatagaagcttcccagaaagtgggcagctgtggtggtgcttctggagagagcgagatcctatgcctgttgccgcttgaggggggccgagccctcaccctggaggggcctcttccgggcccgtccctcgtggcctgtgtggcggtgcctccaggtgctcggctggcccgtggggtcgagcatctgcggggggctcgcgtgcccccgtgttgccccacactgtcgcgggttcctgg

SEQ ID NO: 582835 - DNA, 144 bp, Homo sapiens
tgtcttcgttataccaataatcgccggtgcatggtataatattctgaaaatacatctgtttgctcctgttgtttctattctaactgtttcttaatcagctttaaaattttctctcagcattttcacccataaatctacttcccg

SEQ ID NO: 582836 - DNA, 200 bp, Homo sapiens
tccataagaaaaaaaaaattagccgagtgtggtggcccccccctgtaaccctacctacttggaagggtaaggtgggaggttcgcttaagcccaaggaagttggggctgcggtgagctatatcccgatactgcatcccatccagcctgggtaacagagccccccctctttaaccagtaaaaagaaaactaaggctgcctta

SEQ ID NO: 582837 - DNA, 187 bp, Homo sapiens
  misc_feature (26)..(26): n is a, c, g, or t
  misc_feature (47)..(47): n is a, c, g, or t
  misc_feature (116)..(116): n is a, c, g, or t
  misc_feature (143)..(143): n is a, c, g, or t
  misc_feature (168)..(168): n is a, c, g, or t
  misc_feature (177)..(177): n is a, c, g, or t
tactgtggtgtactgtctcctgtgtnacacacctatagtcatcaggnaacacacttggagtcaggtaactgcctttacattattccccacaaacctcacatctccagcctttgttngtgtcacctggctttgggtaagatggngaaaaagtaaggcgcattgcagaanacccttggnagagggctcc

SEQ ID NO: 582838 - DNA, 104 bp, Homo sapiens
atttacagatgctgacaatacttggggacctgaaggaaaatttagattgtccagattgatttaagcgtttcttaactctcagcaaggctggcaaagaaaaagtg

SEQ ID NO: 582839 - DNA, 321 bp, Homo sapiens
ggttaaggcaaagctagggccaggatggtggatccctcctgtattcccagcatttggggagggccaacactgtattacctgacagaaacttcactacatgataccaaaagtcaaatccttatataaaattcacccaaaacattcactttgggcgggagcatggctcatgcctataatcccagcactatgggaggctgaggctggcggatcatgaggtcaggagttcgagaccagactgaccatcatggtgaagcccaatctctaatagaaacacaaaaattagctggccctggtggcaggcacctgtactgccagctactc

SEQ ID NO: 582840 - DNA, 359 bp, Homo sapiens
  misc_feature (9)..(9): n is a, c, g, or t
  misc_feature (17)..(17): n is a, c, g, or t
tcacccagnctggagtncagtggcatgatcacagctcactgcagccttcacctcccaggcttaagccatgctcctgcctcagcctcctgagtagctgggaccataggcatgcaccactatgcccagctaatttttatgtattttttatagagatgaggttttgccattttccccaggctggtcttgaactcctaggctcaagcaatccacccaccttggcctcccaaagtgctgggattacaggcgtgagtcacagtgcccggcctccatatctactttttaaaaataaaaagaaagctctcagcagtctgtcttggagacaggctgttttcactccagccttgcactgaagctcgtgc

SEQ ID NO: 582841 - DNA, 523 bp, Homo sapiens
  misc_feature (10)..(10): n is a, c, g, or t
  misc_feature (17)..(18): n is a, c, g, or t
  misc_feature (26)..(26): n is a, c, g, or t
  misc_feature (59)..(59): n is a, c, g, or t
aggaacaaanccaaagnngaaaaaantttgttttaatagcgggagcgccaaccacacgnacatccaaaaaattcaaggtttactcaacgtcaaccaagcaaaagaaaggaaaagtcaaaaatttcctgaaatagctaatggggccttgggtttcaaaccatcccgacaaatgaaagttgacttaactgaaagaaatggaaagaagaaatgaaaaaagtggagcaattcaaaccttggcttttcaacaagagacttgggcttttctaatctcttggactaacactgaaattcaccccccaactgaaaaaagatgaagtatgcccttgccgtgtgaaaccatgtgactttgttcacaggccaaaaaaagtaaagggggaacgaagacatgtaagcaacaatcatggaaggtttgaagaaaccccaatttggattggatgaaatccaaaattctgcttgcctggttttaaaaaaatgagaagcctaaaccacttacaactttatgcacaaaaaggaaggttaaaaa

SEQ ID NO: 582842 - DNA, 825 bp, Homo sapiens
  misc_feature (9)..(9): n is a, c, g, or t
  misc_feature (28)..(28): n is a, c, g, or t
  misc_feature (35)..(35): n is a, c, g, or t
  misc_feature (47)..(47): n is a, c, g, or t
  misc_feature (75)..(75): n is a, c, g, or t
  misc_feature (100)..(100): n is a, c, g, or t
  misc_feature (113)..(113): n is a, c, g, or t
  misc_feature (200)..(200): n is a, c, g, or t
  misc_feature (230)..(230): n is a, c, g, or t
  misc_feature (254)..(254): n is a, c, g, or t
  misc_feature (256)..(256): n is a, c, g, or t
  misc_feature (520)..(520): n is a, c, g, or t
gacattaantagcgtcctacctgcgccngcgcgcngcccattcgtcngcgcagacccacccacgacgtctttacngtcctcaacaccccgacactcgggnatgtgtgtgtcgntcgcgctgaccgcgagcgcggtatatatattaatgtgtctatcgagcgtcttatggatagccggtaagtattgagttcactctcctntcccccacctcctgtatttgcgctgtctcnagccccaccccactcctcccccgngnccgccgccaccacgaactgcgaatgaattctcctcactctgtttcgtctccgttcgccccccatcaccctaccccaaccacacaaaagaaaagtgatcaggacgcctatttacaagtggcctatgaatatgcgtgatttcataaagatgcatacaccccacagccacacctccaaccattcccatttatcatcttgtcaacgggtcccgccctgcccgcgcgacgcagtgtgtctcatctacccaacagcccttcatctctcantcacaagagtgagaccacccccaccgcgacgcccccgtcaaccttcgttcgccgtatatgttcaacgaggatggctcgtcagcgcacgcggctaccaataccatcctcctagacagtcgcacgcccatgaagtgcacagacgggaactgcgcaaggtgtgcagtcatctaccgaacatccctccacggcgtctaggacacgtaacaactgctgtgaccgctacggccattgtaccacttactcacgtatacttgttgctttaatagatacttatataacaagctcccactatactacctatcact

SEQ ID NO: 582843 - DNA, 141 bp, Homo sapiens
gatagtcatacctctcacaaatgaatgaattgagcttgccagttcaaggaaacagtgacagtatttatttgccaatgataaaactcagactttcaagcaaaagttaggattttgtgaagcttttatccacataactgatct

SEQ ID NO: 582844 - DNA, 432 bp, Homo sapiens
agtgtgacccccaaacaccgcaatctcaaaataatgaatgggaacaatggctggcaaagattgtgctatgtatgtatcactgaagcactggaaacaggagcgtggcatactgtttctgttagagcattaataaaataactgtcacacactgtgttcgatgtaagtcagacactggataaacacttctatattatcagtattaaccccaaccaaagcatttaacgtgacattatgacacccagaatacatatggaggaattgagaaacagaggtgaaacaactttcctccacaccacacagctagtaagtataggaactggaaatttgaacatattctcattccaagtaaatgcacttaaccactaccctgtggaaaggagattctaaaaggatgaaatgatcaaacaaaaaatcttctacacagcaaaggaa

SEQ ID NO: 582845 - DNA, 220 bp, Homo sapiens
acagctgttctcagtgtggggtggccactccttctgcattggggggtgtgtgcctgtgcccccgtgtgtgggtgtgcacatgtgtgtcgggtgtgcatgtgcacttgtgtggtgtgtgtgcacttgtgcgtgtggtgtgcctctgtgtggcctgtctgtgtgtggggcgtgcctgtgtgtggcgtgcctgtgtgtgtggcgtgactgtgtgtggtgtgcc

SEQ ID NO: 582846 - DNA, 315 bp, Homo sapiens
  misc_feature (40)..(40): n is a, c, g, or t
  misc_feature (62)..(62): n is a, c, g, or t
  misc_feature (106)..(106): n is a, c, g, or t
  misc_feature (187)..(187): n is a, c, g, or t
aagtagtcctccagccctccagactttgtgtgtgtatganacagagtctcgctctgtcaccnggctggactacagtggtgtgatttctgctcactgcaacctccgnctccctggttcaagagattctcctgcctcagcctcccgagtagctgggactacaggcacatgccaccacactcagctaatntttatgtttttagtagagacagggttttcacatgttggccaggatggtgtcgatctcttgaccttgtgatttgcctgacttggcctcccaaggggctggggattataggcgttacacgcaacggcccg

SEQ ID NO: 582847 - DNA, 119 bp, Homo sapiens
ttctttgcctgtaacttctgaatcaatgtatatcatggactgcatgcggtgggtgaccgcaggaaattagatggagctgctcatcaaaactaagaatggagaatgcccaccttcatccc

SEQ ID NO: 582848 - DNA, 146 bp, Homo sapiens
tcaagaaagtatacaaggtatagagtacaaagctcctcttaatatatacctagttctaatcccccggcttactacgttattggtgaatcctttcaaagtttctttctacatatgcaagcaaatacaaacacatactcttactcccc

SEQ ID NO: 582849 - DNA, 696 bp, Homo sapiens
agcggaagttatcattgactagtgctcacttcgggccggggcgcgggaaggtgcgggttgtggctgaggcaagcctgtggacacgagcgaggcgatgtacaggcgggcaggaccgtcttgcacggcgaacagagcgcataccagtctagcgcgttgcgcagaccacgaatctttcgctgccagaaccgacgaacactcgggagtacgtgcggagtgattaatcacggatctgacgtgtgaataagagagacacaccacgaaagcgcttagaatcaagaatctcgttacaggaacctaaaagaaacccgggactgacacgtcaaacgagaatgtaataaaaaaacgacagaagaacacactacctaaaccaacaagaacagcaagaaaaaaaaaaaaagaaaataaaaatacacacacgagcccagagagacaccaagccacaaaaaagaggcacccaggacaccaccgaaacaaagaggagaccacagatgagaaaacaacaggaataagaccacagcaaacaaaaagaaggaaaaacagagaacacaagcaacaacgaagagagaagaaaaaaaaaacaaaacggtagctacgaaaaaacaagacacgacacgaacggagataaaaaacaaagaaaaaaagcccaaaaacaacaaaagaaaccaaaaaagaaaggcaacgagaaaccacaaaaag

SEQ ID NO: 582850 - DNA, 157 bp, Homo sapiens
cattgtcggagaataggcagggagtgagacggctctccaccatcctcagccagtgcaacccattccctctgcttctctctctctctctctctctgtctctctctgtgtgtgtcgccactgaataatctttaagcagaagtatgtgggagttagagac

SEQ ID NO: 582851 - DNA, 449 bp, Homo sapiens
  misc_feature (308)..(308): n is a, c, g, or t
  misc_feature (390)..(390): n is a, c, g, or t
  misc_feature (402)..(402): n is a, c, g, or t
  misc_feature (410)..(410): n is a, c, g, or t
  misc_feature (431)..(431): n is a, c, g, or t
  misc_feature (437)..(437): n is a, c, g, or t
ttatttatttttttgagacagggtctcgctctgttgcccatgctggagtgcagtggcatgatctcggctcactgcagtctccacctcccgggctcaggcaatcctcccaccttagcctcctgagtagttgggactacaggtatgcaccatcacgccccagctaggttttataatttttgtagagacggggtttcaccatgttgctcaggctggtctcgagctccggagctcaagcaatccacctgccttggcctcccaaagtgctgggattacaggcatgagccactttacctggccctaacttttgnttctttacccagatttttaaactgggaagactgaaccatgtcctacattgtctggcttcttaaaactgcactgtacacatancaagagcttaanaaaatgcnggggggaaaaaaaagattttnagtgcntttttacctcta

SEQ ID NO: 582852 - DNA, 168 bp, Homo sapiens
ttttttggggggggggggttttccccttttttccggggggggggggctttattcctttccccctttaggggtttccccggcgggggggggggtttttttccccggtttttttttttttcccccccccccccctttcccccccctttttacccccctttgggtttccca

SEQ ID NO: 582853 - DNA, 1110 bp, Homo sapiens
acccattctaatcgcaatggcattcctaatgctttaccgaacgggaaaaattctaggatagatacaactacgcaagaggccccagcgtgtaagcccctacgggctactacaacacctttcgctgagcgccataaagctcttcaccaaggagcccctaaaacccgccacatctacgcatccacgccatgctacatgaccgtgcccgtaccttaagctcctcaaccgatcgctctgtctagctagtgaaccccgcactctcgccagttactcagaaacacacctgggtcaaataatcaatgcctagtgcactgccctaagttgatgtcatagacccgacgctcctaaggcgtagcccgcaagggtgcaattcctgctgatcaggggtgacacatgcggaagctcaaattagactctggactcgggacacctgagatcctcgctaagctcaaagaaacagatgtccggtattgggaaattttgccacctttaaagcacaatcaattttatagttctaattgcatcactttacataggttacttgaggcatcccatattatagggtttatcccaggcaactatagttcatgggttgggcacactgacattagggctcaagattgggcttctcatgaccagacgatatgaacccctggggacattaatagtgcctacatataatcgcagcacatagccgagaaggacataacagccttcacattgcgagcgaagcccacaaggggagaagtaaggaaccagcactcagagcgtacacactaccgatacatcgcaaggaaggcccacgtacaacccctatttcaatgcaagtgggccgggccatatacgaacgcctgctcactagattacgcttcctctcccacatacggaaccctggctaaccaaaacaaatcatgaaacaaactcggcctgcactttatacaaaattactttgggagcgcaaaacctaggtataccccacctgcctgataaaatctggcccacattacgacgacttacgatgaacaaccgagacctcctaaaaacccaggaaacccgtagctgaacatagcactgccacacttactcgaaatccgcacaatcacacgcgctaga

SEQ ID NO: 582854 - DNA, 94 bp, Homo sapiens
cccattgctggcacttaattctacagagaaagatacgagcaatcagtaggaagtacacgacatacagtgttgagagtagtcctgctatgaagac

SEQ ID NO: 582855 - DNA, 212 bp, Homo sapiens
tgtccacttaaggcctgatgtgtgcctggggcctgattgtccacctggggactgggtgtccaccttgggtctgatgtctacctgaagttatttatctacctaaggcttggtgtctacctgtggcctgatgtccacatgagtctggggttcggttggggcctgctgtacatctgggaccttggtgtctatctgaggccagatgtctacctggt

SEQ ID NO: 582856 - DNA, 243 bp, Homo sapiens
ctttgccatgtcatttggaataaaacttgaaattttgatttttggaaaaaaaagttttttattttttgttgaaatcccctgttacccttgtttgtaaactgaaaacttttttgctttttttcaggaaaacagttttcaactgttgttttgcttttgatagaaactgaaaagcagcaatctgtatttgtggaggaaagtccttttttttgcaaattttaataaatgagccgggtttgcccccca

SEQ ID NO: 582857 - DNA, 394 bp, Homo sapiens
ggacccctcacggattactcaaacataagaatcctagaggaaaacctaggaaaacactctggatgtcaaccttgggaaagaatttatgactaagtcctcaaaagcaactgcaacaaaaacaaaaattgttaagtgggacctaattaaactagaaagcttctgcacagcaaaagaaactatcaacagaataaatagacaacctacagaatggaagaaaatattcacaaactatgcatccaacaaagctctaatatctataatctataaggaacttaaacaattgaacaagcaaaaaacaagtaactgcattaaaaagtggggaaaggacatgaacagacacttcctaaaagatgacatatgaggtaggtggactacttgaggtaatccgtgaggg

SEQ ID NO: 582858 - DNA, 611 bp, Homo sapiens
gggatctgtggaagcgcctcttcacggcactgggatccgtatctgcctgggatcatcaggccctagaagctgtgttgctttaaattagggctgccgtttgctgttatctccctggggctgcggaaagccagaagatgttatctatgcttatacaaggctgctggtgttccctctttattaccacgagggtgtttgtggctgcaattgcatgaaatcccaataggtgtagaccagtggcgatgggatctagagagtttaccaactgagtacaggttcttcaactgtctttcttgtcaggtccttgctggggactgaaaacgcttctgtgagacttgagtaatagctcctctggtgcacaagtgtgggtagcgtattgacaactaaatcgagcaagctatggatctacgtgaaaagccatttgatgtatgcggtcagagaagaagtggatggtcctcaaagagcaaatcaatgaagtactagagaaaaattcccagctggggcaggagatccatctgctgaatacactggccagtcctgagcagcttgccagttctcgggcccagctgcaatgggggctccgcccgtgtggccagtcctggggcccgaatttt

SEQ ID NO: 582859 - DNA, 353 bp, Homo sapiens
cagagtccaaacagtgcccagagtgcaaacagtgcccacctcctcgaaaactccacagccaccgtgagcgaggcgcagagaaaggcgcacgtgtactaccgcgcgcgcgtgagcgagaccacgatctcggagctcaaggccacacctctaatggagttgattgagaggcttgggggctggaacataacaagtccctgggcccagggcaacttccacgacaccctgccggtgggtaccggccactaccggaccttacccttcttttttgtctatgttagtggcgattcccagaactcgaaccgcaacctgattcaagtggaccagtctggcctgggcttggcctcccgagacta

SEQ ID NO: 582860 - DNA, 152 bp, Homo sapiens
tctgtaaggatggaaggactggccaggcctggtggtgcacacctgtaatcccagctactcaggaggctgaggcgagagaatcgcttgagcctggggggcagaggttgcagtgagctgagagaacggcgggcggcagagcgagactccatctc

SEQ ID NO: 582861 - DNA, 133 bp, Homo sapiens
ttactcaaaagactgagccctgaggactatgtgaatacacaccccgtaaggcaaatattatccagcaagcagttctaccctgtcctttgcaattgctctgctccacgtctttcctgctacaagtgtattagat

SEQ ID NO: 582862 - DNA, 205 bp, Homo sapiens
acatcacttatgacattgactagccaagtggtatactcaatgtcatctgctgtgaacaagagtacggaacaagagaacaagattactatcatctaatgacaagggccgattgagcaagagaagacatagaacgtattggtccagagaagctgagaaagtacaaaagctagaaaatgcagaagcacgagggcacacaggtgctcat

SEQ ID NO: 582863 - DNA, 699 bp, Homo sapiens
  misc_feature (188)..(188): n is a, c, g, or t
aacttttttcttcctgaatgaatttggtaattttttttaattttaaaaattagtgcatttgtcaaatttacaaacagcttttcatagtactgttcccttgttatcctcttcaggtctgtggggttaatagtgatgtttcttctctcatttgatgtttctaattgcatcttatttttcttggtcatccnggctagaggtttatcaattgtgctgaacttttaaaataatcaacttttagtttcattaattttctctatgtttttctgtttccaatttatttgagttctggtcttctaataatactttccttccttctacttactttgggtttattctgttctttttctagttttgtcacttgcaagcttagatccttgatttgagatgttgttcttttccaatataagcattataaatttctctaaatcaccgttttaaatgccttctgcaaattttgatatgttgcattttctctttcatttacttttctaaattcctttgtggctttccttttggcccatgggtaatccagaagtatgttggtgtattagtccgtgcttgcattgttataaagaaatgcctgaggccaggcacgggggtcatgtctgtaatcctaagcactttgagagactgaagttagagatgcttgagattaagctcagcaacatggcaaaacccgtctctacaagaaaaaaaaaa

SEQ ID NO: 582864 - DNA, 562 bp, Homo sapiens
tacttgatcatctactcaatgcatacttaaacatcactcaataacatacacacaattaacaaaaaaatgtgacaaaggctagatcttaaaacggctctgctataaattgtctagaatatacagaattacaaagtcaagtattttattatcaaaatatacacccctccctgaaactaacacaagctatcaacattttaaatgaatacaattatagaaaatatttgcaaaattattttttcatgtataaatattctgccatatttactttggtctagaattatcagcatacaagtccacttaaaaaatatccacatataagggctgggagagagacatcactacaggtaatttaatatttggggttaactcgaatcaaaatgactagaatatacagtaatgtctttgattaatattattaactgataaaacaaattagtggatcataggattgcttattcaatattctaattatcaattcaacaatgattttcgtacgccctttgtgactatctcttaaataaaacccaaatgcatagtgtcgggtgtacatatatacaatgta

SEQ ID NO: 582865 - DNA, 102 bp, Homo sapiens
ctagaggacccgtgacatcaggtgatggccaattgggtgtgaggagtcagtatatgtttgggatttttaggtagtgggtgttgagcttgaacgctttcttaa

SEQ ID NO: 582866 - DNA, 375 bp, Homo sapiens
cttttttttccctccctaacttttctggcctattgtcattgttgtttttttaaacttaaggagagaaaaccaaaaatgagattcctcccctttgcctaattgagcccctaccaggttttttggcagctgtggccccattatttgtgagatgattttttttttttatgttcagagtgacttttgattttgattctttatgttttgtatggaggggcacttttatttgtgttttagcagaactgttcctttgtatcctttacggtttttgtttggttttgtttcctttttaaatagttccagcatttttttggtgtggatccggccacaccgttgaaggcccttgaggccacaaagaagaaaaagaaacagtttggg

SEQ ID NO: 582867 - DNA, 1054 bp, Homo sapiens
  misc_feature (359)..(359): n is a, c, g, or t
  misc_feature (385)..(385): n is a, c, g, or t
  misc_feature (430)..(430): n is a, c, g, or t
  misc_feature (492)..(492): n is a, c, g, or t
  misc_feature (505)..(505): n is a, c, g, or t
  misc_feature (512)..(512): n is a, c, g, or t
  misc_feature (514)..(514): n is a, c, g, or t
  misc_feature (912)..(912): n is a, c, g, or t
  misc_feature (945)..(945): n is a, c, g, or t
  misc_feature (974)..(974): n is a, c, g, or t
accgcagagttgttcctgtctgtcaacacttttcctctggcacgcagcactttatggcacatagtgctcatgtaactttctacaagtaaatggaatatgccgtattatctttggaaagcctgttttcaggcagcatgtcttgacatgtctcacgtggaaccgggaaccaccttcttttcccagcagttattctgacgtgtggatgcaccttgcttcgtttaaccagccctgcaccgatacttctttggatggtttccgccttttcccaatcacagacggtgttctgatgaatttccttacacacatcacttggtgctctgtgcctgcatttctgtgagatgttcctggaggtgggctgnctaggatcagagggggatctgtgctnaatttgcatcctgtgcaaaattccatccagtcatccggctccccnagggctcacatggtactgtcctctgtagacatcatcttctgcagatgatggcacgaccgccnctctttcttttantcacacnantctgcacctcggtgtcctggggtgggggggtcccagcccctacccacttgtccccgcagaccctgctaacggtccccccagcccctgctaacagggactctggcttccgagctctggcagactgcctcactctggagaagtttgctttctcaaacattcctgacaatgttactgcagatctcgaggcctgcctttgccttcttcagtttcctcaaaagtaaaatggggataatgtgatactactgtctgcatcctagagctgccatgagggttcagtgagatcactgttgacagcacgttcacggcgccggccttgtgcgcagtcagcacgtgtggggcagggctgttgctgatacgtggttgactgtcattgctagactgtggctttaccgggggcnttgtcttagtgccgagcccagagccacccctantactgctgtgttatagagtgattgagtgncagggtcagagactggggcaatggcagcagaaacagaggaaagaagtggggcttctaatagttcctgcactagtgtccag

SEQ ID NO: 582868 - DNA, 854 bp, Homo sapiens
atactccttgttttcgaatacggaacctcgatatgcgggtattgatggtggccttgctatatggatgatgccccggtttgaccggtggccatcaccgtaatgaactagaaggctaggtatgatgtgtggtattgtataggcatgagagtgctgctgaggggtgctcgtatggtgaatactgctttgctgtacaatgtgtgataagtgcatccaagcagtatataaatagcttccgatagagagaaggaataatcctctgggaatgcgaatgatattccatatggcacttgtaatctacaaaattattgtgacagtgatttaacttactgttttatggggtaggccttgattgttttgtggaaaagagtcgagtgctccaggtactcattcccatgggaattgggaaggggagggtaatattcagattgttgaaggggtaagttctggtttacaagaaagaatgctagtatgatccaagttggaagaccgaggtggaacgatgggagagaatgtcatacgctgggggggaaaattttattcagtcgggttgccaccgtgttgggaccagttatcctaacataactaaggatgggcgtagtagtttattgtgtgggggaggagagcccgggtggaaggtacttgaaggaacacatggggctgtggaaagaccatttgtagaaggcctgggggggcatgtacagtagtaattaagtgatcaagactggtggttaacatgtgtttgtgtcttgtaacattacataggtgcgttgtaaaggggttcccattttgggtggttgctcagaaaatgaatcatttaaatagcttaagagaaaacttggagggagataaattca

SEQ ID NO: 582869 - DNA, 189 bp, Homo sapiens
tggctgagcccaaggatgggggcaggccctggagctgaggctcacactccctgcgcctgcagatgactgtccacaacctgtacctgtattgaccggatatggatgtgtgtcttgcactacagcagaatggcaccgcaacgaagcaatgcagggattcccagacggagtgaggagtataacgctagatgt

SEQ ID NO: 582870 - DNA, 980 bp, Homo sapiens
ggcattggagctggcatgcagcgagccggggaccccggggccgcccgcgtcgcggtgggactggggctgcgtgtcccggccgggtgtcgggctcctgggacacagtgacctgaaggacggacgagcgaggccggtgcggacgtggctatccagcctggagaccgggcagcggccccgctctgagacgccctgcctccccgcaggccccgtctgaggtctggcagtcaagagaacagcctgggctgcccacggcccgagcgcccacggcagcaccatgccctgcactccatggagctgccccaagctttccaactgccatggaccagggcagctgcaacggcaagattatgatggagcgggagcgcaagcggcaggaggacagacgaggtggatacgcatgatggaacagaagcatgaaggacgaacaggagagcaaggcagaccgacggcagatggcacagagcagcaatgtcatctcagaggagaccaaggcacgaaaattctgaagtaaggaaggcagcaagcgtacaggctcataccaggaaaggagaagcgaccaggcttattcgcctgcgagctcgaagcacaaggtttacacatggaaggcacagcaccaaaccggaggccggagaggggacacaagaggtggagcctgacgcacccgtagacaatcgaggcatggcaattacccagacacagaagccttgacgttgataccaacaacagagggaaaacatcaatctaccgtaccagcaattgcaagggagaaggcccatggaaacggaacacacacaatctaggcacccacagtgggaacaccacgaaccaaaatgaggacaagagccgagagaacgacagacaagccaacgacacaccaaaaaagatcgcttactggggaaccccccccgaaagacgcaggacacttaacgagaaaacacaccagaggcacgacataaaccagtttgaagtgcactcaacag

SEQ ID NO: 582871 - DNA, 297 bp, Homo sapiens
  misc_feature (1)..(1): n is a, c, g, or t
  misc_feature (87)..(87): n is a, c, g, or t
  misc_feature (107)..(107): n is a, c, g, or t
nttatgaagaacagtagatgatcagcttcactaggcgcacatcaaagggtgtccaattctctgaaaggggtgagacgtctgtggcanactcttgaaggggtggagangggggtacctaccaacattgtcaaagccactagtggagcaattcctgctatgatgaagattaaatagaagaataacagttccaggataacattgattcctgacaacagcgtggagatttcaacagaacttgtttggaacaaatactcacttagagcgtgggggggaagaaaaattacttagtccttaggc

SEQ ID NO: 582872 - DNA, 86 bp, Homo sapiens
  misc_feature (49)..(49): n is a, c, g, or t
  misc_feature (58)..(58): n is a, c, g, or t
agagagcagtggcatgatctctgctcactgcagcctcaaccagctgcantcaagcaancctcccagctcagcatcctgagtggctg

SEQ ID NO: 582873 - DNA, 401 bp, Homo sapiens
  misc_feature (303)..(303): n is a, c, g, or t
  misc_feature (360)..(360): n is a, c, g, or t
  misc_feature (397)..(397): n is a, c, g, or t
cctggtcctgggatgctttccaaacagcccaggcctttagcctccatgggtgatgacctcagctttcaccctggtgaagtttgtgtacccataatgcagccccattccatggggcccctgaaaaccccctgaggaattccgtagggttttgtttccccgaccggagtgctggctctcccagtgaattttgatgcatttaaaataagattttgatgccagactgttaaaataggcgctggttttgaagccccgatggaaacagatttatgcaaatggaaggaggaagggagactgggccccctnatttccagcccccccatgtgtgctgttttcaaatgtgattgaggggtgttttgcccngcctcccctgtcccagcctttaataaaaatgtgaatnttga

SEQ ID NO: 582874 - DNA, 1095 bp, Homo sapiens
  misc_feature (357)..(357): n is a, c, g, or t
gttttgacggtgacggctgcttccactgcacccaattgcattcggcttcactcgcacgtccgcacggatgcgtggtggactcgaatcgggagacgggacggaggctcaatctcgcgcgtaggagaaaggattgtcttgcaaaaatccggtggaaaggggagggagcgtgcgagagatgtgcagtcgccaggaggcccaccagaagggaatctcgttgatcccgtatatgcatctcgagtaattggccagtcggcgaaggcagtcacttcgagaccgcgagggccccctgagggcacatccaacaagatactgcggtggcctgtgagtcggactggtggctcggtgtcctctatggcntgatgaaggagtagctctaggttgcggtaaatccgaaggaacgtctctggaaaggacgacgcgatgaattgtcggcgtgtgttcggacgccacgaactggctctgcgtatccaccattgattccgagtagagctggtagtgccactaccaccaagctggcgcggaagcgggccaagatcagagacgagaacaccggggcgagcttagaagacctagagctcgcacaagatcgcggagagctagatctatacattgatggtcgcgctcacctcaagatgggatgggctcgatatttgggggctgtggcgacaaatgtggttgctgggggcaaatggtgcttaggaaatcggcttgaggctgaacggggcattctggccgagataccatttcgaagtcaatagtatttggacagccccacggtggtcgagacgtcgagcttgtacgggggctcgaaaggggggtctaagggagcagtgggagttgcccgaatcccttgaacgcccgaaggacacctagagccccttttgaatccctcccaagatgtgggccctctgttccctcgaaaatttggcccaaaagatccaccggaatggcactcggaacgcagaaaggaacgcaaactcggattacaacgggtccaacgactaccaggccccttccaaatgcggagtctgtggcattggcccttgggacagggaaaggccttagttaggggggatgggttttcatttctccttg

SEQ ID NO: 582875 - DNA, 814 bp, Homo sapiens
gagcggcttaacccctctgtagggaaagagggtccgccatgttccccgtgctggctgccgccgcttggctctggtagccgcctgccccatgaattacccatgtacgaagaaggaggaagacagagcaagagggcacaagccagtaagcaagaagggagcagacagacacaaagagaaagaacaacaccagcagacagcagagacagacaacaagagacacaacacagaatacacacgcagacaggagagaaaaaagagcccaaaaagaacgcagaaaagaccggcggaggcgaggcacagagcaccaagcaagcacaggccagcggagcctcctggaggcaaggacgacaacacgcgaacgggagagcagaagacaaagacacgagcgcgaccacagagtagacagagaaggacgcagagcgtagagatgcacaacacggcgcagagagacaaactgggcagaacaagagaggaaaagaaacgcgacacacggaggacaaacaagagaaaacgaaagagaagacaaaaagaagagcagaggacagagagcgacacaaaagaggagaaaacagacaacaagaagagaggagacgacaggaacagtaagcagggacgaaccaacaggatgagcaagagaaagcaagacgaacacagcgaacagaccaacacacaggaagcgcgatgagcgccagtgcgagatgaaaggagcagagtagaaacaagcgacaaggaaagaacaacaagaggaacaccagaagagcaaacaaaacggaaacacacaacccagcaaaaaagcagagcagccggaagaaac

SEQ ID NO: 582876 - DNA, 1104 bp, Homo sapiens
cggtgccctccttcgggtgctgtgatgggccagcgtttgatgctgttactcttcttcccgcgtctgtcctgatgtgagagcctgctgtgtccttccaggggtgtctgcgtgtgtgtccctcccctgcccccccgagtgtttttgttttgcccaccaatcctcgttttggggcccccctttggccccttgcccgtgtcccccccccctctgcttgcttgggaaacctcgtgggttctccccatgggctccacttttgccccgtgtgaacacaggctttccttaagtggagactattttgcctgtgcaacccctgatgtgtgtcaccttgagggtgcaccttttgccctgtttggcggctgcacaaccatgacctcggggggggaaatgggtttggccaacagctggtcccacaggacccggagtgtaggaatatgattaagggcccttgggagtcccacacccggtttcttgccacatgcccctggactttgggctttaatgggcacgaggaatgccctgttgctgggccacaggggtctcaaaggaagactggattggcacaaggctgtcaatgcccgtgttcctgccctttgccccaactccccggtgctgaggctgcatcacgacccctggtaaggaaggggttccgcacgcccgcttacggtatgtgctctccttcagccctcttcccttcggagggaacgtggttttgccccccgtccctttgcctccactgctgaaggtcggtgctgtatttcacgagggagggtccctttcacttctcctctgctttgtaatttaaaggactggggcactagcactgggggcacgtcccccacgagcctcttcagttccccctcctgtggtgagggctaaggtgtgatcacacacctttttttttccacttcccttcctgctttttttactggtgggggatccacccacggtcattctaggctctggccctatgttgaaaggggcacccccttttctctgtgcccaagaggagttcatcctgggaagaagggggccaaggtggaaatgcagattactcacatgcttaaagggacttgggtaggtaaattaaagctatacatggttgga

SEQ ID NO: 582877 - DNA, 238 bp, Homo sapiens
  misc_feature (52)..(52): n is a, c, g, or t
  misc_feature (123)..(123): n is a, c, g, or t
tctagcaggatcctcagacatgcggaccccatcgggttcaagttttggagancctacttcaccgtctctgggatcaggtcgatacatgaagatcattgagaaaagtggttaccaggccctccntgggttcgctacatcacccagagtggcgattaccaacttcgtaccagctagaagggagaagagatgggggtttgaactgtgtgactaccttatagacccggttgcagattttgcg

SEQ ID NO: 582878 - DNA, 124 bp, Homo sapiens
atatgtaacaggcacaatatatgtagaagaaaaatatttttacattaaacctttactaaaaatgtaaatagaaaaataatttggttttgtatcaagaacaacacttatcgttacatatgacggt

SEQ ID NO: 582879 - DNA, 294 bp, Homo sapiens
  misc_feature (292)..(293): n is a, c, g, or t
gcccccattccccccattctttccctcccaccttgggcataaaattacttttgggcccaaaaaattaaaaaaaattttgttgggacccttttttaaattttaaaaaaaattccccaaggggttaaaagaaaatacctttaaaatttttttaggtggttttttggccccccccttttttgtttggaaatttccaagggttgcccttccgggtttgggcccccggccaattccttaacccctgggtttttttcctttttttttttcccataaaaactttttttttggccctttnna

SEQ ID NO: 582880 - DNA, 106 bp, Homo sapiens
ctgtcgtcgcctcatgcttatacttctcaacgcttatacttctcaacgctttatacttctcacgctttataccttctcaacgctttatacttctcaacgctattat

SEQ ID NO: 582881 - DNA, 315 bp, Homo sapiens
tgtgcccggcgcactatatatagtatccgcaggggggagatgagagagagattataaccaagcatcatatagcaaggactaacccctataccttctgcatcatgaatgttaatctagaatataacttttgcaaggtagagcgaaatgcttatacccccgtaatccagacgagtctacctacagatactagcttagagcagcacacccagtctatgttgcgacaatagtgggaagatttatagtgtagaggcgacgaacctaccgagcctggtcatagctgggcgctcgtctaggagtgtccaagttcaactttaa

SEQ ID NO: 582882 - DNA, 510 bp, Homo sapiens
tactctaagaacaatccttcctggtgatagctattactcaaatgacaaaagctgggggaaataccttgtaaatatcagaaaaaaacttctcctcctaagtagtttaaaaatatgcagataggcgggcacagtggctcacacttgtaatcccaacactttgggaggccaaggcagacacatcactcgaggccaggagtccgagaccagcctggccaatgtggcaaaaccccatctctacaaaaaaacacaaaaattagctgggcgtaattccagctttttaggagggctggaggataagaatttgcttgagcccgggaggcagaggttgcaatgagctgagattggaccactgcactccagcctgggaaacagagcaagactcatttgtaggtgcttaataaatattttgttgaatgattgtttaacttaagtactcttccaaaatagttgtaaaaaaaaagttataattcaaactgtttgttttcttccaggatagttacgtttttgtac

SEQ ID NO: 582883 - DNA, 101 bp, Homo sapiens
ctccaccttactaccagacaacttagccaaaccataaccaaataaagtataggcgatagaattgaaacctggcgcatagatatagtaccgcaagaaaagtg

SEQ ID NO: 582884 - DNA, 887 bp, Homo sapiens
  misc_feature (33)..(33): n is a, c, g, or t
  misc_feature (69)..(69): n is a, c, g, or t
  misc_feature (71)..(71): n is a, c, g, or t
  misc_feature (86)..(86): n is a, c, g, or t
  misc_feature (97)..(97): n is a, c, g, or t
  misc_feature (103)..(103): n is a, c, g, or t
  misc_feature (112)..(112): n is a, c, g, or t
  misc_feature (126)..(126): n is a, c, g, or t
  misc_feature (152)..(152): n is a, c, g, or t
  misc_feature (162)..(162): n is a, c, g, or t
  misc_feature (166)..(166): n is a, c, g, or t
  misc_feature (174)..(174): n is a, c, g, or t
  misc_feature (200)..(200): n is a, c, g, or t
  misc_feature (211)..(211): n is a, c, g, or t
  misc_feature (213)..(213): n is a, c, g, or t
  misc_feature (217)..(217): n is a, c, g, or t
  misc_feature (220)..(220): n is a, c, g, or t
  misc_feature (223)..(223): n is a, c, g, or t
  misc_feature (229)..(229): n is a, c, g, or t
  misc_feature (233)..(233): n is a, c, g, or t
  misc_feature (304)..(304): n is a, c, g, or t
  misc_feature (316)..(316): n is a, c, g, or t
  misc_feature (336)..(336): n is a, c, g, or t
  misc_feature (345)..(346): n is a, c, g, or t
  misc_feature (362)..(362): n is a, c, g, or t
  misc_feature (369)..(369): n is a, c, g, or t
  misc_feature (410)..(410): n is a, c, g, or t
  misc_feature (418)..(418): n is a, c, g, or t
  misc_feature (423)..(423): n is a, c, g, or t
  misc_feature (431)..(431): n is a, c, g, or t
  misc_feature (441)..(441): n is a, c, g, or t
  misc_feature (446)..(446): n is a, c, g, or t
  misc_feature (455)..(455): n is a, c, g, or t
  misc_feature (460)..(460): n is a, c, g, or t
  misc_feature (467)..(467): n is a, c, g, or t
  misc_feature (469)..(471): n is a, c, g, or t
  misc_feature (476)..(476): n is a, c, g, or t
  misc_feature (480)..(480): n is a, c, g, or t
  misc_feature (496)..(496): n is a, c, g, or t
  misc_feature (520)..(520): n is a, c, g, or t
  misc_feature (583)..(583): n is a, c, g, or t
  misc_feature (585)..(585): n is a, c, g, or t
  misc_feature (602)..(602): n is a, c, g, or t
  misc_feature (618)..(618): n is a, c, g, or t
  misc_feature (641)..(641): n is a, c, g, or t
  misc_feature (645)..(645): n is a, c, g, or t
  misc_feature (657)..(657): n is a, c, g, or t
  misc_feature (664)..(664): n is a, c, g, or t
  misc_feature (670)..(670): n is a, c, g, or t
  misc_feature (676)..(676): n is a, c, g, or t
  misc_feature (681)..(681): n is a, c, g, or t
  misc_feature (704)..(704): n is a, c, g, or t
  misc_feature (716)..(716): n is a, c, g, or t
  misc_feature (719)..(719): n is a, c, g, or t
  misc_feature (722)..(722): n is a, c, g, or t
  misc_feature (725)..(725): n is a, c, g, or t
  misc_feature (739)..(739): n is a, c, g, or t
  misc_feature (750)..(750): n is a, c, g, or t
  misc_feature (766)..(766): n is a, c, g, or t
  misc_feature (783)..(783): n is a, c, g, or t
  misc_feature (866)..(866): n is a, c, g, or t
tttgtcagcagatcaatgttaataacaaatcangttttttttttaaaaaaaacagtgaacagtgttttntncaagcatattgactntttctttcttnaccttnaacattctnaacgtaaaattgtnaagaagattctcctgagttatctttnatgatatttntttnattttctncctcttcccaaaagaaaatttttttnaattttttttntnaatnctnttntctgtnatcngcgtttgatttaaaaatattaaaacccacagggcgtgacacagaatattttctcaataaattgtggctgancaaattaacgangcatccacagagccctcaanacattttannagggcagtcttagggngcaggcnggcgaaggggacaatagtctttgggggcgagcacataggcntttcctangggcnaacattcnacctttaatntctcnatttgccantcagntttcttngnnnttttncacnaatcttaatacaatcntttctttgggttgttttcgttatnttcagagagggaccccaaagaaaatatactgattgtgacataacaaaaaaaaatcaatgattntnggctttaacacagtttntaaccatagtgtcctnataagacataaataataatcttnaatnaatttagttatntacagtnccattnaatgtnagtgncaatgagatgtggaaaagaagtnttttcgtcattnttnttnttnctgagaactacttngatatcatttngttttgttttttaatnagaaagggcattaattngaatgggaacgtaactttttccagtcacaaaccccgtacagttctctcttgaggcactagcctctttgcatccatcttggttncagatagctaaaattagctat

SEQ ID NO: 582885 - DNA, 1265 bp, Homo sapiens
  misc_feature (584)..(584): n is a, c, g, or t
gtacagatctcccagtaatttttctatattcagcccataatctctttgaaggtttatactacaattcagcaatcccctcatcgttactccattcttctctaccatgcatttctcgttcttttactgggtctaaagggctatgccctccatcttcagagagcgttccaactacttctcttgcatacttctaaattcatacctatgagcaatatcatgcctagttcattcattgtctcaatataactgtcttagtacaccataaaactgggtggattataatacaatcatgaaatcttctcacgtctccttggaagagtctggcaaggtccaatggtcatacggcacgcaagcaagaatttggtcgtctggtgaggtgtcctcttcctcaacagggtgccttctctagctggtgtcctcactatgactggaaagggactagctgatccgctagtgggtggtctatctttgataaatgggctacttaatccctcattccattgagaagcgagacgcctcccatgtgcctcaattcacctttgccaaggaccccaaccttactattctaagagtacacatacacgctngcgtgacatacggtttccaacattagcgaaattgaagggtgatgcgacaactatcttggggaccaaacacgacatttgaatcccttgatcataaacctagaggtctctacttcgacgtccttttaatgcgatctaatcgcgtaccacttcttttggggcttggagcatccacacatactccgtggagatctgggtcatcaacgaagactcggcgtggggtgtcaatacaccctcggtccgcaattccggtcaaagaggattaccttatattacggcaacgttaaagccccctgaagaacgctacctacactctttcaacattacggaatgggccgagattagaacgcatttaatccctatcaggctgtccttgtcaccaaacccgagcattttatcttgcaattatacgcgccccaacgggaaacatcgggtccatcccccagtatggaggttccatgaaagctccgtctctcccccatttttgagcgtgaacgtgccataaccacacttcgttgccacggtgcgagtataaggaggacaaaaccaatgcggctacttaaatgactaggacccatttcggctacgaacggacacttcaatcccttctgataacattgagacgacgccaattttgggcgaataataattattaaacccgtgaggcaattgcacacacacagc

SEQ ID NO: 582886 - DNA, 929 bp, Homo sapiens
tgacagactataggcctcctcatatgcttagtactgttcaaatcttagattcagaatggcagcagtgtacgcggatgttaactactctttccaatggataatgggggcccgaccctagtctgcctagtggcatcctactataataatgtatcttattgataggatcatcatatgaactcactctatcaatgaagttcgtctgacacatggccgattgctttcatcacacataagccatgatacgagtatgaataggtttccagcatgtcggacagtagctgtgtgatagcccaatcataatttgattgactcgctccgtcagaccttatagtcatgagacattgtagcacgttgcagatagaacatgggagtctccatctgagacgcagtcccatggcaaggaataaggcggaaaagatagcatcgtcaaatgataaccgaaggacgtatgaatggcatttatcgacgcagattgctggaatagttcattttgccaaacacgagaagccctgccaacgtgggataagcagatccaatcacttggtttccaagtgaataacctttggagacaaattagtcgaacagcaccagaatggacaagcacgaagccatggaaggccaagaatggctcagagaatccgtcgcagaacttctgtgcgacgagtgaccatcatattatcccaatggtggtgccagatcaaggtttgacctattctccaataggcatttctgcatcattgaccctttaatacagtattccaactcaccctgttagaatgctgggcaaatcccggtcgtaccagacgccccatttatctcgcagccaggaagttacgccgcatctaagaatatggtaagttccccattatatatacagggggccccagggtatacagcggaaccagatgttctggaagggtttcttaaac

SEQ ID NO: 582887 - DNA, 261 bp, Homo sapiens
aaaagggggggggttttttttttcccctttttttttttccccaaaaaaaaaaaaaaaaggcccccttgggggggaaaccccccccccccccccgggggaacggggccgggggggggggttttttaattgggggtttttttttttttttttttaaacccgggggaaaagggcccccctttcccctttgggggaatcccccccttaacccccggggggggggggggggaattttttttttaaaaaaagttttttcccctttta

SEQ ID NO: 582888 - DNA, 144 bp, Homo sapiens
agcggggaacaatcactttctagcctagggagtcttaggagattcttgaaactagtcccttagttggggctgcgcttgtgctccaaatgctctctggcacctgcagtcttttcctgggttctggacagtcgcaggctccatttc

SEQ ID NO: 582889 - DNA, 1149 bp, Homo sapiens
  misc_feature (949)..(949): n is a, c, g, or t
  misc_feature (953)..(953): n is a, c, g, or t
  misc_feature (961)..(961): n is a, c, g, or t
  misc_feature (977)..(977): n is a, c, g, or t
  misc_feature (1011)..(1011): n is a, c, g, or t
  misc_feature (1035)..(1035): n is a, c, g, or t
  misc_feature (1039)..(1039): n is a, c, g, or t
  misc_feature (1044)..(1044): n is a, c, g, or t
  misc_feature (1048)..(1049): n is a, c, g, or t
  misc_feature (1051)..(1051): n is a, c, g, or t
  misc_feature (1057)..(1057): n is a, c, g, or t
  misc_feature (1066)..(1068): n is a, c, g, or t
  misc_feature (1072)..(1072): n is a, c, g, or t
  misc_feature (1077)..(1077): n is a, c, g, or t
  misc_feature (1124)..(1124): n is a, c, g, or t
atgcggattagcggccgcgggcggctggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccaggcgggncaanaggccaanggcgcaccgcggaaanaaacccaccccggagaggcccagcagacacggcnggcggggggaaaaaaggggggggngcangcacnagtnngncggacnggggggccnnngcanggggnacacaccccccacgccgcccgcccccccgggcgccgggaccgggccnggaggagcccccgcccccaaacggg

SEQ ID NO: 582890 - DNA, 230 bp, Homo sapiens
gatgttctgtctgtgacttgaatggaaacatcccaaagaagtttctgagaatgcttctgtctagattttacctgaagacaatcccgtttcccacgaaatcctcaaagctatgcaaatatcctcttgcagattctacaaaaagagtgattcaaaactgctccttcaaaacggtggttcaattctcttagttgagtacacacgtctcatataagtttctgagaatgaaccac

SEQ ID NO: 582891 - DNA, 764 bp, Homo sapiens
atgcggattagcggccgcgggcggctggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactctcgtgcagtctatccttccaccggagtcgccatgaggtcgactgggccaaaacattccacgctcgcaccggtgcgctcccaggaacgtgagacgtgcgtgtcgcatacgtctgctcaagataccactatccaatcgcgaggcggtgcacgacagtgcaccattgcgtagagtcgtgctaaagtccacgcagtccatgtcgccaacacgtggtacaacactgaagcatggaagcccttggttacgaaagaatcgacttgagcgtcttcgatgtgacaagggccgctcgatttgaatctgtgctcccagaaggatgcaagagattcttcagtcgacgattcgctccgctaggtgccgggtccagattgctacaacattttgaagacaaccttgaaaccattggatgtgcccagatcccccagtgccaatgtaaccctg

SEQ ID NO: 582892 - DNA, 163 bp, Homo sapiens
atgcggattagcggccgcgggcggctggcggcagcggttggaggttgtaggaccggcgaggaataggaatcatggcggctgcgctgttcgtgctgctgggattcgcgcgcccacaacccacgcgcccacgcgccccaaccggggagtccgtctagaggcgacc

SEQ ID NO: 582893 - DNA, 1628 bp, Homo sapiens
  misc_feature (1591)..(1591): n is a, c, g, or t
  misc_feature (1599)..(1601): n is a, c, g, or t
  misc_feature (1603)..(1604): n is a, c, g, or t
atgcggattagcggccgcgggcggctggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgcctgcggccccgtctgtgctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccaccnaccgccannntnnagatcgcccccacctccaccctca

SEQ ID NO: 582894 - DNA, 723 bp, Homo sapiens
ctggagggatctttctcttctcccctcccttcttaggatcccgggatccttgatttcttcctgggggcctctctcgaaggatgagctttttaagattatctcctgtcccggaatcagtacccctgccggcccagcgccacccaggttccagcgccatttgttgctatccgggactaccatgtccccctccggtcttgggtggttaagtgctcccaggaggtggcccccccccttccgtggggcccatcatcctggcccagctcttcccatctgtccccctgccccagaggctactgggggcaccagatcggccagcccccccctgtccccttgccaggtgacccggccccttcggctctgtgctggtacgcctcattcctgcacccacggggcactggcactcgtctccgcaccctgtgccttagagagctgctcactgatggctggtatcgagtgactgctacaccctcagcccggggctgccctgcccaccctgggccacttcgcccaggccccctttgatgccctttttatagacctacacagctacctgagcccccgagccttctggaaggagactgtattcccccagtctccctatcaggagttccctgaccccctcgtccagacccccccccgagtttccctgcagcggactccggctcccactgtggctaccacctagggtttttataccagaaaaattaagtgaattaagcgtga

SEQ ID NO: 582895 - DNA, 324 bp, Homo sapiens
gcgtcgaccaacgctctaatcccggccttggctttcaagtgaccaacccccatcctgaagctggccagggactgccagccatcaatcaatcattagcatgcaaaaagacatactttggagactccaaggattttaggaattctatggcagaaaatggagatgaacaccaaatagaaggccgggcacagtggcaggcgcctgtaatcccagctactcaggaggctgaggcaagagaatcacttgaacccaggaggcggaggttgcagtgagccgagatggcgccactgcattccagcctgggcaacaagaacgaaattccgtctc

SEQ ID NO: 582896 - DNA, 1677 bp, Homo sapiens
  misc_feature (1640)..(1640): n is a, c, g, or t
  misc_feature (1648)..(1650): n is a, c, g, or t
  misc_feature (1652)..(1653): n is a, c, g, or t
atgcggattagcggccgcgggcggctggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgcctgcggccccgtctgtgctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgggggggggggggggggagaggggggggggggggggggggggggggggggtgcatccgggggcagctctggagggggtttgctggggaactggcgccatcgccgggactccagaaccgcagaagcctccccagctcacccctggaggacggccggctctctatagcaccagggctcacgtgggaacccccctcccaccnaccgccannntnnagatcgcccccacctccaccctca

SEQ ID NO: 582897 - DNA, 560 bp, Homo sapiens
  misc_feature (16)..(17): n is a, c, g, or t
  misc_feature (68)..(68): n is a, c, g, or t
  misc_feature (350)..(350): n is a, c, g, or t
gtgacggcggcgtggnncgagccagttccgtggtcgtcaacttcagcgatgcgcagacggcggaagancccgcaaggtgctcgccgcgtcggtcaccgaactgcaatgggcgacccagcccggcggcggcggcacgaggttcgtcggtacgttcacgccggccgtgcagaaatccgtcgaggacgccgcgctcaagcagaacctgacgacgctccacaaccgcgtgaacgaactcggcgtgtccgagccgatccttgcagcagcaaggcagcgaccgcatcgtcgtcgaacttccgggcgtgcaggacaccgcgaaggcgaaggacatcatcggccgtaccgcgacgctngaggcccgcctcgccgatccgatcaacacgcacccgaacccgaacgaccccgttccgccgggcgaggagctgttcacgcagggcatccaggcgcccgtgctgctgaagaaggacgtgatcttcaccggcgaccgatcatcgatgcatcggccggcttcgacgaacaccagcgtccgtcggtcaacatccgcctcgaaccgcggcggcccc

SEQ ID NO: 582898 - DNA, 298 bp, Homo sapiens
  misc_feature (85)..(85): n is a, c, g, or t
ccatcaactgttcacgttgctcggtgtcctgggccatcagctccagggcttcttgcagcagcaggcgtgattcgcccagctgctnatgctccagggcacgctgctcttccagctcagccaattcttcctgcaggcgccggcggcgcaattcgacctgctcggcgcgggcacggctggccgacaggctggcattgagttcgccatgcaggcggttttcttcctggctgcggcggcgcagctgttcgcgctgctcttccaggcccagctgctgctcgcgcagggtttggggtaccgagct

SEQ ID NO: 582899 - DNA, 295 bp, Homo sapiens
agaaacccaggcttcagcccacctcctaatgtgactgcttcccccagcatggcatggacttattggcagagacccacaaatgcgatcgaagctcctccgcaacaagtttccatatcaaccaaattatggaactgggacaacaaccatatccagcctttggtccagtgtctagtcctcccaatgcaatgatgtcgtcaagaatgggtccctcccagaatcccatgtatgcatgacccgcaggctgcatccatctatcattcctcagaaatgaatggctggccatcacgtactttgg

SEQ ID NO: 582900 - DNA, 1685 bp, Homo sapiens
  misc_feature (1280)..(1283): n is a, c, g, or t
  misc_feature (1287)..(1287): n is a, c, g, or t
  misc_feature (1289)..(1289): n is a, c, g, or t
  misc_feature (1292)..(1292): n is a, c, g, or t
  misc_feature (1297)..(1297): n is a, c, g, or t
  misc_feature (1303)..(1303): n is a, c, g, or t
  misc_feature (1306)..(1306): n is a, c, g, or t
  misc_feature (1308)..(1308): n is a, c, g, or t
  misc_feature (1310)..(1310): n is a, c, g, or t
  misc_feature (1318)..(1318): n is a, c, g, or t
  misc_feature (1648)..(1648): n is a, c, g, or t
  misc_feature (1656)..(1658): n is a, c, g, or t
  misc_feature (1660)..(1661): n is a, c, g, or t
atgcggattagcggccgcgggcggctggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgcctgcggccccgtctgtgctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcnnnntttntntgnttttntgtttnttntntntttgtttnttttgtttttttttttttgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccaccnaccgccannntnnagatcgcccccacctccaccctca

SEQ ID NO: 582901 - DNA, 1626 bp, Homo sapiens
  misc_feature (1099)..(1099): n is a, c, g, or t
  misc_feature (1217)..(1217): n is a, c, g, or t
  misc_feature (1274)..(1274): n is a, c, g, or t
  misc_feature (1589)..(1589): n is a, c, g, or t
  misc_feature (1597)..(1599): n is a, c, g, or t
  misc_feature (1601)..(1602): n is a, c, g, or t
atgcggattagcggccgcgggcggctggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttcccacccttcccttttctccattcacccttctcttccttccctttttttccttctccactctttcccgccccccccgnccctcctccctccccccccctctctcctttccccctctggctctccctcctcccccgctgggcccccccccctctcccctcccccgcctccctcccccctccttcccctttctggccnctcccccctcccccccggccccccctctcctccctctctcccccccctgctctctgnttcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccaccnaccgccannntnnagatcgcccccacctccaccctca

SEQ ID NO: 582902 - DNA, 944 bp, Homo sapiens
gctccagcctagcccctagcccccaattaggagggcaccgtgggccgcaaaggcagtcagcccgctaaatcccactagaagtcccatcctaaacacatccgtattactgccgcatcaggagtatcaatcacctgagctcacgcatagtctaatagaaaacaacgaaacaaataattcaagcactgcttattacacgtgtttactgggtctctatgtagaccctcctacaagcctcagagtacttcgagtctcccttcaccatttccgacggcatctacggtcaacatttgtagtagccacaggcttccagggacttcacgtcattatggctcaactttcctcactatctgcttcatccgccaagtaatatcatcactttagcatccaaacatcactttggcttcgaagccgacgcctgatactggcattttgtagatgtggcttgactatatactgtatgtctccatctattgatgagggtcttacccgcacacccaccccacccccacaacacaccgcaccacacaatggatacagaaaacgccgaaaaacccacggaccacactcaacccccgcaggcccacaacaccccgagcgcaacccgccacgcacacactccccgctccaacacccacacaaggttcaagaacggcaccgggggacgaaccacgactacacaccagaacccgcaaccccggcagctcgctaaaccaccgacacaagcccacagccaacaacgcacatgaaggaaccaacacgagcaagatcacgcatcaacaaacgaacacactaaccacagaacaccgcagccgtaccgccagccccgcgatacaaccccacacaaacacccacccagcgcccagacccgacaaccgcagacacagaccgacacacgcaagtgcagcacaaacagcacacgacaacccaccccaggacacacaaca

SEQ ID NO: 582903 - DNA, 638 bp, Homo sapiens
aggctgagaaagggccatatgagtgaagagtctaacgcagcctgagaaccaaactgaacgaagacctgtttgatccattcatagtgccaacaatactaggcgtacactcagctgcactgcacatactatgaacagctatattgatcctcaccttcaaatagcgcatgaagaacctaataattaacagggaataatgactaagcaaactaacctgaaagcagatgatgaccgtacacaacattaaaggacgaaccagagtgcttatactaatatccttgatcattaccattgacacatataagctcttgggactcgttgctcactcattgacactaaccacctaactagtgatcaacctagtcatggtgatcagcttatgatcgggcgcagtgatcataggctgatgctctaagatgttactagagattattgaaaccatcagcctactcatataaccaatagacctgaccgtacgcataaccgttaacattactgtgagggagatactgatgcacctaatcggaagcgccagactagcatgtcaatgcattacacttcctctacacttatagggtcacagtaggaatactactactatcatagaaatcgtttagacttaatccaagctacagtgtacc

SEQ ID NO: 582904 - DNA, 1515 bp, Homo sapiens
  misc_feature (1478)..(1478): n is a, c, g, or t
  misc_feature (1486)..(1488): n is a, c, g, or t
  misc_feature (1490)..(1491): n is a, c, g, or t
atgcggattagcggccgcgggcggctggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgacccaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgcctgcggccccgtctgtgctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccaccnaccgccannntnnagatcgcccccacctccaccctca

SEQ ID NO: 582905 - DNA, 354 bp, Homo sapiens
aagtgtaggagatcaattgtagtacttttcgaaaagaaaaggttgtcgaacccacgaggagcagaaggaattagcgtgaagaaagcaaaggaacaataaaagtaaaagtgtgtagtgcgtgatttttgtggtgattgcgagtaaagtaaagtgcggaaagtaaattgcagcaagtaaaatatctcaaagagagacaagagcccaatcctctatatgcaagaggacaagctcgcaagtgtgtgtgtgtgaacaatgagagaaaaacgttcccgagggctacatggatttaggtggcatgatgattcattacataacatgttcgtgtatcttgtctaatttaattcctcttcggac

SEQ ID NO: 582906 - DNA, 1106 bp, Homo sapiens
gccccacaaataccactacatcgacgacctggtggtcatcctggcccagaacgtctgggagcacctgtacaacagattcgggggtgtgcccctgccgtgaaccacctgtactgtgtgctccatctgccaggtgtgagatctgaggcactgtgtcaatgctgcaggaggatcgagatctgacactcttcatacaagttgaacaacggcctatccaggccgagtgagtcgcacgtggcgtcatactactgcatcagcaatgcaagtggttccggtgagttgggaggctgttctgtcacggggaaggacaaccgagccccccgggcccattgacaacagcaggatcgcacaggtcaaccggcagcggacatgtccagactgaagcagggagctgactacagggcagataatcggaggagacctggaacatacctgaaacagcactgtactggaggtggccccgagaattgccatccgccagcagtgcaggcagcagaccgatgggcccaagagaacctgcaacggggaagccgaacgatcgcacaccgtgacgctgtagccgtcggtgatctggctagggcatagttctagcaggctccctgcaaagaacacttcctggcaggatgtggactgcacctgcgacatgccactggaacccacttgctgaactgccagattaaccaacaagaaccgatggtgccccccacccaccggcgcctactagcgcatttttgatgccacacatagctacactccatgatacagctagacatatacaccccaccgacgctatggaaggtgacatgcattgactatcactgcctacttacgacctgctcaaccatccctatccttccccacgtccccgccgccaacgaacccaagacaaatctggaacaaatacctccgactaagtcgcccatgcacgcgcctagagtgatgcagcattccacacgcatgaccactcacacatcgcagccaactatccaactcaccaagcccggacgccggcagtcaaaccctcctcccgccacagtcgcagaccgcggctagtctcggtccacccgagcagcccgccgaaccactagcactacaccaccgtgaactgc

SEQ ID NO: 582907 - DNA, 887 bp, Homo sapiens
gtctcatgttgcccaggcttgcctcaaactcctgggctcaagcaatctcctgcctcagcctcccaaagtgtttttctttttgagatggagtcttgctgtgtcacccaggctagagtacagttgtgcaatctcagctcactgcagcctctgatcccgggttcaagcgattctcctgcctcagcctcctgagtagatgggattacagatgcccaccaccgcgcccggctaatttttatatttttaatagtgacgggatttcaccatattggccaggctggtcttgaactcctgacctcatgatccacctgcctcagcctcccaaagtgctgggattacaggctgtgagccaccgtgcctggctaagcctagctaatttttcaaattatatttatttatttatttatctttgagacagagtcgcccaggctggagtgcagtggcacagtcttggctcactgcagcctccacccctggggttcaagtgattctcctgtctcagcctttctgttagctgggattacaggtgcccgccactgtgcctggctaatttttagtagagatggggtttcaccatgttggccaggctggtctcaccacgcctggccttatttatttatttatatttttaaacatttatttatttattttcgtgtgacagagtctcactctgtagcccaagctaaagtgcagtggcatcatcttggctcactgcaacttctgactcctgggctcgtgattctcatgcctcagcctcctgagtagctgggattataggcgcatgcaccaagccccagtatttcggatcatacgtagaggtgtggttcaccatgtgggccaggtggtgtaaactctatcaactcaggtcatccaaccacctcaactcccag

SEQ ID NO: 582908 - DNA, 138 bp, Homo sapiens
gctggccagaagggtacaagagccggtactctttatctcatggagtcgtatcaacgctatgaacgcaaggcggtgatatggaaccagaaggctgtctgaacttttgaaaccttggtgtggagattgactggtggtgcc

SEQ ID NO: 582909 - DNA, 735 bp, Homo sapiens
acaaaaaagaaatacgaccgaaaagtcgtgttatcggacaggcggggcgcatgtatgcccgaagtatgccccctgcctggcagacctttctcaaggaccaccgcatctactacatacaagaagcgggccctatcttggagggctgcgcctgcaccccggagcggatggacgaggctggctatcatccactgccccactgagaacgagccagactatggcccagtgtttcttctgcttcaaggagctggaaggctgggagccagatgacgaccccatagaggaacataaaaagcattcgtccggttgcgctttcctttctgtcaagaagcagtttgcacagaatataaccctatggtgcaattattatgcgaactagggacagcagcaccagcagcccacgcacacaaaatttgcacaaggcaaaccaaccaatcaagcacagcacacagcactcttgcaggcaaactagcgcaagcaaagtaggcgccgtgcccatcagcagcagctggctagccatggattgaggcctctggccggagctgcctgtgtcccagagtggctgcaccactatccagggtttatatccctggtgccaccagccttcccgtgggaccccttagcaatgtctataggaaaggagatcaacacttttcaaattagatgtttccaactgtgactctatgtatagtcttgaaagtggacaccagaggtgctatctgctgttgcagcggggtg

SEQ ID NO: 582910 - DNA, 130 bp, Homo sapiens
tgtgggtacagtcagagtcatagataataactgtgtcagcagtggacagattgatttcgaggcccccagctcaagtggaaagcaagaagcagaacttgtgagcaaccggtgcattgaaccggatagcttg

SEQ ID NO: 582911 - DNA, 907 bp, Homo sapiens
ggtggctgggcaacagtggctcatgtctgtaatcccaataatttgaaaggccgaggagggcggatcacctgaggtcaagagttcgagaccagcctgccaacatagtgaaaccccgtctctactaaaaatacaaaaattagctgggtgtggtgtgcatggctgtaatcccagctactcgggaggctgatctggggtaaatactttttatctcctgggttggggatgggatgtgtccttatcattttctaagttccatgagtgtgtgacccttagtattgcctaatttatcgctcttacagactttcttgatgtagggcatttaatggtattgaacttttccttcttagcagtgtttttggcgtaatcccaagaaggtctttgataagggttgtgtcgtcaactatctaagtgtcacagttacaaaggaatttttacaatttcccaattttgatttcatgtgttgaccacaatgatcattcaagagcaggttatttaattctatatatttgatggatcgagggttctttgagttgattccaattttattccatgtggtctgagagaacatggatacgatttcaatttcttaaattaatggtcttgttgtgtgggctatccatattctatctgggagaatgttcaatgtgtggtgatagaaggtaggacatcaagttgtacaagattgaaggtaattttagtgaatagtgcttaatacacacgtaaacttggatcagtgcttttgggaataagctggattcggatactaagagagaagaccgatcagatggtggttacccggagagacaaaaaaaaaaaatgtggggcggaagtaaattgtggggagaaagaatgtcaagaggagtgtcaaacgggcgcacatgttcttacctgcggtcagtgtctacaa

SEQ ID NO: 582912 - DNA, 102 bp, Homo sapiens
gggtggtattggcgatcacgagttgccatttaggggacagcattaggtacagccctttaggtaacagccatttaggtaccagccatttaggtaacagccatt

SEQ ID NO: 582913 - DNA, 303 bp, Homo sapiens
aaaccaaaccccccccaaaaaaaactgtttaaaccccccccctgttccccccccttttgggcccccagggtctggggggattttaggggtttccccccccccccccccccccgggttcttcagggcccccctttttttttggtttggggttgggggggggttgggggcccccttttcccccccccggggccggggggccctaagggccccccccggccaaaaaaacccccactgggccccccccccgggtttccccccccccttttcccaaaccccctttttttttaaattttatttttttta

SEQ ID NO: 582914 - DNA, 462 bp, Homo sapiens
gaccacctcatcctgcccggctagagcagcgatgtgcagggccgtgttccccttttggttgtcgtttctagaatgatttctttgtgcagaagttcaaccaccattttcacatggccttccttagaagccagatgcaagccattcaacccattctgtaaagagcagagaggcgggaagggcatggttagtcaaatggtgctttctgcacgtcccagtgggggcccaggccccttcccagccctgaggtgttcacagcactggagaaaaggagtggagtgtgtctagaggttggaaggggcacagggcagggccacccagcctccccttcacgcctcaggtcacaacagagcagagatggaaaggaagggcaagaactagcccgccactcccagatgtgaattaggcagtaagctctcacaacacccatggtgaccttgaaattcatgtcgaggccaggcttta

SEQ ID NO: 582915 - DNA, 421 bp, Homo sapiens
gctcgacggactttaaactgtactgctatgtagttagagattaagttgttgatacggtttggctgtgtcctcccaaatctcatcttgaattgtagttcctataatccccacctgtcatggaaaggacccagtgggaggtaattgaatcatgggggtggcttcccccatgctattctcgtgacagtaagttctcacaaggtgtgatggttttataaggggcttccccttttgcttggttctcattctctctcctgccaccatgtgaagaaggatgtgttcacttccccttccaacaaggactgtaaggttccctgaggcctccccagctgtgtggaactgtgagtcaattaaacctcttttctttataaattacctggtctcgggcatttcttcatagcaacatggtaatacaggtcgacgc

SEQ ID NO: 582916 - DNA, 204 bp, Homo sapiens
gtttccttttaaaaaatggaattgttccttggtgggggaagaatgttgtaatttttacttattaaaggccccttgttaagttttttaggttttcctggtgggttttcttgttggtttcctgctagcagggccaaaattgttaaattttttggtttaaaatttgggggcctttttgtcctttttggaatggggtgcttttaccca

SEQ ID NO: 582917 - DNA, 335 bp, Homo sapiens
aatgcaccttggcctccacctgtgggtgcttcatgccacgcaagaagcctatagcgcagggtggtccccaagtagacctccgtgttggggttcttctcctcctctggcatgcgattgagaaagaagccaatagagtcccgtgggaaattgggatccagcgtacgctggttgtgctccaccttctgtggctatgaagtcctccagcccttacagcacttgaaaggcctgttcctgtgtgtcctggcagtgtgtttcatcaccgaagagaccctctcatagagctgccccgtagaggttcacgtgatctgaaagactccgagcctcatgcgccacag

SEQ ID NO: 582918 - DNA, 323 bp, Homo sapiens
  misc_feature (2)..(2): n is a, c, g, or t
  misc_feature (16)..(16): n is a, c, g, or t
  misc_feature (180)..(180): n is a, c, g, or t
  misc_feature (213)..(213): n is a, c, g, or t
  misc_feature (220)..(220): n is a, c, g, or t
  misc_feature (246)..(246): n is a, c, g, or t
  misc_feature (279)..(279): n is a, c, g, or t
  misc_feature (297)..(297): n is a, c, g, or t
  misc_feature (321)..(321): n is a, c, g, or t
tnaaagcatttcctcntgaatattttattcagaaaaaaaaacacaaaaagataagacagaaacaaaaatcccagtcatctgcagtatctgtcggttttcaatttggttctcttttttaaataaagaaaaatagtaaaattaatctatgtaaaacatgccatatatattcaacgtgctacntaaatataaaaagctttaaaacctgtgtgttcnattttgngttattgtattaccacaacacttatnttaaaacatgtatacttttaaattgggtttccntaaaaaaatggattctantcttataaaacgttatttcctaanta

SEQ ID NO: 582919 - DNA, 1478 bp, Homo sapiens
tttgtgaccccagtgctgcggccgcaaggtgcgcagtagtggtgctggtgcctggggcaccagtcgggttttggtttttgctcctgccctggcctgatgctgcatgtggacctgcactggtgccctgggtctcccgcctgcagagtgagcctgctggccctgtggcctgtgggtgatgcctgtgcgctgaccacctgcgctgctgtcccctgcatgtgcagcctggcctgcctgccatgtgcctgaccaccttgatgctcgcctgagtggctacctgcctggtgcagatggcctgcctgtcctgcctgctgtgcctgcccatgtgccctcatgctgctccgtgactctgcctgcctgtactgctggtgccctgtgtgccttgtgacatgttggtgcttgatgtgcctgctggtggtgtgctccgcctgtgtggcctgcctgcctgcccctggcaaccctgtgtggcccttggctgtactggtggcccttcggtgcctgccttgtcctcctttccatgcacctttctctggcctgttgcccttctctgcctgtgcctgctgtggtgcgatcgctgcacccttgccagcgctttgttgtgctgaccgcatgtacaccctgggcccgctgctgggcctggtggcccacccaactgctcctgcggggaagggccccccccctgtggggcccccgcaatgaccatcgatggcacaaaatagctgccgagcaacgcccccagcccggccaggacccggctagacacacgccccttgagggccgcggcacttggcaccggcctagaaacctccagtcctgaaccgaacggcgaaggcgaggccttgaccacggttcacgacattgagaacgcgcctttgggcaacagcactccatgtgcgcgcttgagcagcccctagcgtgattctgccagcccagagcacaatatgcacaccagagaacgctacctttccccattagtctgacccaacagcacaagcccagaaggttccagaaccaattgcgcttaccaatccagcaaagcctatcggagagcgcgtccgacgcagccacggccccagcaccagggcacatcaccagtcgcagcgcctgtgccttaaatcgggctcacagaggagccagggcagccacctgacaccgagctagccaagtcccagagcacagcaagagcgcgtcacacaggggagccccggacaagtcgttcctctcggcacgagacaacaccactgcaaccccaggccgaccctgggccccgcagagccggcagcacactccagagcgaagtggtaagaaaacacgcagccagcaagtgaaaacgccaagggcgccagcgagaacactcgaaccgtgagcaaccccaggtgcggcaacctacgacgcatagaagccacagagtacgaacagcagcagagagtggcaaaaaccacagcatgcccagcagcgcccgcgcgagccagcggagacat

SEQ ID NO: 582920 - DNA, 712 bp, Homo sapiens
gcaggagggctggcaccgagctcgctcagatgactacttgagcctgggccacccgttctggcgaggcactggggccagggcactggtgtcaccccgctttgagcggtgtggctgggcttcccagcgttcgtctgcccgcacccccgctgccaatcgggacctgccagggcccaggcccaccccgttggcctgcagggctggatgacctcgggtacgatctggctaccgggagctacgagccatcattccagcgccggtagcggcctcctccatgctgctctccttccgtgactcgaccctttgggggggcttgcgttaccctttcgaacccttggcccagtccccttgccgtccatttcccacccagagggcctccgggctcaccaaggggttgtgcgggccggtacacccctaggtctcccggggcccgtgagatgccgataccgtgccggaagaaaaccgctggccactgacggtgggtcctatgaagcggcacgaaaagcacgccccgagcggggccgcaaagcgttcatggcttgagccccccgcgagaggaaacagcgcatgacccgccttgcgattaccgtggcgaccgagggtccccaagaagcaaaagcgccagatgggcagaagtgggaacgccctgcgacagggagaacggggggacccatgtggccccaccacagagagaactcacgagggtaaccacaac

SEQ ID NO: 582921 - DNA, 835 bp, Homo sapiens
tgtgtttgtcctccgcccttgggcgtcccccccttcccggccgcttatttgccccccggggcttttaacatgtccgccccgttcttatatctggccggcccctgttataccgtccccgcatcctgggttggctccgcccttcccatcgccgacagagtcccgtgtggcgtatcgcaccccaagctgtcttgtcgccactctcgtttatcaccctgggggtcctcatacaccgttgttgccgaggatgcgagaaaatctttggggcccccaggaggcgcccccctttgggccacctcatgtcccccccacgccgtctcccctgctcccccctcccacccggggtgctgtggccccccctccgcgtggttatttacgaggcttcccccccaaagtcgacccgtttgctgtacagtagagcagcaccgggaacccctcgttcaccggtgcttctgcgagggcctccatcccctatgcgcgatgaacttccggggctggtcttcccgccaccaagccagatgtccgcccccctgacttcttccttgtgcgcggtgtcacccgctgacaagcaccttctgtgcccacgatctgtgctcccgctgcagggcacaaaaaaagtgctgttcttccacacaggccgacgcagccgctgagactctctctcccccgcagtaagggtcctcccccctcgccccggcactgtggcaaaacaagcagacgaccccaatattatggcggccccccacgacacccgaggtgaacaaggcgctccccgaggcaaaacatgcgaacatcgtgttcagattccaaaaactagggccgggtaaaaccccatgac

SEQ ID NO: 582922 - DNA, 318 bp, Homo sapiens
cgcacatgcacagaatggtgattgtgaagctcttgcccggcagagtgtctcgagtgtacctgcagtgcgccgtatagctggacatgatccactctcgcatgtgcgcagtggcgcagactgacgggtactgcttcattgagcaaggcaccatcaatgctctgggtgaggtctatcggaccgcacgagaagcggagctagcgtgttcgagaactgacggacatggatcctagtgatctgccatatatagagtgagacatgttgattacgagagtgtaggctatggactcatggggaccgattgagctgactgatggtact

SEQ ID NO: 582923 - DNA, 185 bp, Homo sapiens
  misc_feature (19)..(19): n is a, c, g, or t
ccccccctttcaggggtanaaaaaggaacccccccccccatttcccccccctcaaacccacccccaaggttgtcaactttggatttctggggcccggccccctggaggggatacttaggggtttttaggttttttttttaaaaaataaaaactaggggggttttatgccctttttactttggcca

SEQ ID NO: 582924 - DNA, 129 bp, Homo sapiens
tacaggtgtcgagactatgcctggtaactttttcgatttttagtggcaggtttcaccatgttggcaggctggtcttgaactcctgacctcaaatgatccactcaccttggcctcccaaagtgatgggat

SEQ ID NO: 582925 - DNA, 130 bp, Homo sapiens
atatatttttctttaaaaagtcaagggttctctattgtgagtacattacatgtacatttgtgttgtgtgatgataagatgtaatgactgtttcattgtccatcacacaatatagaacccttgacttttta

SEQ ID NO: 582926 - DNA, 111 bp, Homo sapiens
aatggcttagcgggaggtcttggtggttttgtattcatttcacttgttgccccaggctccggtgtactcgtgcagccatcgacagtgacgctgtcccaacggtgaccggcg

SEQ ID NO: 582927 - DNA, 786 bp, Homo sapiens
  misc_feature (409)..(409): n is a, c, g, or t
ggaggaggaggaggagaaggctctgggctcctctgcaaaaataacaataaaaaaatcacatcaacacattttacacaacaataataaaaattcactatatacacatataagcgaaataacaaaggaagtctcagttcacaaaaacaaacaaacaaaaaacaaaacaaaaaaaacaattttgggggggcgcggcgcctcgcgcgcccccgagagagaaggttttcaaacccccactgggtggggggcggcgccggcggcgcccccagacgaattacaacggtcaacacacctattgtgacaacaaaagagcgatgtgggcgcaccaaaaaagagaaagaaccccgcgagggccaagagacacaaatagggggggaagggtgatattctccacacccaaggaaatacaganaacagccgccgcggggggcggaaaaaacccagaggagcgagcttccggacgacacacaacaccccaaacaagaaagggcgggactataccagggagaagggagcacaataaaccaagggggggcgaactacaatacaaacaacacaacggggggaggtctcccaaccaagcgaggaaaggacggccgagcggagtaaacaacaaaagattacagaccgaccccaccagcggcgtgttggtgagaagaacaacagacgaacggcaaacaacacgaatgaccagatcgcagcacaccaagcacacaaaccaatcaaagacagcacagcagagcagagcagcacaaagaatgaacatacacgcaacaacgacaaagagcg

SEQ ID NO: 582928 - DNA, 205 bp, Homo sapiens
cgataactatgctgtccacaggatcacgccacctctcttcctgataccgacgcttcctcagtgtacacaaggaccacgccacctcatcttcctgattcaccgagtactttcctcagtcatccacaaggatcaggacacctcctcttccttgtcaccgagccatttccttcagttatccagcaggatgacgaccacgttccatctg

SEQ ID NO: 582929 - DNA, 107 bp, Homo sapiens
actcactgagtccgtgctactttgtgtcttttagtagaggtttcaccatgttggccaagctggatctggagagctcctgacctcaatgcgatccacccatctatggc

SEQ ID NO: 582930 - DNA, 639 bp, Homo sapiens
gtgagtcgtcggggtttcctgcttcaacatgtgcttgtgactgtgaaccctgtgctgctctgttcacccacccctgtgcctggcctgcccatagccatgccctcctgtcacctcttcacctgcaccctcgtgactgccccaaggccccctgcctgccgctccagcgccgcgcatgccacctgactgctgcctgccgcctctccttatgtcgccgccatgacagacctgcgtccacctcgcagtgtgcgccagaactaccaccagtgactcagatggcctgcatcaacccgccataatcaacctggagctctacgcctcctacgctttacctgtccatgtcttactacttcgaccgcgcatgactgtgcgcctttgaacgaacttctgccacatacctttcttcaccaactctccatgaggagagggaacatgctgaccacctgatgaagctgcagaaccaacgaggtggccgaatcttccttcaggatatcacgcacaccagactgtgatgactgggagagcgggctgaatgccatggagctgtgcattacatctggcaacacaatgtgaatcagtcactactggaactgcgcaaactgcccacctgcacaccacctgaccccccacttcgctgtccac

SEQ ID NO: 582931 - DNA, 143 bp, Homo sapiens
acgcactgtgcagcctccttgtcgctgtgcgacgcttgttgaaggacaggctgaggaggtgtatcgtctgtactcagaactcgcccctctcctcccaccccgtggtgcccctgtcagagctcagcaccctctgtgctaactcc

SEQ ID NO: 582932 - DNA, 379 bp, Homo sapiens
  misc_feature (356)..(356): n is a, c, g, or t
cctgaacttcataggaaagtatcgtcttactggtgttcaccgaagaaaggatctcgccggtactcacattgacgacgcgcaggttcacggcaatctgatcgagctggtattgcgtgtcggcaccgatgccaaaatatcttgccccaaccccgccagatttgacgttgctttcataaccgataatcgaaccttcaaccatgatatttgccgccgttaaagattgcagcgggattcggttattaatggcaaccgtgccgttttcttgtgccgcacgaataatcttgcgctcgttaagcaggttttgtaagccctggcgctccagcggtataaaccagcgagaatctttcagtgccgtnaccagcattgccgtggcgctttg

SEQ ID NO: 582933 - DNA, 325 bp, Homo sapiens
taaattcgcggccgcgtcgacccttgggcaaaaaagttttaggccaggcatggtgactcacacctgtaatcccaggactttgggaggccaaggtgggagggatcgcatgggcccaggagttcaagaccagcctgggcaacacgggatgatctcatctctacaaaaaataaacaaaatcaaccgggtgtggtgacatgtagctgtagtctcagctactccagaggctacggtgggaggatctcttgagaccaggagattgaggctgcagtgagccatgattgcaccactgcactccagcctgagtgacagagcaagaccctgtctc

SEQ ID NO: 582934 - DNA, 138 bp, Homo sapiens
  misc_feature (48)..(48): n is a, c, g, or t
ataaccagcttgtggatgttgaggaaaaacgcagacaggttactccantaagctgtagtatatataaattggagtagtccaaagaaatactttaagagtcttcgtgagaaaccgcaggctgttgagagccacctatgg

SEQ ID NO: 582935 - DNA, 775 bp, Homo sapiens
  misc_feature (161)..(161): n is a, c, g, or t
gctgaagcatcctggtgtcgacatggagcgtcgccccgcgccgttgttatcggtattgtaaagaagcaagccgtagccaaagtctcgcttctgccgaggtgtccctgatgccacagattcgcatttcatgaatctggtggccggagacagagggcgacatncgtgtggtatgcaggtattcctgccgttgtgttgcgcgccatcaatggcatgtcatgcagtgaagtagtgcagtgcagcctgctgcctgctgcacaggccctggcgaggatggcccggaagtgttggtggccaaagtaagttagcaattgggtatacaaaaagtttgatggcaaagagattcgagctttccaatatccgagaggttagccggctctcgacccctctttccactgttcactcgcagctagtcgagacaacgagtagtagtcgcatgatgctgagggcttgacaaggcatccaatacagggcatagctgtggtgcaccttatgggaaaacgccccaggggcactgttggacgcagggtatcacatttgatccatacggttatcatgggtccgatctcgacactcaatgcgtgcaagaaccaagttggaagcattgtgacttgatgcgccctggcgcaagtgggccaaagttcaagttttccttggctcgatcaagaatgatccatcatcttcataagaacgtgagggttgtgcacccaaggttcaatcgcgtgagtgaattgttgaatgacatggttggctgaaaagaggcgtgctcatgaccaga

SEQ ID NO: 582936 - DNA, 243 bp, Homo sapiens
ctgtggtgtacgtagcctactgtacatctcgtctcttgtcagcgcttcctcttccatcagctcctaagtgctgggcttcttacagctcttttctcatcctgtggccagaagcaatcactaggtccagcccaggctcagtgggtggggtcacacacagggcatgaatggcagagatgggccactcgttgaaggccatcttagaaagccctccctgtgtctttgctctctccatcccacggtaac

SEQ ID NO: 582937 - DNA, 1128 bp, Homo sapiens
cccgtcatctaactctgaccagtgcttcgcaggcacactcatcacgagcgctaaagctcgcactgattttttacctgagtaggcctagaaagtaaacatgctagctttttagttccagtttctaacccaaagaaagataagagcgcgtcgttccacagaagctgccatcaagtatttcctcacgcaagcaaccggatccataagtcgcttcgtaatagctatcctcttcaacaagtatactctccgggacgaatgaaccataaccgaatactaccaattcaatactcatcattaataatcataatggctatagcgaataaaactaggaatagcccccgtttcacttctgagtcccagaggttaggccaagggcacccgctctgacatcgcggcctggcttgcttctcagcatgagcaaaaactaggcccccatctcgaatgcatataccaaatctctccctcgactaaagcgtaagccttctcctcactctctcaatcttatccatcatagcaggcagttgaggtggattaaaccaaacccaggtacgcaaaatcttagcatactcctcaattacccacataggatggataatagcaattctaccgtacaagcctaagcataagcattcttaatttaactatttatattatcctaagctactaccgcattcctactactcaacttaaactccagcacagcgacctactactatctcggactgaaacaagctaagatgactaacaaccttaattccattcacctcttatactaagaaggctgccccggtaaccggctttggccaatggcatgtctgagaatttcctaaacataggttttatacgcacatttatgcgcacatactcttaaatctatactaataacagcaaattaccactcaaatgagaagtctcaaatctgcacggggaataacgagggtggaaaatataaacgaagtgacaacagaaagacggcaaaagaagacaaaacccgtagacaactgataagcaaaacaacacagcggaagtacacacagaagactcagcaagacacaggagaggtagctgaaacacagcacgcagtagtataatactacggagacgagacacagcaagcaagagacgagtagg

SEQ ID NO: 582938 - DNA, 212 bp, Homo sapiens
ctggcaattatagatcactctcttgtggtcttcccttttgaacatcctaactctttagggttaaacactcatttgagcaaggacaagcttctaaatatacccactcctcaagccccccgccccactgtgcagcaggttttcctgttgataggacagtggacgtatgagtttgagtgtttggcagatgtttgcatgattcttagatcagtgct

SEQ ID NO: 582939 - DNA, 134 bp, Homo sapiens
aaaatcacgcaatttggccggattctgaatgagttaaagattgatattatctttgccaactcaccacaggctaaaggtcgcgtagaacgcgcgaatagaacccttcaagaccgtttgatcaaggagatgcgtct

SEQ ID NO: 582940 - DNA, 321 bp, Homo sapiens
  misc_feature (33)..(33): n is a, c, g, or t
  misc_feature (92)..(92): n is a, c, g, or t
gtttgggggctgccccttgggttttcagggttntgcatttaggggtccaggcccccccccccgccaaccatgcccctccccaggaattccantattgcctttgtgattggccccggaggaaaacccggcccagctcaaaacccctcccctgccctggggtgtgggggttttagtttaaagccccccaccctaggccccgtgccaaaggggaaaaggcttactccccggggaaaaggggaagccctgttattttccccgtcattttccccccagcccctcctgcccttttgatttgggcccccataaaggggttttttgtta

SEQ ID NO: 582941 - DNA, 171 bp, Homo sapiens
acgtcgcatagtacgctccgcaggcggcgacggcgcggacggactcgcagggccacctcatcgtaaatgcagatagcttcgaagacagtcgccaacgggtgaaagccgtcgggcgcaagggcgccaaccccgagcgccagattgaccttggcgctgacccgcaccgtcacg

SEQ ID NO: 582942 - DNA, 368 bp, Homo sapiens
  misc_feature (127)..(127): n is a, c, g, or t
  misc_feature (245)..(247): n is a, c, g, or t
ttaaagggtttttttttcaacgacttttgtttggattgggagcgtactgggtgttcggagatcttaaacaagatcacgttttttggggtggaatcccgcggctttttttttttttacagaaagtttnttgtggcaaaaagaaggtgggagaaggggaagttttttttttgttttgtgagggatggggttttggaaaaccattaaacgcagaaaggctttttccttttttggggtaaatggggggnnngggcgggcaagcccccgtttcccgggtttttgggtttggaaggggatgtttgggaggtcccccctgtaaattttttccgggggcccgggatggaaataaagcccccagggttgccttggga

SEQ ID NO: 582943 - DNA, 756 bp, Homo sapiens
cctagctaaccagctaacattggagaggcactcgttgggcactccttggtattgacgcactggggataccattgatgaactatgcacagatggaacaaagcttgctcttcttaatgtgagtatcccaggagtgtgtagcgcttaaatccacgttgtcgtccctaggagcatagtatccagtgtaggccttgcgtagatagtggcccgtcggcgggccatcgctgactcgttcatgtgcgccctcggggcctataatgctgtaccgaagtggaatccagacttttgtagctaccatctaacagggacgggcccgtcatcactgtcttaggcgtccccgtaccgtcttacacacagatgccgcaacttcctcaaggcagcaggctggaatacccatgcgggacctagttccagattcgtgagaatgactttcttaccttcgatgccatgcgccacagctggcaccagtcgtgtggattcgcggccatcaggggcaagacggactacggcctcatggtctttgcctgacaagcaggtcttgacccgtagaggtacaagacgggggaagctgccccgcatggatccaggagcacctcacagatgccaacctcaacctgaccgtggacgagggtgtcacaggtggccaagtacttcctgcggcagatggcacagcccttccacacgggaggatcagctgggcctgtacctgctcagcctggagcagcagaatcagaggagatacgcacagaggtagagcaa

SEQ ID NO: 582944 - DNA, 386 bp, Homo sapiens
accaggcaggacctgccctctggtggctgggagagacggccctagatgaaggctgccggactggatggattcctatatctctgttaccatcagtgactacctctgtctgggtggttggtacatgtttgaatttcatttctaagttactgtctactacgtttctgcaatatagccttcactcttcttttattcatgcagaagtgaatcgtaattgatttgttagaaagggagagaaagaaagagagagggagggaggaaagaatggagggaggcagggaaagagacagagagagttcaatccagccaacggtacatcctgaatagcttggtttgcttcatccatgcctgtaaataactgcttggtttgcaataatttctctcccgga

SEQ ID NO: 582945 - DNA, 230 bp, Homo sapiens
ctcgcgctctctgtgtgatcagagatgtgccctctcgtgtgtgttcctggggcgtgtgtggcccgcaggctggcagagtctgcgtgtgtgtactgctgtgtggtgttcagagaggtgtgctgagtgggcgaccaccgccgcttggcccggtgtagaggtgcgcgagtcgcgaaagagaagagagagcgtgtgtgtattgtgtgagagcccgcaagtacaaaagaaaacaa

SEQ ID NO: 582946 - DNA, 146 bp, Homo sapiens
ctgggggctcactatgttgctcaggctggtctcgaactcctggcttctagcaatctgcccacctcagcctctcaaagtgctaggattccaggtgtaagccaccacattcagctaaagtgcacaaatcttatgtggacagctcgagg

SEQ ID NO: 582947 - DNA, 1130 bp, Homo sapiens
cgtgcgccctttttttttttatttggaaatggaaccggggagaagcctaggtcggggttctcaggcatggcggaggcccgtctgggggagctctatgacggggaaacaatgcccctgaggggctccatgtgccccccaaaagacccgttacccccagggcttggcatacacaacgaaattactctgaggcatgacggtttccttccccaagggagagctggcacccaaggtactccagggggagagatggggccagcaattccaaagggggtctggggcaggaccaagagctcccggacttagggcagcataacaacacaaacatagagcagacaggacagcatacacataccggggggacaatggtggacgaggaagaggagggccacagacatacaggccaatgtggcacacgcgcgcgcgcacacacatacacacacacacacataaatatacacgtatggtaccggtaacatcccttccatatatccacaggatattgggagaagtcctaacagggggggtcaagggagagagtgtccccaggaaaggtccctagccactggccacccccagtgactccaacactactataactggacaagaagaacaggccgggcacagggggcacaacgccggaaatacccagacacatgggggaaggccagagagacgagagaggaaccactaagagagcacaggaagtgggaagacacagctcggtgccaacggaagagacgaaacccgtgagatccaaacacaaaacatacaaaacaataacagcccgacatgggggccgggtgccgaaaaacccacaacaaccgacaaggtcgaaccggacacaacgtagaaccggagaggaacgaggaaaaacaaggcaagagaccccagaccccacccaccccgagtgacacagagaacccccccctcaaacaacacaaaactagaaacggccaccaaaaccgtagcaaaccaaagcgggaccgaacacaccccacacacacgagcacagcgacacacgaaaacaccaaccgaaacaacaaaacaaaaaagcgaaaaacagcgcaacaacaaccaccaacacgaacgaccccacccacccacaaacgagacacaataaaaacacacag

SEQ ID NO: 582948 - DNA, 281 bp, Homo sapiens
cacgtaccccatggacctctcacgaggaccctctgagcaactggactatctttccagagtccaggggattccaggttgaatacaaagactttccccaaaaacaacaagaacgaatttgttatctcttatcaattgctcctcttcagccacctcttgatcagccatggtatcggcaaggatgtggagtcctgcccatgatatggctgcgctgaacatcttaaaggtgctgtctgagttgggaccacaaagtacagagatgccaagaacaggaaacgggccaa

SEQ ID NO: 582949 - DNA, 175 bp, Homo sapiens
ctctacgaggatctcccgctagcatatcaggacaagatagggggcggctgggctggtttcttctgcaagtgggcttatgccgccaaggcaggacagtggacttggctcacatccaggtctacccccagcccgcttctccccgtgcttgtccgtgctgatgctaggtcgggggtac

SEQ ID NO: 582950 - DNA, 179 bp, Homo sapiens
tcgataaggccaagctacttctggagtcttagtttctacttctccctgccgtgaagatgatatccactaacttgtatggctgttgtcaaggttagatgagaatgaatgtaaagtgcttagcacaatgcctcgtatggtgtaagtgattattcaatgataaccatttggcccttatcgag

SEQ ID NO: 582951 - DNA, 171 bp, Homo sapiens
gatgactgtgtaaactagtaggcccatatatggtctctctaatatagctgctatccattcagcagagtggatgggtggaatcaggatctggattcaagattacaacagtgggggtgagaaggcaaatgggattctgttttctagtaactttctcagacgttggtaatgggg

SEQ ID NO: 582952 - DNA, 1253 bp, Homo sapiens
  misc_feature (265)..(265): n is a, c, g, or t
  misc_feature (535)..(535): n is a, c, g, or t
  misc_feature (1249)..(1249): n is a, c, g, or t
cttttacactactatttcatgatgtgcctgtctactaatgctgggtataattgatcacctctattctccagtttaccttctcgtccagataccgatctaaaggagctctctgcctggtctctgtggagtgagcgtgactcgttcactcagaccacccttcacatgaccgcgactgctcctgcgtctgagccctagagtgatgtgctggcctcacttggcacgagtcatgtgaggattcttgtgtgcgcgcgtgcctgagagcagncagcctcgtcgcgcgtagtacgctaagcttaactctcagactgtctcacaacacctatagtgcgtccttgaggaagcgtagcgctaacagtaaacgcctaagatctctacgcgtgcgcatagtttggattagggccctagactgcggttcgccaaggatagaatgaatagttcacactacactaggcatgaacaccctgacacattgacccccagaacatgggcacccttacatatctctagagatcacaggggtagacgctaagacccnctatggaggacgcgtaaagagtctcatatcaagctaggtacgacttcgcgcaacgcgtttaggataagtaatttccctgtagaaccctaggaggattaccacaacgaaagcgaacaaacgcgttcactccttgagggggtcgctcttgccccccggataggcacttttaactacgcctccacggtaacctcacccatgagatccaaatcttcgaacgcgaaagccctaggactaagacttaagcagacggtaatccgtgttacgagttacggcgtaacacccccggctttgccgggacaacaacattcgggtgcgtaacaaccatgttccccatgtgcggttacccaaggcatattttggtaacccagaagttgaacacacggcattgcttggggtgccattgcgcattggtaacgttgcaaaaccttttcttcaggcacactccgatacgtattttatgcgcagagaactcccttgaaccgcctaagtgaccacagtgcttcgccgtctttagaatgttagttaggagacaggtggcgcccaggacaacagatttcaacattgggagaccccttaggtctgccaattgagtggttgggcaatttgggcgtactttgaacgtctttgcgacacacactttggaggcgccctttgaaaagttccgcggaaccacttacgttgtaggcgaacttacacttcgaattttttgggacngcag

SEQ ID NO: 582953 - DNA, 348 bp, Homo sapiens
aggaaaagatgcccagacctctgtgtggggagtcttctatgccacaccctcctagatgacatcatctggccctaagttttcagtatgagtcaatgtgttggtgatgcccagattcccacctccagccctgatttcttccaagtgctctagagtcatatacttatttgcctgcttgatgtcccttcttggatgtcaaacagtcatctcaaaattcaactcttgatcctctcccctgctccaaacttcgccatctcagtaaatgcgttatattcctcctggttgcataggcttcaaagctaggagtcatacttgaatagaccctctttcttgcctccgcgtttgagctat

SEQ ID NO: 582954 - DNA, 471 bp, Homo sapiens
  misc_feature (348)..(348): n is a, c, g, or t
  misc_feature (444)..(444): n is a, c, g, or t
  misc_feature (467)..(467): n is a, c, g, or t
agtagtataaactccatatggtcagatttccctttatagggattgtaccaattttgcattcccattagcgatgtgttagagtgcctgttttcctacagcctaaacagcgtgtggccttcttagattcttttttctgatagatttcccaagaaaaagaattaaccgtaattttaatgtacgtttctcttacattgagtgaagttgaacatcttttcatttatttatatttatttttctatgaccttttcatgtacttttttgtctattcggtacattatgcagattttaaaaattaaattaattttgtgataatatattcacagggagtttttttttgtttttttgggnttttttgtttgtttgattttttgaaatgggagtcttcccctggcaggctgggagtgcagtgggtgccaatcttgggctcactgcaacctctggccncccgggtttcaagcaattatccnggtt

SEQ ID NO: 582955 - DNA, 113 bp, Homo sapiens
tgagaggtctgtcatatctttgcacatttaaaattgggttgtttcttaccattgagttgtgtagttccttatatatttggatattagcttcatcaaatgtatggtgtgaaaat

SEQ ID NO: 582956 - DNA, 226 bp, Homo sapiens
actttatccttctcattgtgttgccaggtgctctcgaactcctgggctcatgccatcctcccgcttgggttccaaagtgctgggattacaggtgtgagtcactgtgccctgctggaactaccgtctttatttttagagacagagtctcgctctgttgcccaggctggagcacagtggcatgatctcagctcactgcagcctccgcctcctggattgaagcacttct

SEQ ID NO: 582957 - DNA, 714 bp, Homo sapiens
  misc_feature (19)..(19): n is a, c, g, or t
  misc_feature (21)..(21): n is a, c, g, or t
gcccccttgaaacctagancngatgagaccttgaacgctctgaccattattacgccaagcttggcacgaggcctcgttccatgaaacttaatctggttatctaccacaagcgcctccgctgtcgaattcgtggagtcagcctatttgagaaaggctgtgggaaactggagacctacattaaactggacaaactgggcgagggttcctatgccaccgactacaaaggcgaatgcaagctcacagacagcctagtagactcaatgagattagactggaacatgaagagggggcaccctgcaccgacatccgggaagtgtccctgctgaaggacctcaaacacgccaacatcattacgctacatgacattatgcacacggagaagtccgttacccttgtctaagagtacctggacaaggacctgaagcagtacctggatgactgtgggaacatcatcaacatgcacaacgtgaaactgatcctgttccagctgatccatggcctggcctactgccaccggcagaaggtgctacaccgagagctcaagccccagaacctgctcataatccagaggggagagctcaagctggcttacttgggcctgacccgagccaagttaatcccaaccaaagacttattggaaatgagggtggagccactggtggtaccggcccccatgacatccctgttagggtccaactgaattatcccatttaa

SEQ ID NO: 582958 - DNA, 736 bp, Homo sapiens
gggaccgttggggctgggaggctggtgtgtggcggcggcgcgcgactgcggcgcagtgcagttgttgcaggcgcggacgcgcggcggagctggaactgctgcagctgctgccgccggcggaggaaccttgatccccgtgctccggacgaccccgggcctcgccatggctgaccagctgactgaggagcagattgcagacgttcgaaggacgtgccttctccctctttgacaaggatggagatggcactatcaccatccaacggacgttggggacagtgatgagatccctggggatcatgaaccccactgaagcagagctgcaggatatgatcgagtgacggtggatgcagatgggaacgggaccattgacgttcccgtgagttcctgaccaatgattggccagacgagatgaaggacacaggacagtgcggaggagatccgagaggcgttccgtgtctttgacaaggctgggaatggctacgtcaggcgccgcagagctgcgtcaggtaggtgacgaacctgggggagaagctgaccgatgaggaggtggatgagattatcagggaggctgacatcggatggagatggtcaggtcaattatcgaagagtatgtacgcgattgatgacttggataggtgaagggctccccgggtcaggtggctgatgccctgttcgtcgttgatctctcgtcttctcgcagcgcgcagtctctcttcaagactcccctgagtagccg

SEQ ID NO: 582959 - DNA, 572 bp, Homo sapiens
  misc_feature (4)..(4): n is a, c, g, or t
  misc_feature (63)..(63): n is a, c, g, or t
  misc_feature (109)..(109): n is a, c, g, or t
  misc_feature (366)..(366): n is a, c, g, or t
  misc_feature (500)..(500): n is a, c, g, or t
  misc_feature (503)..(503): n is a, c, g, or t
  misc_feature (529)..(529): n is a, c, g, or t
tganacaggatcttgctctgtcttgatcttgtcatcaacaatttttttttttaattttgtaanaggcaagggtatcactgtgttgcccaggcttcagtgcagtggcacnatcgtagctcactgcagtctcaaactcctgggctcacacaatcctcctgcctcagtctcctgagtagctgggactataggcccataccaccacacctggcaaattattttatatgtggatactgagtctccatatgttgcccaggctgatcttggaactcctgcccttccaaagtgccgggattatggatatgagccactgtgcccagccaagtcttttacttcagtatatctgaatggataaagaaaataaaagtngattaaaggaaaaaggcatagtaaaatgctataataatatattcctctttctcaaaaatgattataaatttgggtctacctccagatgtggtaattgagtgtggacatatttgtgttaatattttgtttaaatncantgaagtacttattgagcatgtctcantgctaaccaatgtgttaggttttacagaaaatacaaaaattag

SEQ ID NO: 582960 - DNA, 407 bp, Homo sapiens
  misc_feature (32)..(32): n is a, c, g, or t
  misc_feature (74)..(74): n is a, c, g, or t
  misc_feature (107)..(107): n is a, c, g, or t
aagaattttgtggtgtgtgtgttacatattgnacttggttctgcattattttttgtctttttctcttcaccctnctgatatggtttaggtctgtgtccctacccaanatctcatgtcaaattataattctcaatgttggaggaggggcctggtgggaggtgattggatcatgggggcagacatcccccttgctgttctctcaataatgagtttttatgagatctggtcgtttgaaagtgtgtagcacctcctcctttgctctctttttcctgctggccatgtgaagatgtgcctgcttccccttcgccttccgccatgattgtaagttttctgaggcctctccagaagcagaagcctgtatagcccacagaactatgagtcaattaaacctcttttctttataaatt

SEQ ID NO: 582961 - DNA, 140 bp, Homo sapiens
actcaatctgtgctcgtgcccgattgtctgtggacgactgcacgatgtgacagcgcagtgaccctaatgctcttggttcacctcaaggccactcggaactctgtgcctgtgccatgccactggtgtattaagtgcaagta

SEQ ID NO: 582962 - DNA, 254 bp, Homo sapiens
ctcctcgctaacaatttactttgtgctttctgacaatttacttcccacttccttcatgaattttaaccccattttctgttaatttcatatttcctcttttcttttatgttctagaaattttaagttccatttatttttgagaccattcttaaattataacatgcataaagataaatcaatactcttgaaagagtaaaggattttaaatgtcttgttggtcatatttgcagaaaagaaaacctaaatagcacttg

SEQ ID NO: 582963 - DNA, 402 bp, Homo sapiens
atccgtgagttgtgcatattctgctgtccatagacatactggggatcaggttctctccaaaatgtaaacaggagtaccccccgtcccgctcgcaaacgctgaagtgttacggcacgtctctagagtgagcctggtgtctgcctcattcttaatggccccaacggaggacggggacgccacgccggggcacaggtgacgtcacgggcacagatgaccacgttgcgggtacggagcataccacaggtctgggctcacacgaggggaagcattcacactgtgttctctctacagggtcaggtcgtttttcttcatgtccgggcgggaaaaggaattccttttgccttttctaaggcaagctgctggtgtagtattcaatctgcttatcatgtaagaacttacatc

SEQ ID NO: 582964 - DNA, 413 bp, Homo sapiens
ccctttgcgcctatgtgtgggcagcagttcctcccggaagacattggcgccggacgtgcattgtcagccgctgagcacttccgtcatactacccgtcggacgacgcatcatcctcatcgttttcctccgcgtcctccttgccgtctggccgctcagcctcgtggggcagtgtgaccgttcgtgactggtgaaaccgtggcttgatgtcctgctcactgtcggggacagcctcatcctcctccacatcccccttgagcaggatgatgtcaatttccgagtacttcatcccattcaccaagatggggatcaactggaccagatgggaggccaggacttccttgcagatgggctgctcggccagcgtcagccagaactcacaggcctcaagggcaacgttctcatcatggtcctgg

SEQ ID NO: 582965 - DNA, 178 bp, Homo sapiens
catacttcaagtcctggttactggttagcacacacttcctttgatatgacacaactcctctctcttctgcttcaagttgatagcttgatgtgaggttcgctcttctcccgtgaccccgttaactcgagccgtctggttggatgcgcaagaagaagcccccgtttttgcagtacagccg

SEQ ID NO: 582966 - DNA, 283 bp, Homo sapiens
tgctattataggtgtgagccattgtgcctggccggctaatttttgtgtttgtagtagagatggggtttacccatgttggccaggctggtctcgaactcctgacctcaggttctctgcccacctcggcctctcaaagtgctgggattacaggcgtgcgccaccgtccccagccaacaatgccctttatatgtgctctgtgttcaggaccctggcaggaaacactcgaattgggtgatttgaggagattgtggtaaggggacagtttacaaagctgtgggcatgt

SEQ ID NO: 582967 - DNA, 141 bp, Homo sapiens
atggaagcttgctcggagcgctgtgaccactgtgctctggaggctgtgtccgcaagttgagcaaccaccgatgtctttgttcctctcatcccttgcaatcgtcacaaacccataggtgcattataaaaacttggtggtgca

SEQ ID NO: 582968 - DNA, 488 bp, Homo sapiens
gagcgttctagaggatcccagaacttatatctagctcaggcattgtaaatacaccaatcagcaccctgtgtttagctcaaggttagtgagtgcaccaatcgacactctgtatctagctgctctggtggggccttggagaacctgtgtgtggaaactctgtatctaactaatctgatggggacgtggagaacctttctatctagctcagggattgtaaacgcaccaatcagcgccctgacaaaacaggccactcggctctaccaatcagcaggatgtgggtggggccagataagagaataaaagcaggctgcccgagccagcattggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggagga

SEQ ID NO: 582969 - DNA, 984 bp, Homo sapiens
ggactttaatgagacagtgttagcaaatggcctagcacatagcaagtacttaaaaaatggaatcctgttattattaataataaaaattatatcgtgcgattatttataattaacataaataaatataataaatatatgtgtatataatacatattactatgtatacttaacatatcacttgtaggcccctattttgtcttgtggctgtgtttatctgctatgtgtcttgacttaaactatttaaaagtagatcctgctatatggaaatttccaagtaaagaggagagaggatttaaaaaacttggtggcccatggtagagtgatcaaagtcattgaagccttgaattcccggggctcagatgatcctccaacctacagctttcaaatagcgtgggaccacagggcgcattaccaccaggcccgaataattagggaatcacggtagagatggttaggctatgtggcccaggtgggtctcaaactcctgggctcaagcaattagccgtgctaagctccataaagtgcgggacctatgggtgtgagcatcacatgttgccaggaagaaggcatttacactattaaatactctaaatacgttggtcgcaaattacagtttaataaagggtaaaggacatgtcaagaacttatctggaaggagtaaccagctgtcaaatcaggaattgggaaacataccaatccagcacattaagtactttgaggacataaacagtttatccaaggcatgagttaaaagagaacccgcgagacttaaatcagagaacactatccaggataataaaaagaggggaacaaccaaacaaaaacacaacaaaaaaagcgcagtctaatcacctttttctcccttctaattcttatttttctgtgaaaaacaaacacacacaactacgcaaatcacacaacacactacccacacaacaccaaaacacacacaacacacaacacacaaccacaaaccaacacact

SEQ ID NO: 582970 - DNA, 863 bp, Homo sapiens
gggcggtgagggatgcgcgccgggtgctggtgtcggcggcaggtgcgctctgggttctcgatgacgtgcaggcttttcgggcccgaaactggtggtgttgccatgcgttgatagtgtgtggacgaatgaagaggccagcgctagcatcattgttaacatgacagactcgttcactgagcaggctgaccaggtgactgctgaggtttggaaagctcttgggtgacagagacaggtggatgcaattctttgctgttgctggatggatggcgccgggggcaatggcaaatccaagtctctctttacagaactgtgacctgatgtggaacgcagagcatatggatcatcgaccatctccaggcatctggctaccaagcatctcaaggaaggaggcctcctgaccttggctggcgcaaaggctgtcctggatgaggactcctaggtattgatcgagtgtacgtgcattggccaagggatgctgttcatcagtctctggccagagacctggctagggcaagaatcagcgtgatgcctgtccagggagaagacgctcatcgcatgtgctcccggttaccctggataccccgatgaacaggaaatcaatgcctgaggctgacttcagctcctggacacccttagaattcctagttgaaactttccatgactggatcacagggaaaaagcgagcgagctcagtgaagcctaatccaggtggtaaccacagaaaggaaggactggaactcaccccagcatatttaaaggcctcatctcagtgcctattaggggcctgcagaaaagtcactaacctgtctcagtgtggcctgtccagccttgtgttactgtaacccctgtttggtgtacgagat

SEQ ID NO: 582971 - DNA, 471 bp, Homo sapiens
aataaccgacttgacgttgggccttattatctcggattctttcatcttccttgggttgttccttaattctggcatctttgctgcccattacctctctcttcaaaggttggcaaagggacatagcaacaattctggtaaacagagcaaatggaaatggaaatgagccagaggtgtgctcagtagaatgtcatgtcatgtattgatcaaatggcacagagaacccaggctctggagtcaagactgggaagctattgtcataaactattctacattggcccgtaacttgagccttaacaaatcatacaacctcagagacttcatctataaattgaaagtgttaatatcatataccttttaagattttttggccagatgcagtgctcatgcctgtaattccagcacttcgggaggatcacttgagctcaggagttagagaccagtctgggcaacatagtgggaccctgtttctac

SEQ ID NO: 582972 - DNA, 613 bp, Homo sapiens
  misc_feature (310)..(310): n is a, c, g, or t
  misc_feature (363)..(363): n is a, c, g, or t
cggcaggagaggttgtggtgctagttgctcataagccatccagggccagtcctcgtcgcgtggagcgacacacgctctcgccgccgccatgactgagcagatgacccttcgtggcacccgtcaagggccacaagggcgtgggtaacccacgatcgctactaccccgtgagttcccggaacatgatcctcatccgaccgtctcgagatagagcaccagtacaattcatgtggaaagcgtgaccgagggagtgaggaccaaactatggacattcctacagcgctgctctgcggagggtcactccgcacgttngttgacgtgggatgtcggttgatcgtcctcaggatgggccgaggtttgccctnctcaggcgtccgtgggatcggaagcccgtggccggccctcctggggggacttctccaatccaaaaccgcgtggcgaacgcgagctctaatcggcccaggggccggaagttatgtggcctggaggaggccccggaattaaaccccaaaaacgggagaatgggttggccccttggcaaaggagtggtttggggacccccttgtccttttccccgttcgtggaaaaccccaaaacaccgggggcccagggcga

SEQ ID NO: 582973 - DNA, 447 bp, Homo sapiens
gcataaaatattttgtatggcccacacaattgttgattgaccactgacattttggctatttcagaaaaattactactgaaactgtgattccaactcagtgtaattgttaaagtagaaaagattttttcttgaccatgttcttcttcagttactaacaaactaggtatgacttgcccttggcaagatttgctctgtctgattggacatagtcgctatacgtgatttttaatttcttttatgaaggacatggcagggattttgaaagattaatgttgtcaaattgaagtctgaatgcccccaggaaaatatgccaagcaaaacatatgcatggcaagtttcctgaaatcactggtttttaaaaatgtatattttagttataatccaaacagatatgatacagtgaaaactttaattagtattaatgtaaacaccagacagcaaaaaaaa

SEQ ID NO: 582974 - DNA, 238 bp, Homo sapiens
gcagacttatttgcaggaggactggtcaggatggagacttagggcagtgaggactggtcagggaggagtaaggggaggaggactggtcaggaaggagttagggcaggaggactggtcagggaggagtaaggggaggaggactggtcagggaggagtttagggcaggtggacaggtcagggaggagttcgggctggaggatcggtcagggaggagttagggctgtcgggctagtcgggg

SEQ ID NO: 582975 - DNA, 1052 bp, Homo sapiens
tgatgtagtagcggccaggagaggggggacaacaggcagcggactcttggtgttttgtttacttgttgccgcagctgtcgtgtgggtttcttctttggttggtgtttgcgtttaaacgttggtgtgtgctgcccgcggtggttgtctcccccctccgtgggcgcgccgtttttttttgcgcgccgataatatttgcgcctgcgcggctcttcccttggtgccgttgtgagtgtttctgggcgtaaaggctgcgggtgtggcgccactttgtgtgttgttgggggtggtgccgccccggcgtgttttttgtgtcgcgcgcttgttaccaggggcctttgtggtgcatgtttgtcctcggcgtgccgcctccgccgcccgatgtgacgccggttgtgtgtcgccccgcgaaacgccgaccggattatttcttgtttctctttgttggggagaaatttcgtggtggtctggaaacaatattctgcgggggacagttgtgccgctctccctcccttggggttgcccccccgagaggggcgcctcttggtgcacttattgctcgtgcttgtctcaccaccggggtggggtgctcaccgatggcggaggttcttctcttttgcgagggaattttctgggctctcccccccgccccccccccacagaagaggtttcaaacactgtgctctcatattcacctcgcgggaaatatatagggaatatattcggtaaacttcctccacaatgtctgtggccccacctctctcgcaaaagaggtatacgtttttaattttcccccgccccattgtggaacttatatcaaatttctgaaataatgttcacacgcccccgcgttgatacaagcaatcttttcgacccaaaacgccccgtcctccttataaactctctcctatattctcttatggcggcccaccccacggggttttacttgcccactgaaaagtgtctttggcccccctctcttgaaacgtgtcacctccccttattcaacccgagtttctctccgttcaccacacattttgaaaacgataacaaga

SEQ ID NO: 582976 - DNA, 211 bp, Homo sapiens
aagggcctgataaacagctttcattatccactgtctccatacactgtttagacacacacacacactcacacagggggaaagggcctccaggaggagcacagggactcattgttttgtcaaaccctgcgcttaaagggcctggaccaaaggctgctgcacaggggtagcgcattaaaagggcctggagagcaagcaccctcggaccgaattc

SEQ ID NO: 582977 - DNA, 887 bp, Homo sapiens
  misc_feature (745)..(745): n is a, c, g, or t
  misc_feature (887)..(887): n is a, c, g, or t
ttctgactaccaaggaaaatatgttgtgtcttctgattaccctcttgatgttcagcctttgtgtgctcccacggatatcatagctttcagtgatagggccagaaagaatttaagaaactcgacattctgccaaacgctagtattggatgctgtctgtggaattctcacttctgtccatctatcatggttcaattgcacctaagaaatatggaggattgccaactccatgaatattcttttgatatctagtacccgaagcgcaccagtctgctccaagataatggtggatctgaaaggtccgatgaaggcatctcgttcaggggccttttgatcattgttggagaagaggggtattcttagcgaatgatcgactttgtaaagtgagcttccctgattggggcgtgtctgtgcgattggataggttagaagactaatttaagagtcttacagattcggatgacatagacagtaggggaaggttgtgcctcatgtttggtgggaaagaatggaatgtgatatcgagtcttatgcctgatgtccaaagtgagcgatacgaatagtctctgcaagtagaagtgacgagctgggggtgtatgtacgtagcgatggctcggtggcaggtgaattcagtgagatacaaaaagctccttctgtattggagaattccgatggagtgaatacatgtgatatcctgaattcaggcgaatctgtggttgtcttacaaggggaaggacttgcctgacgngtggtgtggagacaagcttgttccttggaggaatggttggctaggagtatgtgcgggactgatgtttgtgttttattaagacccgtattttgggtgggttaatgaatgtgaaaaaaataaaaaaaatggggtgcgaaatgtn

SEQ ID NO: 582978 - DNA, 739 bp, Homo sapiens
  misc_feature (628)..(628): n is a, c, g, or t
gttggtatcgattggggccggggacgcggatcacgcgtgtgcacgtggtctgcgggctaggcgtgggccgtccagacttgcgtgcctcggggtaccgtctcccgctgctttggtcaccagctccctgtccctgcccgaccctgctccgttctcctggcctgcgagccctgtcggccggactttgcgccagtgtccggcgctgctgctgtgctcgtgggccccgctcggcgccggcggtgacgcgggtaagcccagcttcaaaggggcaagctcggtgaccctggcccctggtatggctgaagtcagcattcgtaccatgtcctaagtcgtgcctgagagtcaaggaagtatgtccgagattttgctgtcctggtaggactcacaccctggctcactagcctgctaggtaacaagtagcattgacgcatcagtttggcatcggaacgttgcatgcggaagccgtattggtccagtgatgtatctctcaggtgtgctaatcaagggtccaacgaggacagactctgaaagcgcaggcccagctctccagaagcgctaccatagaccttgaaccagcaaggactgttgaacgttgctcctggaagagttcagtgagaagtctggcgtagtngacggcacgagacgacgacgcattcaggagagagatggattgaggacttagctcgaccttgcgcgatgaaaaggaggttaccccgtgacagagtgagccgaggaaagtgac

SEQ ID NO: 582979 - DNA, 347 bp, Homo sapiens
gtcaacttttgtgagagagttcttcgaacacttggttgataccacactgcactgtgtgagttcgtaatggaggatgatcctgaatttaccggcttgcgcatctgcttggatcgtgatgctgtttacttaatttctgattttcaaaggcccttgggcctctctttagggagtgacattgctgaagccaggtagtgtagtttaagattttaaactgatacatattgtgagaaactgtgcggcagcctatgatgtgattggggtcccgcggatgggaaggaaatagtaagtagagcagactagaattcctatagatgggaattaaagtagaaaagaatttcttaggtttt

SEQ ID NO: 582980 - DNA, 168 bp, Homo sapiens
accccgggggccccctttttgcaagcttccccggtccccaaaaggaatttcacttggggggtttgggttttttattttttggaagggtcatttgtaaaactttaaaggcccatgataggggtttcaaacgggaaaaagggaaataaaataattcggtttgcggcccca

SEQ ID NO: 582981 - DNA, 688 bp, Homo sapiens
cgatgctgctcctgtgagcgccctgaggagtcgtacccgtccaccgtccgcgagctggtagccagtctgccccgtcgcctcgactccctttcaccaaacatccgacacccacattgacacctccagtccggccagccgctccactcgttgcctttgcatctccacacatgagacgtcctccgcgcaagacgctagagggctcctccgcggggacccgcggtccccaccgtgcagcgtgggcatcatcaaagatggtcctctcagggtgcgccatcattgtccgaggtcagcctcgatggtagggcctcctcctgagcggcagatcaacctcagacaacaattccgtgctgagaacaatctttgcatcagcctgcggcatatgccctgcccacatccataccttgtattgccactacttgataacttccccttgaaatgcaagactctcttgtgtgtctcatatattcccgacacttccgaaacaaagttatccgtttccgcacacaaatgaaaacgcctggactatatgtgtgtacagggcacaggtacttggttattcaacccgactcatgacacaaatcgcatgcgcaacattctcccccaagaatgtggccaacgaactgttactgggccctttgtacatccataagcacatatgggacacaagcatagactaacccaataatgg

SEQ ID NO: 582982 - DNA, 406 bp, Homo sapiens
  misc_feature (68)..(68): n is a, c, g, or t
  misc_feature (125)..(125): n is a, c, g, or t
  misc_feature (148)..(148): n is a, c, g, or t
  misc_feature (159)..(159): n is a, c, g, or t
  misc_feature (173)..(173): n is a, c, g, or t
  misc_feature (185)..(185): n is a, c, g, or t
  misc_feature (248)..(248): n is a, c, g, or t
  misc_feature (300)..(300): n is a, c, g, or t
  misc_feature (349)..(349): n is a, c, g, or t
  misc_feature (394)..(394): n is a, c, g, or t
gcagttcctggcctggaacttcgaggccttgacgcaggccgaggctggcccagtgtccccacagaccngctccaactgctgctgcccaggagcgacctggcggtgccagcgagctggccctactnaaggccgtggacacctggagctngggggagcgtncctcccatgaggangtggagggcttngtggagaagatccgcttccccatgatgctccctgaggactctttgagtgcagttcaacctgtncctgtactggagccacgaggccctgttccagaagaagactctgcaggccctngaattccacactgtgccctttcagttgctggccctgtacaaaggccttnaacctcaccgaggataaccttacaagccccggattttacaacttngtccactgggaa

SEQ ID NO: 582983 - DNA, 476 bp, Homo sapiens
gggaggaaaggtttctatgaaggcaatagcccaatatcatcccaatgtgaccaaccaggtcccagtaaaatgaggacaaatatttacctataggaattagcaatcagaaaaagtggtttcagtgtggaggtaaaaacagaagctagatgctctgggttgaagattaaagacgagggaaagtgcgggaagaccattcctttgagagatctgaataagaagagaaggcaagagatttgttgttagagatgtcattagataaagggaagagtctttgaggataggggagacttggccctcgtataagctaagagaagagagcacagaagaggagaacgtaaagatacagaagagaatggcaataacagacaaatcacagaggccagaggaagcgattagggcctaggcaaggacctcctttgcactctgtctttgatgtagtgtgctccttgcagttcagaatatattatacctcacaa

SEQ ID NO: 582984 - DNA, 180 bp, Homo sapiens
gagtcggcacctgtttactgggcgtatgaggttgagtgagcaagagtgccagtgcactccagcctgggcgacagagtgagactccatctcaaagtaaataaataaatactccagcctgggcgacagagtgtgactccatctcaaaatacatacatacatacatacatacatacatatgtt

SEQ ID NO: 582985 - DNA, 406 bp, Homo sapiens
  misc_feature (406)..(406): n is a, c, g, or t
gactgtgcgcagccccggcgctcacagatggagggtcccagtgcctagtgacgcagccccagcgggaagctccagctggccgtgaagaggccgagtcgagagccgggaggcgcgctgggggtgggctgctgcagcctgcgggttgtttatctggagtacggagtgggtgagtggggggagcctggaaaccgccccgtgtcccatttcctcctcttgttttctgctccggattctccatgtttggacccaaactgagtgagcccgtgagctgctgctggcgggatcgtgggccggtggtgcacccgtgggtgatgcctgctgccctgggcctgcctgccctattgtacagtgcctgcctcaccttccctggtcctgggtgaggaaagcgagaggggcggcatgtgan

SEQ ID NO: 582986 - DNA, 731 bp, Homo sapiens
  misc_feature (209)..(209): n is a, c, g, or t
  misc_feature (300)..(300): n is a, c, g, or t
cttttggcgtcggcaggcgaagccacatcggctgagacaacatggggaaggtgaaggtcggagtcaacggatttggtcgtattgggcgcctggtcaacaggggctggttttaactctgggtaaagtgggatattggttggcatcaatggaaccccttcattggaaccttcaactacatgggtttacatggttccaagtatgtattcccnaaccatgggccaaaattccatgggccaccggtccaagggctggagaaacggggcaaggcttggtcactcaaatggagaaatcccaatcaancaatctttccaaggacggcgaagaatcccgtctcaaaaatctaaggtgggggcgaatgcctgggcgcctgtaggtacggtcggtgggaggtccaactgggcggtctttcaaccaaccaatgggaagaaagggctagggggctcactttggcaggggggggaggccacaaagggggtcaatcaatctctggcccccctctggctggaacgcccccactggttcggtcatgggttggtgaaaccaatggagaacggtatgaacaaacaggccttcaaggaattcatcaaggaaatggcctctctggaaccaaacctggcttaagcaaacccatgggccaagggggtcattcaatggaacaacgtttggggaatcgggggggaaggggctccatggaacacaaggttcaaagggccatcaacggggcccagggc

SEQ ID NO: 582987 - DNA, 593 bp, Homo sapiens
tcccgataacagcccaagatctacttttaaccaacaagtcactatatccctcactggcaacgcaacatttgtatgctcataaggaaaggttcaataaggcaaaaggaactcaccaaatcttaccccagctgtataccaaaaacatcacctctagcataaccagtgttagaggcaccgcctgcccagtgacacatgtctaacggtcgcggtaccctaaccgtgcaaaggtagcataatcacttgatccttaaatagggacctcgatgaatggctccaagagggatcagctgttttttactgttaaccagggaaattgacctgcccgtgaagaggcggaaatgacacattaagacgagaagaccctatggagctgtactctattaatgcaaacagtgcctaacagacccacaggttctaaacataccaaacctgcattaaaaatttcgggtggggcgacctcggagcagaaccaaacctgtgaaaatacatgctaagacttcaccagtcaaggcaaactactatactcaattgatccaataacttgaccaacgaaacaagttacccctagggattacaagcccaatcctattctt

SEQ ID NO: 582988 - DNA, 141 bp, Homo sapiens
gcatggtaggacggtgttaatcggacgaggaccacacccagctcatatattgtatttttacgcagagatggggtttcaccattttgcccaggctggtttggaactcctgacttcaaattacccacctgcctcagcctccca

SEQ ID NO: 582989 - DNA, 400 bp, Homo sapiens
  misc_feature (212)..(212): n is a, c, g, or t
tcacccacccggactcacattctccccagaggccgagatgcgggtcatggcgccccgagccctcctcctgctgctctcgggaggcctggccctgaccgagacctgggcctgctcccactccatgaggtatttcgaacaccgcctgtgtccctggcccggaccgcgtgagaagccccagacttcatctcagtgggggctaaccgtggacgaancgcagttcgtgccgggttcgaccaggcgacgtccgcgaagtccgaacgaggggaagcctgcgtggcgcccgtggggtgggagcaaggagggggcccggaagtattggggaccgggagacacagaagtacaagcgccaggcacaggctgacggtgagcctgcggaacctgcgcggtatacaacagagcg

SEQ ID NO: 582990 - DNA, 699 bp, Homo sapiens
ggcgggggttgcagtgagccgagattgtaccactgcactccaacctggcgacagagtaagactacaacttaaaaaaaaaaaaaaacacccggatttcaacttgggcaaaaaaaaaaaaaaaaataaaaaaaaaaaatatttgtgtggcgcgcgcgcgctctgggcccctcgagaaaattttttaaaaccttcgtgtgtggaggggcgccgggcggccccaagtatggtgaaacggagaacactgggggacaaacggtgggtccccaaagaagacaaccccgtgggcacaagacaaaggcggcgggaggtgttctccccacagcataagaagaaaaacccgccgggaggggaacaacccagaggtgcgtctcgcagaaaaacatccccagaagggggggctgatcacagggggagcgaaataaccgcgcagagggcatatataacacaaaggagagcgctctcacagagcgagaaaggcgcgagaaatctatcaaagatatattagcgccccgcggtgcttggggtgtaaaaaagacgatgacaaatcagacatacagacaatgaaataagaagagaagcaaaacaacagacgccgaagctagaacagaaacgcaacgacagagagcgaacgaagagacaaggaagagacagaaacaaaaccaatcagaatacaaaaagcaggaaaacacagaagaaaaa

SEQ ID NO: 582991 - DNA, 542 bp, Homo sapiens
gaagatcaggatggtcctagatgtcagtcttatttctgggctctctattctgttccattggtttatgtgcctgtttattgcagccacgtaccactactgctttttttctatggccttgtagtatagtttgaagtcaggtaacatgattcctctatctttgttctttttgcgttggattgttttgggtattggggacatattttggttccatatgaattttagaacagttttttttctagttccatgaagaatgttgttggtagtttgacaggaatagcactaatttgtaaattgcttcagacagtatagctattataatgatattgattctccctatccatgagcacattttttttcccattccataggttgtgtgtttacttcgttagtttttttttgttgttgtcgttgtttctttgttttttttggttgtgcagaagctcttaagtttcattagatcccacttgtcattttggctttagttgggattacttttggtgtctttgtcatgaaatctttgcccattcctatctccagtatgg

SEQ ID NO: 582992 - DNA, 290 bp, Homo sapiens
ttactagagactagtttcaccatggtcttgatctcctgatctcgtgatccacccgcctcggctcccaaagtgctgggattacaggcgtgagccaccgcgcccggcccagttctgttttttggtttggtttggtttcgtatttcgtgtttttcttgagatggagtttcactctctgttgcccaggctggagtgcaatggcgcgatctcagctcaccgcaacctctgcctcctgggttcaagcaattctcctgtctcagcttccccagtagctgagacaaggtagagccgag

SEQ ID NO: 582993 - DNA, 702 bp, Homo sapiens
ttttcttggcaggagccgcaggcgtagcaaccatggcgcccagccgaatggcatggtcttgaagccccacttcacaaaggactggcagcggcgcgtggccacgtgtttcaacagccggcccgtaagatcgcaagacgtaaggcccggcaagccaaggcgcgccgcatcgccccgcgccccgcgttgggtcccatccggcccatcgtgcgttgccccacggtttggtaccacacaaaggtgcgcgccggccccggcttcagcctggaggagctcagggtggccggcattcacaaaaaggtggcccggaccatcggcatttttgtggatccgaggaggcggaacaagtccccggagtccctgcaggccaacgtgcagcgggtgaaggagtaccgctccaaactcatccttttccccaggaagccctcggcccccaaaaagggagacagttttgctgaaaaactgaaactggccccccagctggccgggccggtcatgcccgtccggaacgtttataaaaaggagaaagctcgagtcatccctgaggaaaagaagaatttcaaagccttcgctagtttccgtatggcccgtgccaacgcccggctttttggcatacgggcaaaaaaagccaaggaagccccagaacaggatgtttaaaaaaaaaaataaagccctcctgggggcttggaatcagtcggccgtcca

SEQ ID NO: 582994 - DNA, 459 bp, Homo sapiens
ggaaaacaggtacagaggatgaggtgtctttccccttcctcaggtccgcttgaacctcgagttccttttgagacagttccagatgaatgacgcgagacggaaaagaaaacaggctgggattgtctcgctcactccgtccactaaggcagatggtggagtgggcaccacggcccagccattatcagtgcggaaaaccgtgaagggccttgacgatctggacgccgatgccgatgatggctgggcaggccgtccatgaagaagtggactattctgagaaactgaagttcattgatgatgaagaggaggaagaagttgtgaaggacggcaggccatagtgttgggaccctaggaggcagtggcagttgtcaatgagctctgcagacagtgcggacgctaagcggactcgagaggaagggaaggactgggctgaagcagtgggtgcgtcccgaaactgaaaca

SEQ ID NO: 582995 - DNA, 504 bp, Homo sapiens
tagtcaatggctgcgtcacctccgtatagcaaacaatcataaggtaaaaatagtactctacccaaagacgacacacattatctatggcagcaatgtcaacagtacattacatacagaagccctaggcatatataggcttgtttaacgccaggaaactccatttactgctcgaggatgggccagatacacaaaagaaaagtcaatttctcctatgggaatagtaaaactgaacttaccatctggagaagtaacagctgtccgccagtttactacattataccaaaccttcaaaagacagtcatccttcccagcagtggcaaaaaattctccatctggtgaaaatttcattaaatgaacttgggaagcagttttgcaatgccaaatgcatttccaatctccaaagttcagatctgtatttatttaaatcttcatctacagttgacttactcgcgcgagagtaagtccaaaaaagcaatgggctgggcataagtgaacatgcctgtc

SEQ ID NO: 582996 - DNA, 531 bp, Homo sapiens
  misc_feature (7)..(7): n is a, c, g, or t
  misc_feature (453)..(453): n is a, c, g, or t
  misc_feature (485)..(485): n is a, c, g, or t
tatacangatccccctgacgagtcctaactgttggaacagaaatcacataccagagaccagggagtgtgggagtgagtataagatgtgtgtgtgtcggggggaaatgggcaaacacaaacacaaatgatataaaggaatccgtgggggatcacagggtgtgctgccatggtctctagaaggcattgataactaagagactgctgcgtgacttggtgagagtagtttcagcagaggccaaatggtagtggtttgaggaatgagtggaaggtaaagaagtgggaggaggctgggcacggtggctcccgcctgtaattccagcactttgggaggccaaggcaggcggatcacctgaggtcaggagtttgagacccgcctggccaacatggcaaaaccctgtctctactaaaattagccaggcgtggtggcacgcacctgtaatcccagctacttgngaggctgaggcaggagaatcgcttgaacctgngaggtggaggttgcagtgtgccgagattgcgccactgcactccagc

SEQ ID NO: 582997 - DNA, 160 bp, Homo sapiens
aacgcaacaagacacacgagcattgcacgacaatgatccaagattacgacggcattcttcatcgaccttgatgaaagtcagcgcagagatttcttcctgctcgataggctttttccagggtcatgccgacttcgaacgggatcatatacgacaggcggtc

SEQ ID NO: 582998 - DNA, 693 bp, Homo sapiens
cgggactgctttggcagatcattaagatcggttcgttcgctgacattgaattagtgcaggaatgaagccttggctgtttactccgagatggtgagacttggaggaacttatgaaatgtctccagaagagcttctagcttcagatgggcaaacttgcattgggaaaactcgggctggcaaaagaattaacaacttagaggtgctgacatcaaggattccgaaagcctatttccatcttctcaatcaaatcgcgaccaaagaggacaacccaggaaggtgaaccacggatagatcattaacatgtcaggtttcgaatgaaacagatgattcgaagagagctgagagtatgcttcaacaagcagataaacttaggttgcagacagttgttacccctgctgatgttgtcagtggaaagcccaaactcaagcgttagcgtttacgtggctaacctgtttaataaagtacccagtcactaactaagaccagagaaccaggatatttgacgtggactctattagaaggagaaactcgtgacagaaagaaccttccgtaactgggatgaactctcttggtgtcaatcctcacgtaaaccatctctatgctgaccttgcaggatgccctggtactcttacagttatatgaacgaattcaagttcctgtgacgggcagtacggttataaacctcccataccga

SEQ ID NO: 582999 - DNA, 485 bp, Homo sapiens
  misc_feature (273)..(273): n is a, c, g, or t
gcccccagtctccctaatttttataagtttcttcaagcttggcttcctgcagaatgttacatataaatctttccaatatccacctcccacctcaagtggctctctttcttttttttttttttttttttttttgagatggagtcttgctctgtcacccagactggagtgcagtggtgcgattttggctcactgcaacgtccgcctcctgagttcatgccattctcctgcctcagcctccccagcagctgggactacaggcgcacactgccacgncctggctactttttttgtatttttagtagagacagggtttcaccgtgttagccaggatggtctcgatctcctgacctcatgatcagcctgcctcggcctcccaaagtgctgggattacaagtgtaagccacagtgttgggcctcaagtggctctatttatttaaaaacttccatgtttgtagttagctgggtctcagaatctgaaaaaaaaa

SEQ ID NO: 583000 - DNA, 407 bp, Homo sapiens
  misc_feature (4)..(4): n is a, c, g, or t
  misc_feature (16)..(16): n is a, c, g, or t
  misc_feature (39)..(39): n is a, c, g, or t
  misc_feature (76)..(76): n is a, c, g, or t
  misc_feature (396)..(396): n is a, c, g, or t
ccantggatttaattnggttcaaggaaattaaattaccngaataattttcacccagggtatgtaaaaaatgaatcnaaacgggaaattcttagaaatagaaaacataataaattaaaaatgtaaggccaggcacggtggctcatgcctgtaatcccagcactttgggaggccgaggcgggcggatcacgaggtcaagagattgagaccatcctggccaacacggtgaaaccctgtctctaccaaaaatacgaaaaaagtggccgggcgtggtgcgggcgcctgtagtccctgctacttgggaggctgaggcgggagaatggcgtgagcctggggggcggagcttgcagtgggccgagatcgcgccactgcactccagcctgggtgacagatgtggntccgtctcaaa

SEQ ID NO: 583001 - DNA, 957 bp, Homo sapiens
  misc_feature (521)..(521): n is a, c, g, or t
ggggaagatttgagctgagagagaaatggactggatgtactagagagcccagtgataagagttgtcgaacaatgttaaaggtcagcatgtgctatgttgggaatctagatgtagcttagatttcctatgggttagagtattgtgctataacaaagtgaagtgcaatgacaattatatattcctactcgtgtcatacgtggcacatgggcgtgcggttctcttaaatagtactcacgtaatgaactcaaagcctctggctattaacataccctagtttgccgtatttttaatggccatgagccaaatacttcttggtatacaattgatccatttattttaatgggctggccttttcatttccatcttttcttgctgctacccatctatgtatgtagtcattggggggaaaatgtagccacattttttatgggaagactttgtgttacacagtgaacatttgaaggtttaactggtgaaactagcctggaataatgccaccagagactgagtggaaactcgcncccttttgacaggtgccattcttatgagccaaaagtttgtccctttacagagttccatttgacgggaactaacatggtcattattaacttcggaactaacagggtatagtaaccttacaacaggaaccttataacttgattgtcgtgaacggggctgactttcgtcaccactgagagtcacccttggagtaaaggttttccatgcactgtgcaaccgtggtttcactatagaatttctacgctagggaaccggcattcaccttggggcacatggggaggttccctaacagaaccttttctttaccaaacataaaggcccatacgttaacccttgagacacaccacgacgtacagcacaatgaaacaaaacatcgtggcgaggccactgaccactagaacaatcttatacaccaacattgtgagcgggccccaagat

SEQ ID NO: 583002 - DNA, 394 bp, Homo sapiens
gccaattaaacctttttctaaaaaaaaaaattacctagtctcaggtatttatagcaatgcaagaataaactaatacagtgaatattgctgcagtaaacatggatgtgcaaatatttctgtcagatatactttgcatattttgaataggatgctcagaagtagaattagtgggtcatagaataacttcattttttttttggaggaacccctatacattttttaggggctgcatcactttcttcccaccagcagtgcacaagggtttcaattcatctacattgttgacatttgttattttttgtttgcttgatattggccattccaattaatacacgataatacctcattgtggttttgctttacatttttctaaagattaaaaattttttcaata

SEQ ID NO: 583003 - DNA, 178 bp, Homo sapiens
gtcggttctacatattgatgcgaacttagtgcggacacccgatcggcatagcgcactacagcccagaactcctgggctcaagcgatcctccacctcagcctccgagtagctgggggtaacaaagcgcacaacaccggcacccgggctattttttttgtatttttaagtagagatgggg

SEQ ID NO: 583004 - DNA, 141 bp, Homo sapiens
tctcatagaccgatcccctagtgggtcctgccatctccttggcctatcaggcagctgagagtgtatatcttgaagacggcagccacataaactcccagcacgagacaagcttggtgatatgagaggctctagtcatctatg

SEQ ID NO: 583005 - DNA, 454 bp, Homo sapiens
ctcatcatttttctttatttcctctaaaaaaaaaatgagatacgttggcagaatgtgcaggtttgttatataggtatacgtgtgccatggtggtttgctggccctactgacccatcctctaagttcgcccgctcaccccctaccccctgttgtgtgttttgttaccctctctgtgtccgtgtgttctcagcattcaacttccatttatgcgtgagaacatgcagtatttggttttctgttcctgtgttagtttgctgaggatgatggcttctagtttcatccatgtccttgtaaaggacatgatcccattcctttttatggctgcatagtattccacggtgtatatgtaccacatttcctttatccagtctatcattgatgtgcatttggattggttccatgtttttgctattgtaaaatagtgctgcaataaacattatgtgtgcatatgtca

SEQ ID NO: 583006 - DNA, 306 bp, Homo sapiens
aggtactctagcggacctttgcactgttcggatatacttgagggcgtatgtaagtgaaacaagccagcacagaaaggccaatgctgtatggtgcacttctgcgatgttcttacagtagtccaattcatagagacagaaagtggctgattggtttgcacgggctgggagagaggggcatgggagttagtgttcaatggctagagattcaacttgagatgagaccacggttctggcgatggctggtggtgatggcagcacgataatgtgaatgtacttaatgatgtccacttacttggttcaagtggt

SEQ ID NO: 583007 - DNA, 273 bp, Homo sapiens
atcagtcgtaccatcagactgtcttccaagggagacaagtcctggctacatccagcctgtggttacgatgtgcaaagtggcccatcgggaatttaaatcttttcccacctcagctgatcggtgcgtggaattccaggcaccacttctgattcgattcctctgtgactcctgtccgatggggatcctctatagctcgcacctgacatggctgtgttcgcttggccactggctcgctcgttctacaaggttgcgattgagtcgaacccgtggggg

SEQ ID NO: 583008 - DNA, 421 bp, Homo sapiens
tctgtgatgcaagtctcgctcttgcagtgagtggatgtgtgagacattcagacaggtacgcagacagtgacgtggtctacaactaaaacgtggctagcactgggtgaggctggcagttaccactcaattccacacaatgccatcaatgcccaccccctgctgactgtgtgcggggttgctgggatggacggacagatgacacaggagtgctgttcttgatgagcctggacttggtgtgctgctagctgatgctgtggtgctgagcgcaacagctcccagatcagacccctgctccggagcttgagtgctcttccacattaactcgggtgtgctctgcatgagtcccatgtttccccaatctgtcaaaatgaggaggataacagtgcccaccatcacaaggctgcagaaggacacaatgaga

SEQ ID NO: 583009 - DNA, 196 bp, Homo sapiens
gccaatatgcggtcgaatcgaagctgtagccacaagcctacaccacagccacagcaatgcgggatctgagccacgtctgcagcgctacaccacagctcatggcaatgccggatccttaacccactgggcaagtccagggatcaaacctgcgtcctcatggatgctagtcaggttagctaaccactgagccatgatg

SEQ ID NO: 583010 - DNA, 681 bp, Homo sapiens
gtcttgagcgtgacaaccccccaccgctgttgccggcgcgtctttggccgctcccctgtgggcccctctttcacacacgaccgtgttgttgctcgccgaggtttgggccccactctcctcccggctggcttttggggcacaaccattgtgaaccggtgggcgctccccgttgcaggccccccactggtcgctggtctactgcgcatgatccctcggttgtgtgtgacaaccccttctccgcgcaacccaccagagtgggggtttgtcttctgggccccttcttgtggaagcgccacgcgctgttattggggccacccaaccccttggcgcctcttcgctgcccccaaaggggggcaaccctataacccccgtgtggctacgacaccgtgcgggaataaaacttgcctcaactgctcgcgcttagggaaacgggcggtgtgcgccccaacactgttacaccacacaccacgggtgatggcgctcacgttcgacacaccacacaggggaggcgccctccaccaaaggagttgggtgacgggtggcacttatctgtacaatggtcggaaaggcgccggcacataataagagagggtgggggatatgcctggaattccccccccccttttaaatatctttttggggaaacacaggggggaaaccaaaaacaaaaccccaaaaaaa

SEQ ID NO: 583011 - DNA, 680 bp, Homo sapiens
cagctttctcgagtgttggctccattttgggctgaggggcgcctttggaggtctttagcgaccggggctggggggtggttttcgagaaatcgcgccctgtttcagtgaccgcgcccttattttccagtcgggtatagtctggattcttggggcggtagggacccccgagaggccgcggtagaatggtgacctgtctccttcgaggcctgggccggccgcgacctcccaacatggcgccagttgaacgctgccttggctcataacccctcccaatggagggagttcctctttgcccctaaaactggcagcgcgggttttcgcccggcacaagaggcgctctcgttcgggctctcccagtttctgtccctcggagttgaccaagcagagctttcaaactatcggactatcgaacgtcttcacttttcgtgtgtacccgtgctaaagaggccgtctcggatttacttacgtaagcccaaacctggttaaagtgcatgtcactcttagtcattcacactcgtaagggctttccggcgcgttcctcttcaagttcacgcagcgtgtcggctgcgcacgaaccattccagtcgattctgccaaccgttcaccaggccgggcgcgctgggtcacgcctgttatccccgccagttgcgaggccacgcaggcggtccctgcagtaagca

SEQ ID NO: 583012 - DNA, 160 bp, Homo sapiens
accctctgtgtatcctctctgccgtcagctcctccgattcgaggcttgtacttggtcatactacctcctccagggtaatagaggcgcacggccgggcactcttccttcttcaggccaaagaactacgaggatagcgctaggttgtacggtagtggtcgct

SEQ ID NO: 583013 - DNA, 373 bp, Homo sapiens
  misc_feature (19)..(19): n is a, c, g, or t
  misc_feature (50)..(50): n is a, c, g, or t
  misc_feature (55)..(55): n is a, c, g, or t
  misc_feature (81)..(81): n is a, c, g, or t
  misc_feature (109)..(109): n is a, c, g, or t
  misc_feature (122)..(123): n is a, c, g, or t
  misc_feature (169)..(169): n is a, c, g, or t
  misc_feature (268)..(268): n is a, c, g, or t
  misc_feature (278)..(278): n is a, c, g, or t
  misc_feature (311)..(311): n is a, c, g, or t
  misc_feature (317)..(317): n is a, c, g, or t
  misc_feature (340)..(340): n is a, c, g, or t
  misc_feature (366)..(366): n is a, c, g, or t
ctaagagttttaataaggnatggattttatctcttacgaaatcccttttnagctnatatagagctctcataaattcttccntattaattgaagctgaaatgaaggttcntgcacagccatanngcctcttcatatcctctacatgcccctagtcccttgtgccaggacntgaatacctctgcagatagcctaaaggtgaggcttcaaggtctgcgtgctaggcgtggttctgaacgccttctcaagctgcccaagcacatgagagtcntgagaggctntcctttacagagaaagaaagtaggccatatccnctctcngtgccattataagagagagctcntgggcacagcagcacacagagcacangagccct

SEQ ID NO: 583014 - DNA, 125 bp, Homo sapiens
catggtatcatcacactgggcgcatggagagatctgcacacaccttctacactgagctcgtgtgctccgagcagcacccacctgctcacagagccccgctgagcccaggccaaccggagagttct

SEQ ID NO: 583015 - DNA, 156 bp, Homo sapiens
aggaaatgaaacctgaaggcactgctactgaaagggggtggaaaggatgattttactggtgagccataaggttttgcttaagcttgaggaatagaaaaacacacaaagcaaacgacttgcgcaagatccagttatttgagacgcccccgctcattt

SEQ ID NO: 583016 - DNA, 146 bp, Homo sapiens
agtgggaacgtggggggtacatatgccctcgcctccccgtgtacaagagttgtggttgtccatcggatccttccactcttgtcagtgtgaagatgggggcctggtatctcaggcagatagttgaattcctgtgctatcccttctct

SEQ ID NO: 583017 - DNA, 672 bp, Homo sapiens
  misc_feature (65)..(65): n is a, c, g, or t
  misc_feature (87)..(87): n is a, c, g, or t
  misc_feature (130)..(130): n is a, c, g, or t
  misc_feature (139)..(139): n is a, c, g, or t
  misc_feature (149)..(149): n is a, c, g, or t
  misc_feature (166)..(166): n is a, c, g, or t
  misc_feature (169)..(169): n is a, c, g, or t
  misc_feature (181)..(181): n is a, c, g, or t
  misc_feature (186)..(186): n is a, c, g, or t
  misc_feature (191)..(191): n is a, c, g, or t
  misc_feature (200)..(200): n is a, c, g, or t
  misc_feature (234)..(234): n is a, c, g, or t
  misc_feature (268)..(268): n is a, c, g, or t
  misc_feature (406)..(406): n is a, c, g, or t
cttgagttcaggagttcgagaccaccctggccaatatgtgaaaccccatctctactaaaaatacnacaaagttagccgggcgtggtngcaggcgtctgtaatcccagctgcttgggacgctgaggcaggngaatcaccngacccctggnggtggcggctgcagtgngcncagcccatgccncggcnccccngcctgggcnacaaaagcgacacttcgcctcaaaaaaaaaaaanaaacacatagaattggatcctttggtcgggttcncccaaattcttttgaggtgtccatggtcaactgcttcagctttgttttggcaaccccctgcccgaagtcgcatataggctgttcttcaccttgtttccaaggctgaggaacagaaagtagcctctgttttgaggaggnggaagttaagtatacatttattttttactgtgacttgttcaggaccacattttacaaaaagccttggttccctcattggtactggaaaggaaagttctaataaaaattgttaaactttggaatatagaaaaagtttttttaaataagggcttaattttgaaaaaaaatctggggttaaattcaaaaggaatgcccaaaaacccttccaaaagtaaggggaaatatttcaaaaaacaggtttgttggggaaaccaaaagggccttaa

SEQ ID NO: 583018 - DNA, 867 bp, Homo sapiens
gctacacacatgcggtatataggttatatctctggttgaatccctcgaacaatagacagtgaacctttcgcccccctttgtcatggaccatttgattggtctgccatttgcagagaactaagtatgaccgatcctatctcagatcttaataaaaagaaaataaaaaaacgcattcagggttaaatttgggccttaatatacacaatatactggttacgcaagcgtgtgtgacacgagagtggggaaagctacatcattgaatatttggataagactttaccgactggagttgggttaatttttcccttttcctaaattaactagcaactgactgtaatttatttccctgtttcacgtctctcccttccattctgcaggagttttacgctattgagatcgtggaccatcagttcggcccttggtagagagtggtttctggactctaaacctgttttatcagaaaatttggttttcttggatcttagctggaaaaatctgccaactttacacagtatttacttggtttggacccacagaatatagcacgtgtgtgcaacactgttcgattcaagcgaaactttaaaaaaagacaacgaaactactggaggagcttagtaacttgctgtttctgtacgtaagttgtttattcttcccaagcacatctaagggtctgccagtttcctaatgggcatgtgtaggctggtctgtgcattgagaattctaaaccagtttaacccttagggagaatccttgtgttggagtttcctatctcccggaactgtcctcacaattgtgaccacgttttatgataacactcccgtatgtattttcaacatacctttttttaatgggcgcttaaagccagag

SEQ ID NO: 583019 - DNA, 117 bp, Homo sapiens
cttctctgttgagctgccccactggcaatattttcacaatttctctaataaatctgcccttctttacctacaactatcttggtatatggctttaccacctgcaaaactgaccctagg

SEQ ID NO: 583020 - DNA, 1414 bp, Homo sapiens
gccgcaataaaactctatactctctatactaaatctccctatcaaatctccttaattataacattcacagtcaccagaatgtatgtcaatattctgatattcttccttcggaagaccagcactgtatccccaaccttggcctatacagtcacaccgcactgaggcaagccagtacagcaacgaccatggacaccgcaggcgacatacttaccctacttcgtacaaccacttcaatacggactaccctatacacccatagcgtcagtcgtcaactacagtttaccattcacacacaacgcgtaggcctcaactaatacattactatgtcactctactctacaacctgtcgcgaaggaagcgtactcaatacttaccgtgagtcacatacacatcgtataattagtgaacctactgcatatacactaaggtagacttaatcactacgcctgacatgtactaaccgtccttgtaccggaggctcctcactatcatggcacttctcgcttcatacacgccgctagtagtcccgaaaggcgcactccaaatcagcgtaggggtcccaactaagtacatttggaccagcacagttaacgtcattctcaagacacatcaggcgcatggactatatgggtcactaagtaactgtcaccgttctagcaagctgtcgaagtctctttcaaagagcacgcgcactatgtatccacagagtaggaaagcattatgggccccataagcccgctcgtattcccggttatgtttaccttaatgttcccccgttaactgaacgtggccagtacatcttatagtacatctaccaggtcgatctcaggtccatggcccgttaacggaaagcagaacctaggaaacccttaggcataattcgcctttcgaatatggtcaataaccttccgtgttcaaaatcccaaggcgccaccatttaaggcgcgcttcgttaagttaacaccaagtgccagtattctgccaattccccaaacaatgtcccccactgcgatagtctgtttaccacccagaggcgccaaagtgaccagtctcccttcacagggtgaacaagttccggtgcttctccgcatgggggaagacccttagtaagccatgttcgccctttctaaatgtaacgcgtaaaatgttcactgggcgcccttaatgttcgcaaaactgagttccaagagaatctgtaacatggacaaatagggggcccggcgttcgcccccaaggggattcgggtccgattactataatactctctccctcgtctcgctgcatatccccacgcgcgtagacgtatctacaacaacaccatagttataccatgtcccacatctcgatgagtacagcccctattagtgatgtaattgagacccctatcacttcagggcgaaagacaccccactga

SEQ ID NO: 583021 - DNA, 764 bp, Homo sapiens
tcatgatgcattcaatgaagttcatatccatgaattcactcctaatataccctaataaagtggttgatcacctacattatctgtctataagaaactgccttgcactgacaatgtaaattattttaagcataaattttcctaatagtttattagagctactaatggcaaaattcatgtcttcaatgtggccataacataggtctgggaggggtggtgagaaaataaggtatttacttgtagtagttaagtgattctgaggacaattagaaacagactataaaactcaactacactgtaatcaatagacaactattggaaatatggcatatgttgacaaacacttaactagggaaatcaaagatataaatcatgtttataaaaaattaggcacgcaatcatgtgattcatgcttcaagaaaatatatgaaaaaagtgttactccattatgttataaactagcagattttccctatttgaaatgcatgtaaacgggctcgtgtgattctgaaatggtactgtatccttggtatttacttatatggtcaaatacttgtcttgtaaacagtgatgggttctgatacctgttgatcaacacataagatacaaagcttcagaaaatgggtaaagtgcaaagccagtttaacgtccgtgaatccattgatgggtgttcctccaggccacaagcatgcccagcaagagcttagacttacacgattccggaccggggaacgtcttcaccaaaacgtgacgttttcacgcagggc

SEQ ID NO: 583022 - DNA, 1530 bp, Homo sapiens
atctttagtgaagagcctcactggtccaaaccatcactccttgtagtgtcgagcccagtgtgatcatccattgtagaatgtcaaaggccgaaagattctacatgaccaaggcagggtatcccagcctggaccgagctgcgatcgtgactcatttgccgcgcagaacagtcgtggacggatggctcgacactcatctcagcagtacagacatcacagacaagagctccatcccttgtcaccctgagtgtttgcagccttgctgaggctggacattcattgatgctcttcgtctccggcgcagcattgcgccgagcataatacttactgacgacaacgatgactctgccgcgacaacgctgcgtcatgcgtcgcacgttcatcgcctcggtgacttgctcatagtctgcccgcaacgaacgaacgctgctgtggtcacacccaaccacaccatgcaggtcccagatgaaggaatggctcaaaacgtacgaaggctgggtatcctctatacccttgcacatcggccaagactcttcgcttgtctcgcaaggttcgcccccgggtgcgtcccacttgggcaagaccctaccaaatatagcagtttgttcgctcttttacaattggcacctcggccaggtcagcgcaagacaactatacacatagacaacaaaaagggctgcgggccacgtctcctacacgagtttaactacgtcttgcgatcagcggcgcgacccccaggagattcacaccgacgagtgttaacccccccacggctctaatctgcttgcgctctcacaaaccgcgacaggagttccacacatcactaccgctcgcgaacagatcgccatcatttccactccacccccctgacgtcaaccccgctcaggcccctcgcgacgcagttctcactcgcacacaccgcgcctacgcgccagccacccgtgggcccacaacattcgcctcgccccacaccctctctgcagcgccagtcccattcccgctgacaaacccgcagaccagcctccacctggcccttgccgagccctgcttgaacccctctacccgctgcagcccgccatccttcacccctacccgaacacccatttaccaaacagagcttcctacgcgtggcaccctttcatcaccaaagccttcacacgcgcggccacacaaccgcgcgcccccccccaggcaccgcgccagacaatccccgcgccgggacccacgaacaacgctccggcacacacccccccccgcgccctcccgcaacccacttctttatcaccgacccacccactatcataacaacccccccaccccacacccccccccctcccccccaccataccacaccacccaccccctaccaacaatcaatcaccactaactccctcccaccccacccacaccccacaaacccaacccacccccaccccaccctcctccacccaccctcctcaccaccccactcccccctccttcaacatcacactcaccacactcacccaccgcacaccccaccccccccacccc

SEQ ID NO: 583023 - DNA, 1246 bp, Homo sapiens
taaaaaaaaacaaaatttgaaaccctttcccattttgtgaaattcacaaaaataaattatttcgggaatttccgggcctgtctccctttcacggggtttcattatacggggcggggagggaggaaacagttctcggaaaattcagagtggtgccaaaagccgagttcccataaaccccagtgtggattttttttattttattatttttgttttttctctccacattttcgcgtgggcggcggggcggtgggtgggacacacaaaccatctggggcgctcccccggggggaggagaggcgccaaaaaacaaaaacacacccctcctcagaggcggcggccgccgtgggggctgagagaaaccccgcgccctagacaaacaaaatttctcttccagcaaaatcagaggctccccaccccgcaggaagagagaggggcgtcatggctcccacgagaggaggcgcctacagagggaggcaccgcgcgcacaagagacaactggggcgagccagcggagacacgtacgcccctgtatagggcgccccctctctacctaagagaaacacaaagcggcgcgccgccccccccgaggagggagttttcacgcgagaacacacgcgcgaagagagacccacaccgggggcgagtctatgaggggggaccactgtggaataaagcgcgcccccccacaagaaggggcggggaagacattttgccgcgcgcaaccacctggtaacgccgccccccacagctctcttacttggccccaccgccgccgacctactagaagaaaggagcccctacccgaccagagacaccacaagactcgcgtagacctacatagcgaaggaccaaacaaccacacaccccaccacggaggaagcccgcgagcgagacatcaccaacaaaaagcgggggcgccccaaccgacgctaccatgtgggagctgccacgacccagagaacaaccaatcatgcgcccactcttcaacaaacaacaacatacatagcatccgctttgtcgctataatctatttactgtctttttgtcacaacactcaacattgtgcgtgatatcaccccaccaacacacactccgaatcatccttatactcaacacacaccaacacattctcctcgatcaacaccctgccacctctcccatactatttgagtgtctcatcggtccacaccaccaccactataaaatcatctaccaactcaacgttgattttgtctatctcccacat

SEQ ID NO: 583024 - DNA, 1243 bp, Homo sapiens
ggtggtcgtgtagagtgtgctgacaggggtggatgccgcgcttgcctcagcctggcctcacccctcccgcccgggacagggtggctggagcgctgctccgctccgccagctgcgagtgggagcgagggagggcctggtccctggacggtctgccgccagctgcgagtggaagtgagcgagggctacgtccccggaccgtctgggccagggggtaccggcggcagcagactggtgtaccgatgtgcgggcaaaacaacaatgctcctgtaaccggagggggccccccgccagagcccctgtgtcggcagccggggcctgacgggacgtggcgcgggccctgtggggaagggcccatgcaggccctatccggtggactcccgccctgacggcacgaattgaagccccaccggataacattcgcaggatgcaaacttcaaagacaggacacacaaacagcagatacccattcgagatggcccatcagacagggagacttgctaagaaatacagtggcttgagtaagagtcgcaagaactgtacttcttgcccaaggggaacaggggatccttatactacgcattggtctggaggcgcagggatcaaaaggaccactacaccctctttcggctcagggaaccgtcgtaagcccggactgattggaattgactgggcatgaacacccgatcaacttcgcacgcctagcaacctgcacaatgactcacagaagtaggaaacattaggctcatacattgagcagcggcccagcaggcacatggcacgcgaccacgacgcacaacaagggagacatccgcgccaaacagggcggagcgaagtggacggggaaaggccatggggaagggaaatacacgggcacaatagctcatgggacggggaggagcccaacacgccgcacggcgcgaggaaggggtcacacgtcccaacgagggcgagagacacatgcccagagcgagaaagcagagacacacacgcagagacaagaggacaaacgaacaccaggggaacgctaagaacacaccgagaacacaactacagagaagcaagtagatggaacacagaggaccaggagaggaagaaaaaacacacaagccacaggacaaataagcagtgcacgacaaggccaagaacacagaacaccaaaaaaccgaacgcaagccacaagagacaaccagaaaagagacgcaacgaagggcagcgaacgacagagcgacgggaacgccaaaaa

SEQ ID NO: 583025 - DNA, 315 bp, Homo sapiens
gctcgacgtcagcgccaccggaggccatgccaccggaggcctcgaactgtggaaacaggcggggctgggccatgtgcgcctgctcaatacctacggcccgacggaaaccaccatcaccgccagttacctggagtgtgacgcttatgttcgcggcgaattgcccaagccgtcgtcgatgccgatcggtcggccgctgggtggcggcgcatgtatatcctcgacagcgatttcaccccggcggtccagggcgccacgggcgagttgctgatcggcggtgcttgctggcccggggttatcacggccgtcgacgcggcg

SEQ ID NO: 583026 - DNA, 305 bp, Homo sapiens
tcgatcgagccggtacccctagtttagaagttcactaggataatggctgcaggtctatccatgtctggggcaatgacaggagagctacttgttagaggctaaataagtattctaattatctatctatagagtctctctatgtcacagtttctttatccattggcccattgatgaacacctaggttgtgtctgtatcttgactatggtgaattgtgctgcaataaactggggagtgcagagataatctcattcccttgggggatatacccagaagagggattgctattgaaacttctaaaactagg

SEQ ID NO: 583027 - DNA, 82 bp, Homo sapiens
catggaatttgctggtgcagtacaactaggcttatagggacatgtccctattagcttgaattcgagcttctaacgttagaag

SEQ ID NO: 583028 - DNA, 113 bp, Homo sapiens
tattgagtgctccgggtgggagtggtaaagctcatgtgcaacaggaagttgtattcagcaaggtccagtgaaatgatccagcagaatctggcagacatctgtgggtgaatgtg

SEQ ID NO: 583029 - DNA, 101 bp, Homo sapiens
actaggcgaagactgtggggcgtacctcctcacgctgcggctgtcgcccgtatccgagcgctcgcgcacagtcttcccctgatccacagtcttcgcctgat

SEQ ID NO: 583030 - DNA, 325 bp, Homo sapiens
aagataggacatgacctaaccccctggaacctggaaacaggactttgtttgctgaaaaagtctttgaagatgtgatttaagggttagggatgagatcatcctggattagggtgggtccaaaatccaatgacaggtcacttctgagagacagaagaggagacacagacacagaggaggaggccatggggagacagaggcagagactggagtagatggggccacaagcccagggacgcctggagcccccaggagctgggagaggctggagggatcctcccttagagcctcccagaaggaactggatacaattgaaccggatagcttg

SEQ ID NO: 583031 - DNA, 130 bp, Homo sapiens
gctgcaggctgttctagaggatcccaatgcagtggaatcggagggaagtagcaataaataacatggacagacagagctccctccagacagatgagggtaaaggaggttagagaggagcgtaatgatgggc

SEQ ID NO: 583032 - DNA, 408 bp, Homo sapiens
ttggcactataagggaggttatgtcaaagagttgaatattggacttacagatttcacaagtcaagtggtttccagggctaacaatctagtcctcctttggggagtagattggtgatttagggaattgttggagtcacgaagattaagaagacgtatgactagctcttggattgatgcggaagctatccagagatgattgactcatagggtagtatgtgaaagggtcctacatgcacactagttgtcacacagtcggcattgagttgttgcttgaacctgaaccatgtgatctacgacagagtatataacgtagcactatcaagccatcagctgcctcgagagtgacgtgcattctgcgcaatgttcgaaccatctcttccttgactccgttatgttgtgctgccttcc

SEQ ID NO: 583033 - DNA, 267 bp, Homo sapiens
ttcttggtcttcttgaaggcactgacttcttgggttcgtcgctcttggtagccggaaggccccgatggctccacccctttgtctgcttgaggacaccggtggtacccaggcgcttgatggacaacttgatctgcgagtcagcgttctcacccaccttgtagtgcctcttgatatacttctgaatggactggcgcgaggcgccagccgcggttctttctcgggcctggattgcagccaccgacatgttcggggtaccgaggctcgaat

SEQ ID NO: 583034 - DNA, 727 bp, Homo sapiens
tccccaaaaaaggtttttttttttttccaaaaaccggaaaaaaaaaaccaaaaaggggccccccgggggggcaccaatttgtggttacccccccccaaaaagagagcggggagagagggtgcccccaatctctccttgtgtggtgcattgcgcgcccccttgctcacttatggttgtgcactcttcttgaggggcgagtcccccactgtccctgtgaagcggtgttatcgtgcagccccactctgtgtctcgtcccacactcttctttcccccaaataatttttttgttgggggcgggggcattcgtggtgcaacaacaagcggggcaccatgggggatcaacactttggggcgtctggtacccacacctcaatgtacggtgttgttctaaaacagtggtacctctctgacacaaaaacccacccctagttctccaacaaggtttttgtgcaaccacgagaaaattgggtcccccacactctgggggcgccgtgaagagacaacagggggtgggttggcgaaccggcctgggggagccctcttgtgtgtggtgtgcccccttgtcggggggggcaacgtgtcgactgggggacaccaatcttgtgtttggggtactgccccgtccccccttggggttgggcccccagggcacttttggccacgacgtgtagaaaaggtgctgctcttcccccccacattttttcctaaaccccgggcgggggacgcg

SEQ ID NO: 583035 - DNA, 653 bp, Homo sapiens
  misc_feature (528)..(528): n is a, c, g, or t
  misc_feature (560)..(560): n is a, c, g, or t
ctggcgtcatgcttcctcagtgccaggtcagggtttggtccctcttctaggggtggtttcattctttatcctgaagtgaggtggaagtctagccacaacggctggacattggagaacactgacgcgtagggacatacgacagtgtctccttaggttgatatttaatgatacaccttgtgagatgtaccctgggaatattgatatgtaatgatatattttaatgacataccttgtcagatgtgccctgggaatagttgctcattccacagtttccgcttgtttcgcagctgcgctgaacctgctcccttggccgccttggatgcaggtttgtccccagcctccatctccttcacagctaccctgccgcgtgctgggaaggagaacaggactggagcgaagcctttctggtttggcagaggccttgtggaggaggtagaggctggggatgagcctgcacatgaagcagccctgtcgcagttctgaagggcagtgtgctgtgtttcctttctagcccccacgagataattntttatatactttcatttttttaatggattgcngtttcgctattgttgcccagcttgactttgactccttggctcgcaggtcttcctctcagccctctgagtgtcttggactacaggtgcacaccc

SEQ ID NO: 583036 - DNA, 629 bp, Homo sapiens
gatcagctcgtacctattagacacatcagaaagtgacaggacagcccgtaaataagaacaaatattttcaaagcacacatctgataaggaactcacatccagaatgtgagaactcaacaataaaagacaagtttaaaaggacaatttaaaatgggcaaatagtgttggttttgcaacaatgtaaatgtactgttcacagtatatatacattttgatgtaacaaatagtaagttttgttatatatatttaaccctaattttaaaaataaatttttttaaatgggcaaacatttcagtaggcatttctacaaggaagatacccaaatggtcaacaagcacatgaaaagatacttaacattatttgtcattagggaaatgcaaagcaaaaccataatgaaataccacttcacacccaccaagaaattgaaaccctcatacattacttgtggtagtgtaaaatggtgtaactgctttggaaaacagtctggcagttcctcaaaatgttaaacatagaattagcgtatgacccagcgatttcactcctaggtaaatacccaagagaaatgaaaatatatgtccactcaaaaacttgcattcaaatgttcatagcagcattatttatactagcca

SEQ ID NO: 583037 - DNA, 500 bp, Homo sapiens
gttattttccaaaggcaaactaattcatactcctacgtgaacatccttttaacacaggcttaggcacagtacgtccaattaatttaaaattggtgaataacgcctgttggccacaaattttttggttttccaccctttacctggaaaaaggagggggcctgtcttccagttttttccttctggacttccctgtgtgtcactttacaaattaaataatgctagctgttaacatctacatagcagttgacatgtgccaggcctgtttaccagttaatcttctccatgatcctatgaggaaagtgctattgctgtctccatttcatagatgaggaaaatgaggcacagaggagacgttatgtagccactaccactgcaacttgctcaaacttccggccaagtcggctctagtccagacagcctgactcctcagcctgcgtctgtatgctgcctctcctaattcattatgtttattaataatttttccccgttttgttaacact

SEQ ID NO: 583038 - DNA, 160 bp, Homo sapiens
cgctgattctgagtcatgcgccaggctcgggtaggcacaggcgtacactccagatgtgctgcgtgcttgtgagactgcctgttcagggaccagcccctgtggctcttccaccaagtatttggtagagggtccccctcatgcctctacacagacagcccct

SEQ ID NO: 583039 - DNA, 154 bp, Homo sapiens
  misc_feature (54)..(54): n is a, c, g, or t
  misc_feature (62)..(63): n is a, c, g, or t
  misc_feature (125)..(125): n is a, c, g, or t
gacgtatatcctaacgcagagcagtatatctataactactcatacgagactccnccttcttnntaatttcttcttttctgttagtatgatatatcaaaatgcgggatcttttccctgccatctgncagagttagaattgtacaaaaggacagtc

SEQ ID NO: 583040 - DNA, 100 bp, Homo sapiens
tgacccatgcacattgtatcaggtgtaaacattaacaaaatatatagtacacttagcatacttagcctaccaacatcgggtctaagtactagagcacact

SEQ ID NO: 583041 - DNA, 1288 bp, Homo sapiens
gccgaggctggcggacactcagctgatgcttggagtcgggctgatctgtgaccatctttccaccgtagcaaaaggacacaaatggagaagcttctgctgggctgtggtgttatccttccacgacagccacattacacggaaccctgctgctgagaaaactgctgcctctacacgatgacaacaacactctctccagtccctctctgctccttctggctcacgtaccagaaccaacactggccttcttacctactcaccaaccaacttgcacactctatccacgacttcttcctccactatctctgaacaacacgcgtgcaccctcacttcttcccctactctcgctcccctgaccccgcccccacacgcactatcttaaacccacacggagcgacacgctatgccatgtcccttccaccctaagcgcacctatctgctgttacgacgctcctcagccatttttggtttgaccccaaaggccttggaacgcctgccacgactgcgcgcgccgaactcctctgaggccatccaccgtgcgcaaaccacctccatgagcacgtcaccttggtggctctccaaacagtcgcaattctacctccgtactgccccccctccaaagcagccctctccccgcaaggttaactacccttgcaacggcaagtctcacccacacgaagaccttgtgctcagccccttgcaaacgatacgaactggtcgcgcacagccctcccaaggcagtgttcaaacagaaagttggacattgtcgcacggcaagcacatccacgttcccatttgggccccacggctgcatccattccagccacaacacgaggcggtccaattagtttgcgccacgaaagtgttggcacacccaacaaccagccgatgcacacatccctctctgcccccctttcacactaaacctaggactactaccctcggaatctgccccccccgcaccacgtaaggtggcccaattagccccatagaggccccactgagcagcaatgtcccaaattagacacaaaccgacaaccccttaggctcaaattccccctcacacgactacatatgtcgaaacaacgctgggaccaacacagcctctgggaccaaattgactcacctaacgagaaacagacaagcgcgccgccaccctactcaaactatgaccgacacatacagcctcgaaaacccacatcgcatacacatccctggcggtcgcagccaccgttgatcatatccgtcgcagacccccccacacgcgaacgctcccctacgcaagcgcccg

SEQ ID NO: 583042 - DNA, 147 bp, Homo sapiens
cgtgatgtcgcttcgacgtcacacgtcaccctgcacgccgacgccatcaccgcggagggggccagatcatccccgcagcacggcgctgcctctacgccagtgtgctgaccgcccagctcacgcctcatggagcccatcttccttgtt

SEQ ID NO: 583043 - DNA, 685 bp, Homo sapiens
aggctcgggatgtggcgcttgtgtggttgggtgcgtgaaagattgtgggccccctggtggatgggccggccggcctcgctgtggctggggcactgttgggcggcgctcgcgctgaggggcgcctctgttgtgatgccctgtcggtgtttgccccccgcagtcgtcgggatgggggtgcgctgcgccctcgcatccgcgtcgtgggggtaacgagcgactgctgtgtgatctgccgctgcaagtggtgctgggggggcgggcgggagcctgtggtaggcgtcgcggcgcgccggccggggggagccgtcgtcgcgccgggggtcgcacgcgctgtctgtcaggcgctttgcgcgtctctgggcctcgcgccgccgttcttcgctgcagtcactcgtgtggtgttctcctctgccggtgtcagtcccccctcgaatttgctcgctcgcgagtgagcccgcgtcactcccccccgcgcttcatgcccgttcgtacagagagcggagcggcccagggtacgactctcgtcgagtgagcggatgctgcagcttactcacgtggccgtctacgtcctcgggccgccacgccccgcaccgagccgaggctgcagccgatgttcatgagatgtcgatggaacccggaccggcagaacattcagtataacataccttatccgccgttatcaact

SEQ ID NO: 583044 - DNA, 236 bp, Homo sapiens
cgtgaattcccggcgtcgagccacgcgtccgactatctgtacttataacgtggttcccctctctcagcgaactggtgttcgtgaatggtgcacaggaactgtccccattggtcaatttcttgtcaacaatgaagatggtgctcataaaatatacaggccaaatgatttcagtgcctttcactgccaaaagaaaatgatggaggtgcaaaaaaagtcttttgaagacaaatatgaag

SEQ ID NO: 583045 - DNA, 879 bp, Homo sapiens
ggagcaacgctaggaatgggcgggcagaaaggtgcacgctcttgtgaggtgactacaggttaggagaccgttgaacctggaggggccctaggatggagcccgtggaaagattcagagactgcgccctctccctggcgccgcttcccctacacgcggcgggtatattctcgttgcagttggcccaggacctgttttcaagactctgccccctcgcacattcctgtccctcctggtttcgtaaacgtgatgctcatagtgaacccccaacccgagtgacaactactcgcagctcctggctgacttctagatcttctgtgttgaatgctgcgcctttagatgacacgaacctaactacccctgttaccagcggatgcccgggcctggagcccacagaattcttccagtccctgggtggggacggcagaaaggaaccgttcagattgacgatgtgccatggcaccacaccaactgctcgccttcaagttccagcatggagttgattgcagcagcttggattctcggcgcctcagctgggtcctacattagtgccttacggggtgaacaacggtgattgaggattaacccttcacctgctatgtgcaccagtgtatggatgtgcaagcagactgtcaaggtacttgggaagcgccatgctgggcacagggaattgcatgcgttgtacactactcctgacgcacattggaaggaatcgttgcttccacagctggccccggaagccctcaacggctgctgtcccaccattgattgctgccaagtaccgggggcaatggtgcccccctcatattatacgcagtcattgatcttgtggcttggcgatcatcgccgggtccggagcactaccacctacgttgaattacc

SEQ ID NO: 583046 - DNA, 1011 bp, Homo sapiens
aatccttgtcacgtgaacgatcctcggtggtgcaggtcaattgtgctctcggtctccactctgcttggtcgagccatggtgcgaactatgagtgagacaaagtgacgagcaatttgggagggtgctcgggtggtctggacccgcaagtaaagggggctgggtgtcgttccgacctctgagcaccggaagtgctgccagtcaggtacggtcaaggaaaggctgagagtttgctattgcggtgagaggacactcgcgtatgcatgcgcggaagcgtcccacagtgtggccccgggaccttgcgtgaattgcttgagaccttgtgcccctagatgattctagagctgagcagacatctgtgtgctctgttgagtgcttgtacaactgtggtcttcgaaggcataatagcagccaagacgtaaacaggcatcgtcactctgtgcataggcgtgtagtcaacgtcgagcaactagatcctttaattggagttggcaccgtgctctctgtggctatgcgttcggacctcaatcgtgtccgtccgttgggcgatcgtccggcatattgctttagaagtgtcaatcattggaacgtcaaatggtggtgccgttcctacgagacgtcgatttggtccgccactcggcatttagtctgacccaagttttggagtcgtcccgtttgatgcgcgttccaaggtgccggtacgtcttgcggcagctatgacgacgtgcggtctccagtagctgactcgtgtcccttggcgtgcgctgtcccagagtacgcgcggctggttgcgcccgtataatgcgacataacgtgggcgagggcctgggttgaacccggttcgttggtttgccgtgctatcttaccccggttgtttgtcgttcggggattttgcgtagagttgttccggtttgtcccacgttctgctttggcgggggcgaactggagtgcgcgcaggggcccccttggcgctgtgacaaggcgggggcttgtggcagccgccacccattgttt

SEQ ID NO: 583047 - DNA, 705 bp, Homo sapiens
agaagcggtctccttctcttccaagcatttctatcttttacatacctactgtacgaggcagagggggtaaacagtgggagggacctgaaagagtagagaagaagaaaacattgttatgagctatgtttaatagccaacgcatgtagggttggccaggtagtacgacagccccgggaagccggggccgtcttcctagtcccccccacgcgccgcgcggaacgcgtggatcgaagaagaagaatcattgtgaaagcatttgaagtgcaacgtcatgaccgcttctggccccgcgtaccacagcgcgaaaagagtctgcggcggaaaacaacgaccagtacaaaaagagggtcgcaaccagaaccgaacgataagacgtacggcattgagtaaaacatgggtttgtgtgcgccctacctccacggccatcctttcacaaataggaatacgagaccaaacgctcccgtgtagagtgaacgacgaggggatgatgacacggaaggtgaaaaagaattttgcttccccctccctccgtgattgtcaagggcgctatatggatgaaggaactctagaacgcgaatacaatatagctttcttcaccctctgccgccacacgctcacaggcacaaaggacgagtataacgctcctacaactacatacataccgctcacgtcgggcagacgagaagcgtgtgcggagtaggtaat

SEQ ID NO: 583048 - DNA, 770 bp, Homo sapiens
acagattctagctattcctatcaaagtatcaacattatttacagaattagaaaaaaacctattttaaaattcatgtggaaccaaaaaaatggcctgaatagccaaagcaatcctaagcaaaaagaacgaagctggaggcatcacactacctgactttaaactatactacgaggcaacagctaccaaaacagtacagtactggtacaaaaacagggatatagaccaatggaacaggttagagaacctagaaataaagccacacacctacaaccatttgatctctgacaaagtcaacaaaaacaagcaacaaagaaagggctccctattcgataaatgatgctgcaatagctggctagtcatatgcagaagattcaaactgaatcccttcttttcatcatatacaaaaattaactcaagattgattaaagacttaaatataaaacctaaaactataaaaactctagacgaaaacctaggaaatgccattttggacataggctctggcaaagattttatgacaatgattccaaaagcaattgcaacaaaaacaaaaattgacaaatgagacccaattaaactaaagagcttctgcacatcaaaagaaagtatcagagtaaccaagctacagagtaggagacccctatttgcaaactacacctctgacagttggtctaatattccagaatctataagtaacttaacaagcaaaaaaaaaatcttcattacataatgggtacacggacctgagcagacacttcttctaaagaaga

SEQ ID NO: 583049 - DNA, 269 bp, Homo sapiens
gctgttcagaggatcccacaaaacatgatacatacctcgggataatcacatgagtatgctagatctaggctacgggttcgatttgaagtatgttccagcttttgtgttcttcgagtcgatcccttatgtgatagtcccgaggtatgtatcatgttttgtttacttcgggatctatgtgcgagcatggtaggaaatggatagaaactacttaggatagatgtcattgtacctacgtgcttgggaatcgtagagcataacaccacacaatt

SEQ ID NO: 583050 - DNA, 251 bp, Homo sapiens
caagggtttgtgggagcttaggaagggcttcctggaggaggcggccattgagctggaagatggatgggaggtggacggggaagagaatggcacctggcgggctagggatactttgcttgtgaggtacgggtgcaaaagtccatggagtgcctgacggggtgagccaatttacttggataacatcatcgggtcattgaaactttgtgtgtgtgtgtgagagtgtctgtgtgtatatgatcgctctttgggac

SEQ ID NO: 583051 - DNA, 133 bp, Homo sapiens
gaagtcactcccgatatatatcagtaaagtgttatatgatacatgtcagcacgtgtacttttcatttggtagaaacatattcacgttcatgcataagacggcatataactgttagcaagattaatcctttttt

SEQ ID NO: 583052 - DNA, 889 bp, Homo sapiens
  misc_feature (151)..(151): n is a, c, g, or t
  misc_feature (196)..(196): n is a, c, g, or t
ggtgcactgtgggaaagagcttgtcgctgcggtgttgctgttggagactcgattgtggtgacagcgaaagaacgataacaaaatgccggagcgagatagtgagccgttctccaaaccctttggcccccgatgggccacgatgtggatgatnctcactccttccaccaatcaaaactcaccaatgaagacttcaggnaacttctcatgaccccagggtgcacctacctctgcaccaacttctaagtcacgtcaccatgagatgccaagggagtacaatgaggatgaagacccagctgcacgaaggcaggacacacacgaaagagttattatgccaagctaggccaaacaaagaaatgagagagagagagagctagcagagaagtaccgggatcgtgccaaggacacgggcgagatggcgtgaaccacagcttatgaagaaaccgagctaatcagaccaagtaaactatagggctgtgggccccactggtgaggcggacaaatcaggtgcagagaagagacgacagttgatccaggagtcccaattctgggtggtgcattgcacacacccatttggttggaaggctgggattggctctggttcaaaaggtacgaggctgagattgcagccaagagaaagaggagcaggaactgatgcgaagccagaaagaaacaggaagatggggctctgcaaataatggttttcaacacgttggcggaaggtacgaagctttagagcaagcttgacggaagagtttcatgcgggagatgcatagtgtaactggtaggttttgcaagttcacattatggaggtttgccagggcgactgccatttgttggggcattttcggggcgagaggaagggcaccgggtttagtgtcaccacaggggg

SEQ ID NO: 583053 - DNA, 481 bp, Homo sapiens
gaagcgccgcgcgcatcctcggttcccgccgcgccgttgccgccgctcctctccctcctcacctccccgcaagctgagggagccgcctctggccttgtgccagcccagaaaggggctcccacagtgcagcggtgagctgaagggttcctcaatgctgcggccagaggtgggcgccaaggccgaggaggcgcccagagccagcgagggcttgccagcaagcttgtcacctctcaataggaaacttggtaaccaaacctacttacgaaagcaagttattctgttcttaacctggaaacctgggggcaaaaaccaacatgaactgttcgtctatctataatcgctccattattctttttacccctcatggcattgaaaacaaaattcttcaccaggcaacacacaaggacatgttaaacgcaaaaggaacgccagcacctttacctactcagcgggagggccacccctcaacggaggccatttg

SEQ ID NO: 583054 - DNA, 121 bp, Homo sapiens
caggtagccacggatgttctgggtgttgggcggcggctgcaccggcgacgcttcgtgcagcgtccagtagtacgcggcctcttcgcgcagggcagcgcccaccaggctgtgcttgatcacc

SEQ ID NO: 583055 - DNA, 381 bp, Homo sapiens
ggttttgggtatattcaaaaccagttgagaattgtacaactactaccataattttagaatatttttgtcactccccaaaggaacctgtttgactccccatgactccccattttcccccagttctccctgccctaggcaagtccaagtctattttctgcctctatatatctgcctattttgaactttttacgtaaatggactaatgtattttttgtgtgtgatttgtttccagcataatgttttcagggttcgtctgtgttgtaaccatgtattagcacttcatttttaaaattattgagtaaatgtccattgtcaaatgaatgggtaatctcatgtaccccataaatacatacacctactatgtacccccaaaaattaaaa

SEQ ID NO: 583056 - DNA, 630 bp, Homo sapiens
gggaggctgtgtctgtgttgggtctcgggccggctcggtcctacccagccaccatcacgaccatctgggacggaatgaaggtcgtgtctcactctgtggtctgccacaccgagagtgcaggggtcattgccggagcctttgtgggcatcctcctgtttctcatccccggagggggcaagatccccaagcgaattgggtcaaccagaccagcaggaccaatgagacgtggtacaaagtggaggcccttcagctttgtaaggaagatgagagagagtcggccgttgatggtgcagactgaggctcagtacgtattcctgcatcagtgcatcctgcggttcctccaacagtcagcccaggccccagccgagaaggaagtcccgtatgaggatgtcgaaaacctcatctacgagaacgtggccgccatccaggcccacaagttggaggtctaagtgacgagggggctgggtcggcagcccaggcatcctcaagctctggacacccacttgagcccagattcctggaagagcagagggctgggctcccagactcctgggtgctgtgggaggagggggctggtatcccaaatctggtttccccaggagagagtggtctggtgggcttcagatgagt

SEQ ID NO: 583057 - DNA, 1149 bp, Homo sapiens
ctgagtgagcccggctgaggctgccagtacccggcccggtccgcatttcgccttaccggcttacggtttccctcggcccagcacgccccgggcccgacccagcccatcctgatcacctcgacagtccggactccggactgacacgactactgacagacgcaatgactgatgataggcgctgacgcatacgaccattcagcggcacgaatcgcccgtgaatgttccacgcctgtgacggaccgactgtgcgaagttcatacactgaatccggcatccgacgggtgcggacaactaccatcacgctagtgcttacccgaacggcttctcctgctacacacgacgaatacccactgtcaacatcatgcgacggccgaacatcagcacacatgatgcgaaagacgacgcgacacgacaaactacgtaagcaatcacggtcaaccaacatgggcgtcacaccaggccacgagcaacacacaacgccctacaagcgaccgctaccagcggacaatccaaccgagcgaccattaccacacaggaacgcatatccacttaagcccaaccaaaacacccaaaggcaaacggacatagcaaaacacaccccacgattgggccgtacgatgacaagacacgaaacagaccaccactaccaggccgcacacaccgatcggggagaaacacgcaatcgccacattctcccatccgcggcaactttcggcgtcgcacaaaccagagcaactagcacagacaacagcgagctaaccgacaaactacaggcccatagctacgcaatccccaaccctcccacagcccacccatgcgaatagactcccaccacaccacagcacatacaatacccttacacaaagaagggatacacaacacgcaagacaacacgcggcaccccccacacgacagcgggaaccacccaggacaccacacgatggacggacgatcaacgccctcgaagacgccccccataggacgagcgcccacagacacccaaacacatgtaccaccccccacatccacacacccgctgcagaacgaggcaagttcaggcgccctagccaatgccaaccaaactagagccccattccacccagaacacaaaacccccaacacattcgaagaacccaatacgcccggaaa

SEQ ID NO: 583058 - DNA, 365 bp, Homo sapiens
  misc_feature (32)..(33): n is a, c, g, or t
  misc_feature (60)..(60): n is a, c, g, or t
  misc_feature (79)..(79): n is a, c, g, or t
  misc_feature (247)..(247): n is a, c, g, or t
  misc_feature (312)..(313): n is a, c, g, or t
  misc_feature (318)..(318): n is a, c, g, or t
ggcaccagcctcagcccgaacgacccttggcnntaaacccgtgtccatccacagaccacntcctgctactctgtcggtntggccactgtgcatgtggccagcgctgctgaggcaacggagcggcagctcggtccgccccccggcccgtttcgtggccactgatcggaaacgcggcggcggtggcgagcgctcacctctcgttcgctcgcctggcgcggcctacggcgacgttttccagatccgcctngcagctgccccatagtggtgctgaatgcgagcgcgccatccaccaggccctggtgcagcagggcnnccttncgcgaccggccgtccttcgcctccttccgtgtggtgtccggcggccc

SEQ ID NO: 583059 - DNA, 1063 bp, Homo sapiens
aatcgtggttgtgatgaaggtagctgagcagacacccctcagcggcctctatgtggccaaactgcagtcaaggaggctggtcgttatccccctggatgttgcgtcaacaattgtgctctgagatttgggccccacgagctgagaagtcttgcattcgaactcccatgaggatgtgggacaaagtggcattcagcaggctccactgagatttggtcgcgtaatccagtgttgctgctgggagcagacaaacctacaagagagtgagcttgagagctggggtggtgaaggagcccctaaacatcatcatgtccacgatgcctgatatggattagggccggtgggaacaggcccatttcgccctgttcttcaacaaggagccagtgctgttttgtgccggctccccgtgacctttcgtgccggaaggacatctatagatgaaggtaatgtcgagatgcgggcagccgttgcccgggccaaggatctcagggtggatcgttggaaacccgctttgaataggccaagaaccagaagacaggggtgccgcacggatggactgcaacatcagcttttaacgaaacgattcgctacgtgataaccattcgataccacgggggaaatcccaacagaccgcggagcgaaacacagggccagttgcttgcgcagaacaagccaatttggagtggtgaggcagtgcggttaacattcattccaaggccaccttgggattgcgcagatctgtgcatttgactgggcctctgactcatcggtcacacgaaggacgattcattcgcggacccagattgatggcacagtccatggagcgtttcaaggaaaccaataaaaagggcacgagtggattggggaagaagccaacagagattccagatatcgtgggacttgcggacgatagttgccaatacagaaaaggcaatatagcacacagggccgagtgtaccaatgtttccaaaagaccccataccataagactggtaaacttggcatcggtctcacacgacacagaaaacttaaggcaagccagaggcacccaattgggaggaaaaac

SEQ ID NO: 583060 - DNA, 367 bp, Homo sapiens
ggtgatcttagaggatcccgatagagcaggaggaggctttcgaatgccatcttgacagctgttggtagggatgagccagccattgtggccgtcactgaagtccatacagggtgtgctgtagaccggctgacggtcaccagtatatgcaccggcttcactaggagcgcttcgatgagagcggcatgggcaagggcattccgggatggctggacatctctggacgacagtggctacgtaagcgcctacaacaatgcaggcacctactatgcctaggtgaagaagtgaggcttgggaagaccgccctgcctagtgcggcttcccctgccataggctcaggcctgggtctatggggcgcgttcagcaggag

SEQ ID NO: 583061 - DNA, 238 bp, Homo sapiens
acaacctaggatcagttttgtcaggtggtaagccatttatcaagatagttgtaggtaaagaagggcagatttattagtagaaattgtgataatatgttgcactgggcagctcagcagagtaatgggctacctgcaaaggaggcaatgggctggtaggaaagttttatacgggtcctgactgaacgggtgctacgtagtggactgagtgtcattgctgcccgtcaggtttgtcatgtga

SEQ ID NO: 583062 - DNA, 299 bp, Homo sapiens
gagcagtatctatcatgcatactagcacacactcacacatgtacaccacacccacacacgcactcttgcacacacacacacatgcacacacccccacacacacacacgcactctcgcacgtgcacacatcctctcaatgctctccaccccaccacccctcgaatcccagacccgcattatgacagattgtcgaatgtcctgtgacaacatcgcactctggctactccctgctcacggtgctgcaatactccgaagaggctgaatcacttgagaaccggcaggacattcgaccgcaataa

SEQ ID NO: 583063 - DNA, 296 bp, Homo sapiens
cgttcccaaaccagggtgcagtttcactgtgttaggaatctctttgatataccctatattgtggctgtttatattgacatttcactttatatttcagattagtcatagctatttcctgatgtcgaaagatcatttattcacagaaagagaaacggtttagggaaccttttacaatgcacctgggtcctcatcccaactctgcctgtagggtgccagtggtcttaggcctacaacttaagcctcttaagactcaccaccaacaagcaatgactgggttgattgggttgacgtcaggc

SEQ ID NO: 583064 - DNA, 1061 bp, Homo sapiens
tatgtgtatactagttatgttaaatgctacaaaaccaatgtgaatcccatggaatgcaaaaaacacacattggtcgtagcattaccatcacactcgccatgtcgtatatatatatgtgtatatgattgacaatctctcaaccagatactgtactcccctcacaaaagtcgacaagtccgctacgcttctagctatgaccaccgtcagtgccaatcattatctacttcttcaatattgttgcttgatcttaccgcacgcgatcattccctcaactacaaatcgtactgcatcgtcataccaaccgctccgccacaaacaaacaccacactcaccaacacaccggcccgagcccccccaaaacaacaatcacctcaccgacggcagacaccacaacgacactaccgcgcatcaccacagtattcacaaccgcaccaacagaagcgactccccccaacaacgccaagacaccaccactcacacaactccaaccgagtacccgtcgccccccacccccatcccaccaccacatccctcgtctactgtcctccatccacccccccccgactccgcccactatcctcctcccaacacgccatccttcccccccacctcagcacccgctgcccccccaccaccggcacaccccacctcacccccaccacgacgcagaccagtcaacgacacaacaccaagagcgggaaccagcatcacacgcacacacccaccagcaaccgtcacaccccacgcgcgtgatcgaacatacgctaacttgctcataacctgctactgcccagaccaccagacgcaaacactcgcggcacacacccgagcagcaccgaagaaccgcacgcaacacgctcgaacctcaaaccccgcgacgcgatcagctactaatcacctcggcgccgctgacacacaaccaaaggcaacacacggacaccgatcacaatcatgaaccacactatcgctgacatcaaacaaacgaacatgcagccgcacaaacacacaacacgacgaccctcgaccacctaccgtcgagaaccccacaccgagacaagaac

SEQ ID NO: 583065 - DNA, 273 bp, Homo sapiens
  misc_feature (48)..(48): n is a, c, g, or t
  misc_feature (130)..(130): n is a, c, g, or t
gccatcggactttatcaacgatgccaccgacgtcaacgatgccctggntatgtgacccgcttctaccgcgagcctcgtccggcgctgcaagaagaggctgctgctcttctcagatggcaactcgcagggnccacgcgcttgccatcgagaaggccgtgcaggaagccagcggagggcatcgagatcttcgtggtggtcgtgggccgccagtgaatgagcccacatccgcgtcctggtcaccggcaagacggcccgagtacgacgtggcctacg

SEQ ID NO: 583066 - DNA, 992 bp, Homo sapiens
gatcagtccactgatggcggtctgcaatgtagtctacggttcttcggtcagttcccgttctatcagagacgatattgcacgaagtggcataaaaggactgagcgagggctacaaatttgctcgagtggccatgtcgttgtatgtaccgaagatgaattatagacactttacaatggtgcgcatccgtgcccttgcatttatgcgtgggccatcaaagtatttccttcatcgacaaagccagaactaatatcacgcctgacccatgtcataatgtcgtatccttcattcacccagaatctcctccggccgttgaatctatgtaacaaataataactatcaactggtcttcataattccatcatgaactgggctgtatggccctggaagcttagcgcaagttgtctacgctaaaacatgttccatagatgtccactataggcgatttccacgttggttacttccatacgtaggctatacgagcggtcttttgcattgtttttctccacattggaacaatattgataagctctcccaactacgtccaacccaagtaatggaccaaaatcctttcaactacatttaaattctgaagtgcgaattcttccactactttgcttttcaatcttatcaccctttctagtcatgtgaagaggtgtgggattaaaataatcaccaagtgctaaagtaacaacctttaaagtatacagccatcccatgctgctcatacagtgagctgacaatcgtactgaacctgttattacctatattgtaccccacttaagtttttccgagttctagggagtgctacttgcgtacccacttctttctacttgacatggactgccgttcaaagatccatctggtatctcccacctgaattagggttactacgtagaaccgtgggcaactgtctctgccgaaagagttgctccaaacagtaatttccaaagccatgctgttccccttcttaaaagtgggaccttcaaagagcg

SEQ ID NO: 583067 - DNA, 987 bp, Homo sapiens
ggaataccagtagtgttcgatagcaacgccattgcctactatgtgagcaaggaggagctgcggggcacctactccagaggcggcgagtcccatgtgggtgcagggggtgagcttggctggattccgatatggtgcccccacccagtacctgggtgttccccaccttgggccatcattgggaccgacccataaacaggccagcctgagtaatgccaagaggagggagaggtgaggcggaaattcgtggggcctgcctgggatggcttgactatgacactaccgcatgcacctttatttctgggtgcgcgccgaaacggagctggaccatgggcttgtacatctgcagtggtctgcacccttgtggtggctcgtataagccacgccttctagagcccttccttccccgggcgaggccctttgtccccaatttagctcacaacgcgcgtaggtttgcgctccacgcatggcgattgaacgcgaagacacgcacatgtttcgcgggagactcgttctttggcggtgaagtagaaacctgtgtgagaagatggtctcagtcagctgactaatttgagtgtgcatttagtgccccccatttctgagaggaggaccgcagccacgcgggtggacgcaagtggttcacggggaccgagaagcagaaagcccgcgaggagctagagccgggaacggatgtgaggaaaacacacggcgggctcgacaccgcgggctccatgaatcgaggaagactggactagaactgtaggagcaaaggccgcatggcttgcatggagcccgaaggggcaaaggacgccccattcgcttaagcttagcgccaaggacgtaccctccggtggtagtgagcggcacgtcaacgacgcaaactacacccacatgagggacccacacaccgtgagggccctagaccaaaatacctgggcagcactccgatacagcacgggtaggtcctgctggaccaagtatgcaccggaa

SEQ ID NO: 583068 - DNA, 492 bp, Homo sapiens
aatcaggcaggcactgaacttgtgttctttctgtcttggcctctcaaatgcagccatttgaggtttgtcggaccaggctgggccaggcttcctttttttcccctcccagtacaagaaaagggccttgtgcacgttgggcaagtatctcttgttgttgctgtcatttttaaagactataatagctatggatatgtgtgtgtatacatatattacacatacacacaaacacatatatgtatatattttaattgtgtctagagagttggctcagcagttaagagtacttcttgttcttgcagaagacccaggtttggctcccagtagctacatggtaggaacctacctgggtagctcacaaccaccctcactacacttctaggtgatccaactctctttcatggtccctgcaggcaccaggcacacacatagtacacatacacacatgcaggcaaacactcatatacatgaaaataaaacctatttttaattatt

SEQ ID NO: 583069 - DNA, 1333 bp, Homo sapiens
  misc_feature (392)..(392): n is a, c, g, or t
  misc_feature (1092)..(1092): n is a, c, g, or t
  misc_feature (1098)..(1098): n is a, c, g, or t
  misc_feature (1103)..(1103): n is a, c, g, or t
  misc_feature (1106)..(1106): n is a, c, g, or t
  misc_feature (1112)..(1112): n is a, c, g, or t
  misc_feature (1114)..(1115): n is a, c, g, or t
  misc_feature (1132)..(1132): n is a, c, g, or t
  misc_feature (1135)..(1135): n is a, c, g, or t
  misc_feature (1139)..(1139): n is a, c, g, or t
  misc_feature (1153)..(1153): n is a, c, g, or t
  misc_feature (1159)..(1159): n is a, c, g, or t
  misc_feature (1171)..(1172): n is a, c, g, or t
  misc_feature (1208)..(1208): n is a, c, g, or t
caggttccgggggaggcgaattgatttcacaacggtcgagaaggaggaccccgcccacttcgtcatttctcggaagcccagggactcgccggaagagcggctcaaaagccggaaaaccggcaaatccgagtctcccggcgcatgcgcggcgcaatcggcttcgcgtggttgcagtagagaggatccctccgccagccactgcatccggcggccggatctaacttacccgctagcgttttacccttgcgcggccgtggcgtagggcggtcttttcccttggtcctccgcggcgccgcctcttgtgacgtaagccgcagaatcctctgtcttagttcggctctatgccgcgagcttgactcttcctgggtctgaggaaaagtaaaagtaatttngtcatttcctgaaacttcaagttaaacctttaagctgttcatttcctaaaagggtgaaaacgcgggcacccctcgagctagttcatcgccttttaacctgtgagttctgttaaaaggaagtaactgcaaaatgtcttcgctgttaggtttcttggaagtttgggtgtgttcatgcgttctctcggcgtgtgaactgggagaaagtggagtgccagccatatgaaatgacaactgtatatggaggctgggaagtataatgcgcattctggcttgatgaaattaatgaaattttaattaagtttaattttcatttgaattacccaggaatagcatcttgaaaggcggggcataaaaagcagttaaagagcttcgagaaacggttactcgttttgtaaactaaagaccaaatgaaaatccagctgcactagaaaagaaagaaacttataagggccgaaggttttgtctgcaatttacagctaattagtctcaaagatttctgtgatttgcccaagagaggtggagttggggccactggtttacccaggacaccgccgcggcccgcttgaatactgccgccgttaggacccgccgtacctggccgtccagggcctcttttcttgtcttccactctcacttgtcttttctcccctttccatgtttttggttcctttcctgagtttcccttgtctccactcccctncccctntgttnctntatctntnnaacttctgttttttganggnggancaactttattcccntaaaangcctaggaatannataatttttgtcttttataaggcttgttttcttgtnttgcctgttttttggggggggtgaaaagttcatatgcagatagacataacttcttttggtaaaagctgccctctagtttcttccatagctgatctgtgaaagtaagagtgtgtgtgaatggtgaa

SEQ ID NO: 583070 - DNA, 278 bp, Homo sapiens
cctggtaatactgtagagggagtctagggctgtgattgtatgttgagtcctgatacgtggtagagtcgatctttgtatctgagcagaacgctggttactacgcacagagagcttcgtcccaggtacggttaataggtgtgggggtcaggcgaggttagcgaggctcgtctaaagtcatcctgaagctatgagtgggagtagagttcgaagtccttgaagagaggattatgagtgcgactgtgtagtgcgttcgtcgcaagaagatttcgcaatgagag

SEQ ID NO: 583071 - DNA, 166 bp, Homo sapiens
agacggcttcactatggcaggtgtctcaactctgactcagtaacactgctcagctccacagtgctggataccgggcttgacccacacaccagccagccagaggtactttgaatatacgaaggttcacagcctggcggctagtgagggacctccctagtataagcat

SEQ ID NO: 583072 - DNA, 177 bp, Homo sapiens
  misc_feature (98)..(98): n is a, c, g, or t
ccttacgagagaaacgtcagctcttgtaagagtagcggtgccgacatcgacgcagtggacattaagagcgtgcctccccgctcatccacgccgtgaanacaacagccttagcatgtgcagctgctgctgcagcacggcgccaacgtgaacgcgcaaatgtactccggcagctccgcc

SEQ ID NO: 583073 - DNA, 154 bp, Homo sapiens
agaggatctcggctcccacttggttgcacctcatctgatcgttcataatgattctagtaggagagatggaaagaagtccctgggctttctagctttgcctaaaatgggttgatttcctatgtatagagtagatagatttttcatactctggcaa

SEQ ID NO: 583074 - DNA, 982 bp, Homo sapiens
  misc_feature (318)..(318): n is a, c, g, or t
atgacgtgatggtgtagtgtcaattcttgtaaatgtgcagataatagttctagggacaaaattatcacatttgctcatgcaacagatgcctctccttccggagaagcaatggtgtgcagaaatccattctatcagcacgtagcgccagagaatagctttgcactagctcccctctggatgcgtgcaggcggtacttaacaagatgacatttatctctattatacctttcatgcatgtgtaggggtatacaaatgtcccgtgacaatcaaattttcttgatccttccaatcatgtgtcactgaatgcatgtgcacaaanatgtgctttagagaaggtccttcctcaacttgtagttcataatatctcatgcattttggggttgctatgaagggcttcgcttttgacataactcggtagtaaatggtatatggactgtctccatggccttcagtagcctatggaatctgtctcatactcctagcactacaagaacagaagcggcataaggtgaattaatatggtttaaagagaatttcgtttgtccccttagtggaatgtgggagaatcgcaggagtaaatcctgtggactatgttaggctgggggctgtatgtcgagcgtgtatcatacagtcactcgattgctaaccattaatgcactggagatcaatgtactgccggctctctttccaagttatccactagatttacctgtgttcgaaacctacttatttcttggcaagcgcttgtgtcgtctggctgtcgactcccggcagaagtagcttcgtgcgagctctcactcgggggctggagggactggacacggacctattgggtggcaccatcagcggggggtcggccgcttcccctgttggggccgggggccccaatggggggccagccgccgcggaaggccgcgcctcagggtcggccacaccgtgcccgggccgtctttcccgactgtccccctccggggggccaacct

SEQ ID NO: 583075 - DNA, 347 bp, Homo sapiens
ggaggacagacactgagtgcttggtcctgccgtttgctgtttctgcatggttggaaaggattctgcttgtagattgcttatttcttgctccaaatttataaattaacccatttctttctttagttcaaatagccattaagatattgtagagcttattccttcctcaaattccagctggtttggaggtgggatgcagaggctctgtgtcttagaggatcaattatgtagttgaagaagccaagaaacatacgaaatacaaccctctttttagacgtttccaatttctaaattttaaaagcttttattcccggatgtctcccaagttttatttaaaaaataagcagcct

SEQ ID NO: 583076 - DNA, 131 bp, Homo sapiens
aatgccgggaggcccagcccaagcctctccactaggcctctgccaggatctaagcccatgagcacagggacatggctagtcccacgaccgtggacagatgcggctgctcaataaacactggtggaaccatc

SEQ ID NO: 583077 - DNA, 631 bp, Homo sapiens
tcgggagagcgagcagtgagcttgctggattgccgagcgcgagtgagtggagcctgagcctgcccgcctgccgccgcctccgcctcccctcctgctgaacatgtgatgccctgtgtgcctgtgtgtgccctgtgcactgcctgtcccatgccctgtccctctgtgctgtcatgtgcctgctgatggtgtagctgctgctgctgagctgagctgagggcggagtgtgagatgctgatgctgagctgcctgggtgatgggatgtgctgtgcctgtgagcgctgatgctgtgtgcttgccctgctgctgttgttggctggtagaggggggtgaaatgccctgcttgtgcaccactggagaaaatttgagcacatacacctatttataactacatcacactctacatcgctcacacaaaactccacgccgatcaccattgatagctactattacccccccctcacgccactcagactccagccacccgtccctcgcgccacatctacaccacaacagttacaagctactttctaactcccctcacccagcacaccagcgcgtacttaaaaacaccctcttctcccttcctccaaacactcaccacaccccttccacacacgacctacatcataac

SEQ ID NO: 583078 - DNA, 413 bp, Homo sapiens
cacatcctaaggaaacaggacagcagagtgaggggtcagacgtggagactccaggctacagacatttcatgaaccactgacaaataacaacactgggagggaactccaaatcgcgatttggccacatatagacgtatgcacacacatcacaatcaacccatcacaaaagaaagaacctatcaccaagaaaaaaaatgcaacgaacagcatctcacaatgaaggtatatctcattaaactgaattcaattaagtttctgaggtgttcattgcaatggccctattatccttactcactgacaatggggcatgctgggagaatacagtgagaagagtataaaaagagagacaacaaaaatatgcaggaagtaatagtgcaaggcatgtgtgagcctcagagaacaagaatagaagg

SEQ ID NO: 583079 - DNA, 889 bp, Homo sapiens
gcggagatcacctgctgcccgcagaccttgtcccttcctcccggaccagcagctagaggctctgactccaggcaagagcagtgaatggccttgaagtggctcccgccaggtcgtgatcactcaacttctaccctggccacggcagagcaaattgtggccaggagactgcctactggaagaacatgctgttcggctccttctaccttctagagttttatcctggcttgagtttggcaaatagccgtggctctgtgggttgtttcactcgcgaggacctacgaagtccagggaccccggtccgaacgtgttccttgatgcatcgtggccgtggctcggacttgtcgtgcgtgctggtcctgcccacccgcctggtctaccagttctctgggaaccacttggccgatatggggaaatcgcgtgcccgtctcgaccggcttcctcttctacctcaacatgtacgccgagcatctacttcctcaccgtgcatcgagctgccgaccgtttcctggcgcattgtgcacccggtcaagtcccgtcaagctccggtaggccccgtctacgcacgacctggtcctgtgccttcctgtgggtggtggtggcgtgtggtccatggccccgctgctggtgtagcccacaggaccgtgctagaccaatgcacacggtggtctgcctgcaggctgtaccgggagaaggcctcccaacatgccctggtgtccctggcagtggccttcaccttcgccgttcatcaaccaacggtcagctgctacctgctgatcatccggagcctgcggcaggggcctgcgtgttgggagaagcgcctcaagaccaaggaagtgcgcatgatcgccatagtgctgggcatctaccggggtcatgcgtcggtgcccta

SEQ ID NO: 583080 - DNA, 247 bp, Homo sapiens
  misc_feature (199)..(199): n is a, c, g, or t
tgagtgccttagacaatggagtgggagatgttgttggagacagagatcagccaggatttctttcaggtaagactctaggccttcatttttgaggcatccttggtgttgtggataacagtgcctggtcagtggtttccttgggcaaggtttctataacctttctgagcctcagtttcatcctaccagtgtgggagttaantaatacctgtctctacagaatggttagtgacgaagttaagatgagttg

SEQ ID NO: 583081 - DNA, 156 bp, Homo sapiens
aatcagatcgaattaatacaatggtggagagctatatagtcaaaatacactgctgttctctataacgagtcagctcatctggagtggattagaacaagtatgacatggagaatttgatagcaaataccttaccatcctccctttttccaagtctgt

SEQ ID NO: 583082 - DNA, 885 bp, Homo sapiens
aggtcaaagacttgaggtagacatttctccaaagaatatatacaaatgaccaacaagcatatgaaaagatgcccaacatcaccagttatcagggacatgataatcagaaccataataagataccagttcacacctattagaatggccactatcaaaagaagaaagagaaaatgacaaatattgatgaggatgtggagtacttggaacccttgtacactgtgctaggaatgttaaactagtgcagtcactatggaaaacagtatggagtttccttaaaaaattaaaaatagaattaccaaatgatccagaatcccatattgtgtatatttccaaataatgggaacaaatctctaagagatatttgacaccatgttcattgagcattatttacaagagccaagaggtggaagtaaactatgtgtccatcagcggacgaatgaataaagaaaatatggtatatatacacattggaagattattccacttagaaaagaaggatgtgtggtatctaaattagtcaaattgtagaaaaaagaagctaagggcaggtgcagtggtcacactgtaatcccagcacattgggaggccaaggcacggggatcaccgggaaggtcaggacgtcgagacaagcctggccaacacggagaaactccaatctcctagtaaagaataccaaaactcagatcgggttgtcggcggcgatgcctgtacacacaggtacccaaagaaggcctgaaggacagaaacacagcttgcaaccgggaaagccgcaggtgaacagacccacaatcgggccacgaacccacagactgggtgacggaccaccatacgctcccacaacaaacacacacacaaaccaccaaggggacacacaaaaaaaaagag

SEQ ID NO: 583083 - DNA, 963 bp, Homo sapiens
aaagcggcgggagcggtgcgggagaggggttggacccagtggctgatggcaggcccccccctccctcccgcctctagtggatcatgcccatgggcggcagcggcggcgtgttgcgggggtgtgatgtgactgggctgtgtgccggcgcctgtgagacgatgcctgtttccagttacaacacatgggatcacaacaaacacaacctgccacaagaaggcagctagtggcattacttctcctatcagcttagcagcccccaaggagactgactgcgtacttacacagaaactaagttgagacattgaaaccctttgggcgtctaggaagaggcagaggaactgcagcgcaggatttcaattttgggaaaactaaataacctggtaaacgagtggatacgagacatcagtgaaagcaagaatcttccacaatctgtaccttgaacaatgtgggaggcacacacaatttttacatttggatcttacagattaggcagtgcatacaaaaggtgctgatatagaatgcgatgtgtgttgcacccaagacatgttgatcgaagtgactttttcacctcattctatgataagttgaaattacaggaagaagtaaaagatttaaagaactgttgaagaggcattcgtaccagttattaaactctgttggatgggatagagatgaatattggtttggcagataagcactgcatgacaaactccctggaagcattgggatctacgaaaatgacaggctgcttacacaatttagacactaagacggtttaaggagggtcttaaacgcgagacacagggtaaccgaagtaaaacttttcatcttggtacccaaaattgtgacaactcagggtataaccgtgaaagcaaataaaaatagtgcgcacagggcggacgatttttccacaaataagagccccgcagagggaccacagacgaaaactatgcataaaatcac

SEQ ID NO: 583084 - DNA, 1039 bp, Homo sapiens
ctaagttctagatgtaagcttccttatgacctccacagtgagtacattaactacattttcacaaacagaaaacttacatacattaaactgtaatccaaatgggacaatctgataagactttatgcattgttagttaaataattaaattgctagagcttagcttgaaattatgttagaaaacatatgattccatgggatgaatatacatatggtaattgtcttcaaatgagactccttctcaccattaaagtagtcatatatcaattgaacttataggaaataagcatactatatgttagctgtttaacaaggtaccagatgtaagagtcataaatatatgcaattaaagaagttcatagatttcacatgagatgtaaaatgtgtcatatggagacatgtcttgtaaacagttgaatgtatgtaagttatcctgctaccgctgaaaactgtacgttaatgtactcactggtggaggtcactcaggaagctaacatctcgcaaccaccacccggccacctacgttagaacgcatcctacccggacactgccgccaccgtacaaaagccccgccaacggcggcccaccacgcacgcaccacacaccaaagctctacacctatgcaaagagcccacacgcccaaaaacacaagacccagaatgccacgacaccacacgcgcacccactatccacacaatcccaccaccacagcaacaacgctccgacgtcaacatcatggcgcccgagaccccaaccattctgagcagcgccacaacggacgagcccacaacgcaagctaaacaacacggcacaaccccaactcaccacatcaccacgggccacaccgtaccaaccgcgggccacaccaccccccacattaatgaacgaccaacagcgcacaggcacaacaaaccagccgccaccagcagaccacacgacaggccagccaagccaaagcgagacacccacagaacacaacaagacgagcacacccccacgcggggaccacaacgcgaaaccacgagctcaacagtgaaagcat

SEQ ID NO: 583085 - DNA, 125 bp, Homo sapiens
gaggatcctatgctactccacaaacaggtggttggtgttaaataggcgatgagtaggggaaagggcgcctactagtggtgtagactagtgacgtctgtgcctgctgtacagtgcgtcctggctgg

SEQ ID NO: 583086 - DNA, 318 bp, Homo sapiens
  misc_feature (21)..(21): n is a, c, g, or t
  misc_feature (39)..(39): n is a, c, g, or t
  misc_feature (74)..(74): n is a, c, g, or t
  misc_feature (129)..(129): n is a, c, g, or t
  misc_feature (133)..(133): n is a, c, g, or t
aataaagtgcagtggctcgtnctcagcccactgcaactnctgcctcccaggctcgagcgattctcccgcctcancctcctgagtaggtgggattacaggtgggcaccacacactcagctaatgtttgtntttncagtagagacagggtttcaccatgttggccaggctggtctcaaactcctgaccttagatgatccacccaccttggcctcctaaagtattgggattatagttgtgagccaccatgcccggccctgccacctgccatcttttgagttcttccctggaggacctaggacctgaaccctgcttgcttgt

SEQ ID NO: 583087 - DNA, 114 bp, Homo sapiens
taccatctatgacaataaattaaaagaaaagacaggaccatttaattctgctgtctggttatctcctgcaatgcttcaaattatgtgtgctcattcaacacaaaattatgtgtc

SEQ ID NO: 583088 - DNA, 321 bp, Homo sapiens
  misc_feature (10)..(10): n is a, c, g, or t
cacataatanaagtattcttcaggagtttttgacctgcagggggctgggtgtggtggctcacacctataatcccagggctttgggaggctgaggtgggaggattgccagaggccaggagtttgggaccagcctggacaatttagtgagaccctgtctgtacaataaaataaaataattagcctgctgtggtggcacacacctgtgttcctcgctattctggaggctgaggtgggaacatcagccaggagtttgaggttacagtgagctgtgatcacaccactggactccagcctgggcaacagagcaagatctgtttctta

SEQ ID NO: 583089 - DNA, 338 bp, Homo sapiens
  misc_feature (79)..(79): n is a, c, g, or t
  misc_feature (310)..(310): n is a, c, g, or t
gtcagtgaagacagactcggtcaattagaagcagaatcccaaaggcttcttaaaatttatgaagagactttgccaaatnagagtccatgggacccaggcacggtggaggctgaggtgggcagatcactttgaggtcagaagtttcagcctggccaacatggtgaaacctcgtctctacttaaaatattaaaaattagtcggacatggtggcatgctagtctcagctactcaggaggcttgaggcaagagaactgcttgaactcgggaggcagatgttgcagtgagccgagatggcgccactgcactccancctaggcaacagaatgaggccccatctc

SEQ ID NO: 583090 - DNA, 427 bp, Homo sapiens
ttttaattcaggacaaataaccagtgtctattcactgtgaaaacagtaaggaaccttagcactatttcagttcaacaccatttctttactgaatattttcttcacttctggcataacttcttaaatcatcctcattctccgagacaggtctgagaatagaatttagctcacctcatttcataaatttttaggtgatgttaattatggccactatttggcagtctccttcaaatagccctccactttgtgtttttctttacattgaaagatatttttaaattgatttttaattgacagataataactgaatatatttatggggtatgaaagatttcttttaatggaagaggttgtgaaagagagcttttccttataatgtatgtgcgttgttgccctgagaaaagcctgtaaagatattctaaaaaaa

SEQ ID NO: 583091 - DNA, 857 bp, Homo sapiens
gttttattcttgaaaattgtgtaattgataagatcatacttcttgacgagcgtggtggctcacgcctgtggtcccagcactttggaggccgaggcgggtggatcacgagggcaggagatcgagaccatcctggctagctcggcgagaccccgtctctattaaaaatacagaaaaatagccgggcgtggtggcacgtgcctgtaatcccagctaatctggaggctgaggcaggagaatcgcttgatcccggagggcggaggttgcagtgagccgggatcgtgccaccgcactccagtctgggtgatagagcaagactgtctcaaaaaaacacacaaacacaaaattccagagatctttacaggggttgtaagctatcctaggacactcggaaacaactgtgatttgactcccgtggaatatataagttacacataaagtagaaaattcgcgggtacagaaaccactctcgtgggaaatctacacaacacaacaagtgtcaaatcccagcgagatcacacatcagttgagaaaaacaatccagacggcaatccactcaaacgcgcagctccaacaaagagggtcttcacaaacgagccacaaccaatctccgaaccacggggccaaaggggcgcaaacaaatagagagaaggggcaacaacacaagtgaaagcccgcaaacagtagcgcacagacaatgccgggctcttccaccgaccagctgacaaatacacgcaagaggaaacgaaaacgggagcacacatacccaggagcacacaaacggacgccaacagtccaagcacacccagcaaacacgcgagagctcagccgcatggcgagccatgaacaccacacaaacc

SEQ ID NO: 583092 - DNA, 159 bp, Homo sapiens
ggttgggttttaaaaaaaccgaagggtttttttttaagggccccctttctggaacccggaaaagttataaaaactgaaccgtttgggcgagtctttgtgggttatattcccaggaaaattgaaaggattccgaaatttaaatattttttgatatttgga

SEQ ID NO: 583093 - DNA, 481 bp, Homo sapiens
cctaatttttaagccaagaaggtgtaataggtgatttaatcacagggatgaaacaacagctgaattttttagagcactgtaggtgtgactgatgttaagtaagtttttcaaggcaggaatgtctgatattcagccattcaattaatgcataaaatcccctttcagtcatgaaaatttgtatgtcttttctccctttgctgacttaaaataaaataaactggtggtttggctaactattttaccatatggggttggctggttttaataaataatgttttgggttatcataggatctgtaagtccaaaggatattctgtttctatctgcaatgcatttgataatcattcctatgaaatgtattttatttaatcagataagctaataagcgaattggttacatcgtttgtatctgttggcctagtggacagctgtgcctggtgcacctctggcttttaataaatactcattggttgaaaaaaaa

SEQ ID NO: 583094 - DNA, 433 bp, Homo sapiens
ttccgtacattccactccactccactccactcaatccactccattccactccattccagtccactccattccattctactccattccactgcagtcaattacattccactccattccgacttcactccactccactcaactccactcacctccattgaactccactccactccacttcactccactccactccactgcaatccatctactccattcctttccactccactccattccattgcattccattccattccactgctctccattccattccccacaaatcttctccattctactccattccattccatttcaccctattccattcctctccactgcactccattccactcccctatactctactccacttcactccactctgtcccagtccattgccctccattccactccattccactccaattcc

SEQ ID NO: 583095 - DNA, 284 bp, Homo sapiens
tggtcccggggtccagagactggatgggcattctttcacctcatcagaacccaaccagcgcacagatctccttgggttgcttatgcttcatgttcttcatcatctggtactagcattttgagagttctggttgttgatatttcttggatatgtcgggcatgccagggtccaagtgcgtccttgtcctccttgaactgttcctgcaaggccttggacattaggccgatgttaggtcctgttagaagtattcttgcgatgttcctgtcatcgatctcgcattgcaa

SEQ ID NO: 583096 - DNA, 114 bp, Homo sapiens
tgtctttccatatgttacgggaatgtaaataataacttaatgcctactacctctggaatagtttccctgttattagagaggtgagatatgaaaacaaagaacaacaaaaaaaac

SEQ ID NO: 583097 - DNA, 985 bp, Homo sapiens
gacaagtatcaatggtttggatctttttaaaaacatacgagtacatatataagtgaatgtagtcatgtctgtcatataacagacagagaaatccacatggtgtgtactaaactcggttacgacattcaaaattgccgttgtatataatggagtagcccaggtagcaggtggtcgacgaagcagcatttctcttcgttagctgaggctcatagcttgtatagcaaagcaaggaattaaggccgagcatatggaggtgtcgtggaaaggacagttttcgtatccacgtcattatttctgtagagtcagaaggtgggagtatggtccaaataaatccattaggttactcctgcagcatgcgcttatataggttctctctatgactgaggatcaaatatccctttgtgagctggccctcagctccttagctcatgtgtacaaacctcagatgtaactacatatttatatctaccagagctatcaagcaacagtatagaaccactagcctttgaaataaacttctgccccattactgatgtgcagataatgagtgcactatcataaatagccagattacgtagcactacttaaggtaaaataggtaatctataagcgaagacatcctagaagagtcagggacagaaattaatgaatagacaagcaccttgtaaacactctactaatgaacggaccggccagtgaaggcctagaagacatggatcaggcgccaatatccaggaagacacgggaacaaaaaacatccggaaatgaatactgacagaatagtgaaaaaagggacatgtatgaattaaaagtagaggcatatgaacattcgattaaattatgagagggaatagaaagagttaaaaagtgactgaatggaaaaagtaacagagaaacagtgtaatgaaaaagtaagaccaaaagtgaatgaggactatcaaacatagcgaaaagggagacatttcatagtctatataaaaaaaat

SEQ ID NO: 583098 - DNA, 879 bp, Homo sapiens
  misc_feature (1)..(1): n is a, c, g, or t
  misc_feature (83)..(83): n is a, c, g, or t
  misc_feature (95)..(95): n is a, c, g, or t
  misc_feature (131)..(131): n is a, c, g, or t
  misc_feature (145)..(145): n is a, c, g, or t
  misc_feature (150)..(150): n is a, c, g, or t
  misc_feature (157)..(157): n is a, c, g, or t
  misc_feature (159)..(159): n is a, c, g, or t
  misc_feature (205)..(205): n is a, c, g, or t
  misc_feature (223)..(223): n is a, c, g, or t
  misc_feature (237)..(237): n is a, c, g, or t
  misc_feature (244)..(244): n is a, c, g, or t
  misc_feature (247)..(247): n is a, c, g, or t
  misc_feature (250)..(250): n is a, c, g, or t
  misc_feature (279)..(279): n is a, c, g, or t
  misc_feature (283)..(283): n is a, c, g, or t
  misc_feature (350)..(350): n is a, c, g, or t
  misc_feature (353)..(353): n is a, c, g, or t
  misc_feature (376)..(376): n is a, c, g, or t
  misc_feature (388)..(388): n is a, c, g, or t
  misc_feature (397)..(397): n is a, c, g, or t
  misc_feature (403)..(403): n is a, c, g, or t
  misc_feature (415)..(415): n is a, c, g, or t
  misc_feature (733)..(733): n is a, c, g, or t
  misc_feature (814)..(814): n is a, c, g, or t
  misc_feature (845)..(845): n is a, c, g, or t
ngaaggagagccgcagggagaagctacctcatcatgggaaaattgtgggagcgggaagagggagggggagacccagccatccngttctgacttcnagcaatttcttctgccctcagtcatgaggggctccntatcctcccatccnatggncccaggngnagcaatgagagaggggaagggaagagagaaaggaagacaagttggngccaggggaaggcatctntgctctgcatagcnatttggnccnggncatgactacaagcaaaagtgggtgcaganggcngggccaagggcggggggagggaggggatactcagtaggcatgggtggcaatgtagagggactgtgcngcngctccaccatcttctccacggcnttcatacttgcncggggcggnaagcanttcacctcagcncgcgtgaggaactccgcaggggcagccccagcattggcccgtggccctcgccaggcattgagtgcgagaggcttgcagggcacgcccataggagaagggaagcgcccagggtcggggaagggggcagcggttgatggcattgaggttgaatgatgcctcttcttcgctctgacccccagacaggaaggtcactcctgggacagctgggggcacagtgcgacgcaggcagtgacagttgccatggcaatctcctctggggtatacttgatgggacaggcatggcccggggtcaccatgttgggcttgagcagggtcccnccaggtatacatgatggtcactcagggccttgtacacagcagccaagaccttctctgtaacatactgacaacgtttgaggncgtggtctccatcaggcaatatttcagggtncacaataggcacaaagccattctgctggcagata

SEQ ID NO: 583099 - DNA, 408 bp, Homo sapiens
acaatgaggaaacgatggtcttttcaataaatggtgtgggggaaagctagataactatatgcagaagaatgaaacaagattcctctctctcgctatacacaaaaatcaaatcaaaatggattaaaggcttaaatctaagacctgaaactacaaaactagaagaacacactggagaagtgctccaggaccttggtctgggaaaagatttttttgttaagacctcaaaagcacagacaacaaagcaaaaacagacaaatgagattacattaagctaaaaagtttctgcacagcaaaggaaacactcaacagagtgggggagacaacccacagaatgagagaaaacattttcaaactatccatccgacaagggattaatgaccagaataaagagaccaaacaatttaagcc

SEQ ID NO: 583100 - DNA, 386 bp, Homo sapiens
  misc_feature (59)..(59): n is a, c, g, or t
  misc_feature (121)..(121): n is a, c, g, or t
cccacctggtcctttcccatcgcccccaaaaaggggggccccagggacgagcttagctnagctgggaggagcagggtgagggtgggcgacccaggattccccctccccttcccaaataaanatgaggggactaaagttgtcttggtttttattttaataatattttttcccttttccagtatactagcttgtcttttaagaaagggggtattaaaaaaaaaaaaaagaccaaagtgtttttaaaaaaaagccacccccccccctgtgtctgtatatagtcagcttatctcgtgttcaattttttgatctctacaaaaagaagtggaaaatgctgtatcaagggtggggttaactgtgcctttccaataaagatgtgagaagcttca

SEQ ID NO: 583101 - DNA, 191 bp, Homo sapiens
  misc_feature (22)..(22): n is a, c, g, or t
  misc_feature (29)..(29): n is a, c, g, or t
  misc_feature (55)..(55): n is a, c, g, or t
  misc_feature (116)..(116): n is a, c, g, or t
  misc_feature (154)..(154): n is a, c, g, or t
tcaaaaagtttcaaatgacatnccttacnctttggttttcagaggcattcaagcnaaatatcacagtggtcttttgttttctgaccaatctaaaaatacctgtgattaaatttaanttgttagtgtaaataaatttcttgccaatgagtattantgttgttagacaacgaatgcaataaaaagaaatactg

SEQ ID NO: 583102 - DNA, 133 bp, Homo sapiens
catcagaacacattcccattgttatccaatgcatgactgtataacggtcctatggattaaattttttatgtaattcaactggaaagtatttttatgttattttgtaataaataaatcaatcacaattgtaatc

SEQ ID NO: 583103 - DNA, 119 bp, Homo sapiens
  misc_feature (112)..(112): n is a, c, g, or t
ggctggtacggcctggaattatgggatctccccttcgactgcagctcgctccgtgccttctgcgcgcctgggatccggagcctgctaggttctgtgcgctcccgcccaggcnggtgccc

SEQ ID NO: 583104 - DNA, 895 bp, Homo sapiens
cagcagctgtggtgaccatggaaaaatgatgcagctgcccatggcgcccagactggcgagcgcgccggggtcagtgctggctgtgttgccgccgatcaagctgcacaccaccagcggcaagatgatcatccgcagcagactgcagcagcagctcgcccgggaagacgaaggcgctcaagctgctcctggtgcccaactgccatgcgcaccccctgtgccccggactaccccctatgtcccagctgccacgcctggccaccacgtgccaccatctgtcatgcacgcacagagcaggttggctcgacaggcagcctggctgcacactgtgtcccgtggaacctgctatgtatagcctgccatgcttgcctgctgcccttgcgtccctcgactgcgagtgccatgtctgccatgtgtccaccagttcggccgtgtggcgcatcctgcctgctagccgatgccaccgttgcgacgtcgtcgacggacgcgactcaggctcacgcactgcatcgggaacagcaccagtgggctttcattacgcatgccatggcacacgctggcttggcgacgcagcattggcgcatccgttcccagggacccggacgttacctacgcacttgagcttgcacgctaacccagcaacctgcgagcactggacaccttcgcgacgcggctccttaccagcttgctgagttccacagcccctgaagcttcccttggcctcttggcaacgcttgggagttgtgctaaagtataccccaagggcatgagcccgcacagagagtcttcctacttgccacttgacacacgtgagtgccagaattgtcgcgacaagcctagggaagtaacgtgcagtcgcaccggggctaacccttgggcctcctagtgaagcctaggg

SEQ ID NO: 583105 - DNA, 1006 bp, Homo sapiens
  misc_feature (257)..(257): n is a, c, g, or t
  misc_feature (261)..(261): n is a, c, g, or t
  misc_feature (267)..(267): n is a, c, g, or t
  misc_feature (271)..(271): n is a, c, g, or t
  misc_feature (294)..(294): n is a, c, g, or t
  misc_feature (316)..(316): n is a, c, g, or t
  misc_feature (338)..(338): n is a, c, g, or t
  misc_feature (341)..(341): n is a, c, g, or t
  misc_feature (343)..(343): n is a, c, g, or t
tggattatagtgaggagttgttacggagtacagatattaaaagattatttgtaattccagccagctcatttgataccaaattactacagcctatgtttctaggagtggtcaatggaattatgctaaaatagtatttttcttgcttgttttatattttataaatcgctttccagcactgaatttttaaaatcttttattttcaagtatctcttgaatctcaaaaatctattttcttttccctgctgactgatcctggncccnggaatnaggntgcagataagtcatgttacacangaatgaaggtgggtcaaagtangggtactgtcgcagagtggatnacncnctcattccctgcaaagcaaagtaagtggccttgtctgaaccttcctgcttcacagactagagcaatggtacacttccagctacacattctgatttattccagttaaagggaaagtgcatttggtcatcaatcatttgacaaacatttattgagtaactactatgtgccatgatgtgggctaggtaccgagtctaaaacaacaaataagaaatggcttctttcttcaagtatctcatggtgggtgcttcagatgacacaaagcacagtcattgttgggtagaatgaatggttgtgatggaacatgccacaaagaatgggtctggttagaaatttgtccagggatttcccagtataaatcagatgctttctcaatctcatgtttttccttgtaagattcagagtagaaatatttatctacccagaggaataacagatgcagtgcttgaacagttttttaaactttcagtagaattacataaagaaaaaatacaatatgaaaatattgacaattcatctgaagagtttgttagttttagtactgatatccgggaaaacactatagaacagcacaccagaagaacttgggatttttctatggtttaattctgcaattttgagatgagttttaaaatccaattatagattaaactctttgtacctgct

SEQ ID NO: 583106 - DNA, 317 bp, Homo sapiens
tatgcaacaactagggtcagttttgcaggtggtagccatttaccaagatagattgtaggtaaagaagggcagatttattagagaaattgtgatcatatgttgcagatgggcagctcattggagaaggggctacctgctaagaggcaagggctggaggaaagttttatagggtcctgctgaagggtgctacgtgtggaatgaggtcattgtgcccgcaggtcgtttgtgattagctgtctctaacaattgttgcatacaataattgttcattattgttctcaacttggggctctccccaacctggggacccttcctta

SEQ ID NO: 583107 - DNA, 440 bp, Homo sapiens
acccatgccacctctctcttcgcactgtgtaccagagtacacctaggagctctctccttactctgtccccatgtctccagtcctctctccttactctgtcccaatgtctccagtcctctctccttactctgtccccatgtctccagtcctctctccttactctgtcccatgtctccagtcccctctctccttactctgttcccatgtctccagtcctctctccttactctgtcccatgtctccagtcctctctccttactctgtccccatgtctccagtcctctctccttactctgtccccatgtctccagtcctctctccttactctgtccccatgtctccagtcctctctccttactctgtccccatgtctccagtcccctctctccttactctgttcccatgtctccagtcctctctccttactctgtcgtcgacgc

SEQ ID NO: 583108 - DNA, 827 bp, Homo sapiens
gccgcagcagcggtactggcagcacggcttatgggctggtggggtccccgtgctggctttcgccttgtcatacctggaggagctgtctcgctaccgcggcggaccaggggacccgggcctgtacttggcgttgctcggccgtgtctacgatgtgtcctccggccggaggcactacgagcctgggtcccactatagcggcttcgcaggccgagacgcatccagagctttcgtgaccggggactgttctgaagcaggcctcgtggatgacgtatccgacctgtcagccgctgcagatgctgcacagcttctaccaatgggctttccattcatatgagcaagcaatgatgtgtgtgttgggagggtgcacaggcacggtatctcacggcagcaggcatgggctagcccaggccgcggcactgaccccaggtagaagctgcgatcagcgagaggcttcggaggccaagcaaactagcagctgcaagagaagcagacattgcccgtccgtgcaactgcggagatggagcatcagccaggggcagccggatctggtgcatcccagaacgagtggaggtgtgagcagagactggattggcgtccccaggaagctgtataagccaggtgcacacggagccccagatgggtgagtgatgagaaccaacggtcgcccctagaggccagatgccggaaaagcgtcagaacgagaaatcgatggggacctgtaaccagccaaagatgggcagagtagacagggctgcaccaacggatagccagtcacagtgcatcccttgccggtcgtagcacggaagacctagtactgataaagtaga

SEQ ID NO: 583109 - DNA, 373 bp, Homo sapiens
cggggtaggcagccgtccgggaagagcagaggagtccagcaagcccacaggagaacttggcactcacgctcatgaaaggatgaatgattctaaatgtgactttgaaaaatgcttagtttttctgactatagaagtaaaaaccatatgaaagacacatgtacaaaaccagccaaaactgtttcgaaagaccagtgagggaggacagggaactcgccagccagcacagtcaaaggacaccacgatgctacagggggaggggcgggcggcgctcacgctggaaggcgcggtggagcaacaggtgcatgaagcgtggtgggggagctgggtacacatctaaggagagcatatgaagtcagtgggggcgatgccaatt

SEQ ID NO: 583110 - DNA, 700 bp, Homo sapiens
gtccccgaggggtacgtcgttctaaaatattgggacccccgggcgcggaatgccccgacgaaataacttgcgaggatgacccgccccaggcggcaagattattttgttttataaagagcagggggtcctcgagtggccagggggggtaaacccatataaggatggtttcccaccgcaggctccccaatggggggacaacaggaggaaattccggcccgacggcgacacaaggttttttcgtcaaaaaatttcttttgcaaaaagagggcagttaagaaaagactttgagggtgtttgggtgagagaaaaataccgattcctttttgtgggggacggccctggttttttattgggggaaaaaaaccggaccggaaagccgtttccccccccttgatggagaggtaaagaagggcgctccttttacgaagatttttcgtattagcaccccgggacccgggtgttagtaagacgaggacaggggcctgggggtgtgcatactaggcaccgccgagagggagagtgggtggtccgatttttcagccgcgggttttttaatggatacaaaaattggggagggtgtatttggttttggaaaaaaatgagggggggatctggagagggaggcaaatccgcccaggctatgggcaaagaaaaggaaaaaaaaaaaagcgagcagaaaaaaaaaacaataaaaggtgag

SEQ ID NO: 583111 - DNA, 361 bp, Homo sapiens
ggatagctgcgtgatctgatggacgccgcgcacctgctgggcgccagcacctggcatagccgcgctcgctggttattctgccccacctgcgctaatggcggcatgatagccgtgctgctgtcgttctccttcttaatcggcgacttcgtcttcgccaacctgttggccaggggccgctacgaaacgctagaggtatattggttcaacatgcgcaatggcagcgggccacttcaccagcgcattggttatctcctatatcgatggtagtcctgatttaccacctggattgctaacgtgctgaacatgggaaagagcgtaaaatgtcatattgacaggtcactaaactctataagcattacgg

SEQ ID NO: 583112 - DNA, 289 bp, Homo sapiens
cgccgggcagagcgccaccgagggaggccaaggcgtccacatcgccgatgacaaagaaagccggcccggtcttacgcagggcgcgccaggtcttgaccacgatctcgggcccgacgccggcgggatcgccgaggctgacggcgaggggagctggcggagccggtctcaaggcagggatcgcttacttagcctcgatggtcgcggagttgcgcagatcccgcaggaagcgcttggcgagcatcgaaatctgttcgccgcgcaggcgatcctcgatggactcgcgcgacgg

SEQ ID NO: 583113 - DNA, 117 bp, Homo sapiens
agtagcaccgaatgttcgaagcgccgaattttctcttctgttcgttcttttgcttctaacacagccatgaatgctcatcctcctgttttagaagcagaaagaacgaacagaagagaa

SEQ ID NO: 583114 - DNA, 881 bp, Homo sapiens
ggaaggcgcgtggggtttgatgcgagaacgggccttgctgtcaccaacatggagactttgtaccgtgtcccgtcttagtgctcgaatgtcccaagctgaagctgagagaagccgccctggttgcatatgccgtcgggaatgactgtgtatgctctggtggtggtgtcttacttcctcatcatcggagaaataatttatgatgttattgttgagacctccaagtgtcggttctatgagtgatgaacatgggtgatcagagcgacagtagctttcttggctacagagtaaatggacaatatagttatggaagggattgcatccaggttcctatttacaatgggaggttgaggtttcgataatcctggaccgatcgaatgcaccaaatatccaaaattcattagattccttcttctgttcattggatgcgtctgtgtcctatgtgagtgttgtcatggctagagtattcatgagaatgacattgcgggtatctgatgggtgagagtggcgttgagaagaaatcagtggctggtggatttgtcctgtcaatgaagtttaggggtgtaccaatcctctatatgcgtgtggaaagaatgagagcagcagtaatacgaatatctagtgaaaacgggagcgtatgaaggttggactaaaattctcttgcttaggaggaccagttattcagaatttccgggggctattgtatacgaagaggtggggagttcttcaggttcataaaatatcttttgattaattcataagggtgtttgacctcaattgggaatttggtgagaaataaacaaaatcggaatgaggagaatgtggaaggggatatatatatgggaggggagtaaaaaaacacggttctgcacaactatcgtgaa

SEQ ID NO: 583115 - DNA, 1012 bp, Homo sapiens
  misc_feature (10)..(10): n is a, c, g, or t
  misc_feature (62)..(62): n is a, c, g, or t
  misc_feature (99)..(99): n is a, c, g, or t
  misc_feature (102)..(102): n is a, c, g, or t
  misc_feature (104)..(104): n is a, c, g, or t
  misc_feature (133)..(136): n is a, c, g, or t
  misc_feature (143)..(143): n is a, c, g, or t
  misc_feature (148)..(148): n is a, c, g, or t
  misc_feature (150)..(151): n is a, c, g, or t
  misc_feature (159)..(159): n is a, c, g, or t
  misc_feature (188)..(188): n is a, c, g, or t
  misc_feature (193)..(193): n is a, c, g, or t
  misc_feature (197)..(197): n is a, c, g, or t
  misc_feature (204)..(204): n is a, c, g, or t
  misc_feature (207)..(207): n is a, c, g, or t
  misc_feature (210)..(211): n is a, c, g, or t
  misc_feature (213)..(213): n is a, c, g, or t
  misc_feature (216)..(216): n is a, c, g, or t
  misc_feature (218)..(218): n is a, c, g, or t
  misc_feature (220)..(220): n is a, c, g, or t
  misc_feature (231)..(231): n is a, c, g, or t
  misc_feature (276)..(276): n is a, c, g, or t
  misc_feature (315)..(315): n is a, c, g, or t
  misc_feature (334)..(334): n is a, c, g, or t
  misc_feature (338)..(338): n is a, c, g, or t
  misc_feature (354)..(354): n is a, c, g, or t
  misc_feature (358)..(358): n is a, c, g, or t
  misc_feature (373)..(373): n is a, c, g, or t
  misc_feature (380)..(380): n is a, c, g, or t
  misc_feature (388)..(388): n is a, c, g, or t
  misc_feature (390)..(391): n is a, c, g, or t
  misc_feature (395)..(396): n is a, c, g, or t
  misc_feature (413)..(413): n is a, c, g, or t
  misc_feature (419)..(419): n is a, c, g, or t
  misc_feature (425)..(426): n is a, c, g, or t
  misc_feature (440)..(440): n is a, c, g, or t
  misc_feature (446)..(446): n is a, c, g, or t
  misc_feature (457)..(457): n is a, c, g, or t
  misc_feature (505)..(505): n is a, c, g, or t
  misc_feature (516)..(517): n is a, c, g, or t
  misc_feature (536)..(536): n is a, c, g, or t
  misc_feature (560)..(560): n is a, c, g, or t
  misc_feature (590)..(590): n is a, c, g, or t
  misc_feature (632)..(632): n is a, c, g, or t
  misc_feature (667)..(667): n is a, c, g, or t
  misc_feature (742)..(742): n is a, c, g, or t
  misc_feature (880)..(880): n is a, c, g, or t
  misc_feature (933)..(933): n is a, c, g, or t
  misc_feature (935)..(935): n is a, c, g, or t
  misc_feature (941)..(941): n is a, c, g, or t
  misc_feature (945)..(945): n is a, c, g, or t
  misc_feature (987)..(987): n is a, c, g, or t
actaatttantagaacaatgactaaaactgaactggtatttgtatgtgaatccacaggagtntaagcatcaaatccagccaagaaattaaaaaaaatcnctntnaacattgaatctaaataaactaaaaaaannnnatcaacnctganannccccaacncggcttggcgctggctgacgacatgaganaaganagcnttctcanacnccnncntcntncngggctccagtntatcaagatatccccttacacccgcatagataacagccacttgtncttcaatagccatgggagactactgtccttgcttcagcnactcagttagacgcacgcnacgnctcaaaagttgttgantggnagcttcgaggtcagntccgttntgggcaantnntgcnncctcacgttattgagcnaatttnagcttnntggtacctgctacntgcttnatagccctggnttgggcagcggatccgacacgagttatagatagaccaacgttaattgngggggggatanntttgtggaacagttgtgtntccaagaggatctgtgcgtgagtnatggaaatgacatttgttggaatgtaagcngacacatcaccagcctgtgtttctgtgactggcaaagcagtnaaggagccaccaccaaaagcatcgttcattttggntgctctctccagcaaccgggagtgtaggtagaacacatcaccaggataggcctcacgaccagggggtcggcgganaaacagagacatctgacggtaagcaacagcctgtttggataagtcgtcatagatgatcaaagcatgtttgccattgtctctaaaatactctcccatggaacagccagagtaaggagccaggtactgaagtggggcagntccgaggccgtagcgacaccacaatggtgtacttcatggctctgcatctgtantntcttcnccantggggcaaatggatctcttttgaccatagcaaataaatacanacagcttcttcttttctcagatcca

SEQ ID NO: 583116 - DNA, 397 bp, Homo sapiens
cgcggcatttaaactcacaatctaccgatacagggctgtttgtaccgtccagatccactggtccctatgttgcccatacaggcattagatagcattaagctaggtcaatacactgctcaggcacatgtctgtgtacagatgatcaggtctagatcccttacagtaagggctcgtacatatgtcggttcatatctcccgcccacatacaagcacccacagtgtggcagaaagcttggctgtgggtcttgtaaaataatcaatctacatgcgtacaagtgtgtcccatgttgaagtccaaaggcaagaatgctagtttgtccatcccaatatgtgtagatatccagtttcaatgtgtctctagactatgcagctagtgtgtgagcatccagctaacaat

SEQ ID NO: 583117 - DNA, 685 bp, Homo sapiens
  misc_feature (71)..(71): n is a, c, g, or t
  misc_feature (266)..(266): n is a, c, g, or t
  misc_feature (292)..(293): n is a, c, g, or t
gcagacggaagtgagcgacacactctgcgtcctcgcctcaccaggaaactactaaagttcctggggaagcnaagtagaatttcatacagaacaaaatggatggagaggagaaaacctatggtggcatgtgaagggagctgatgccatgtatgtcaaattgatatcatctgatggccatgaatttattgtaaaatagagaacatgcattaagatcaggcacgataaaagccatgttgagtggaccaggtcagtttgctgagaacganaccaagtgaggtcaattttagagagnntaccttcgacatgtgcatatcgaagagtatgcatgtagttttacgtacaaggttcgctagcagctaacagcttccaccgagattcctgaatttcccaatgttgcacctgaaattgcatctggaactgctgatggctgcgaacttcttagattgttcaacatataattgcatgtgataataaactgttaagtcttttcagtatttaatacctgtagttcagttagtaagctttttcatatatagcatgtttgcgctgtagtgcaggttgaactatataaaggttcattgcaaagcagattatcgtgtatctggcataggaatcaaagttgaaattcgttgcgacagtcaacaaattaaggacattttcacaaactgagagataatcaatatgg

SEQ ID NO: 583118 - DNA, 693 bp, Homo sapiens
  misc_feature (71)..(71): n is a, c, g, or t
  misc_feature (274)..(274): n is a, c, g, or t
  misc_feature (300)..(301): n is a, c, g, or t
gcagacggaagtgagcgacacactctgcgtcctcgcctcaccaggaaactactaaagttcctggggaagcnaagtagaatttcataagagacggggttgacggttgttgggggtgtggagggggtgggtgggggttgtgtggggtggtgcgtggtcgggcctgcgggtggtgggtggtgggggcgcgtgtggcgtggtggggtcgtggtggggtggtcgagggggggcggttgggtcggtttggggtggccgtcgggatgcgttgcggatcganaccaagtgaggtcaattttagagagnntaccttcgacatgtgcatatcgaagagtatgcatgtagttttacgtacaaggttcgctagcagctaacagcttccaccgagattcctgaatttcccaatgttgcacctgaaattgcatctggaactgctgatggctgcgaacttcttagattgttcaacatataattgcatgtgataataaactgttaagtcttttcagtatttaatacctgtagttcagttagtaagctttttcatatatagcatgtttgcgctgtagtgcaggttgaactatataaaggttcattgcaaagcagattatcgtgtatctggcataggaatcaaagttgaaattcgttgcgacagtcaacaaattaaggacattttcacaaactgagagataatcaatatgg

SEQ ID NO: 583119 - DNA, 313 bp, Homo sapiens
aggacacaggcaggaaaagctggttcttgctggtcggggccaggatcatcatctcctactactccaccacctatatctgggtacaaaaacaattccggggggccaggcatggtggctcacgcctgtaatcccagcacttggggaggtgaaggtgggcggatcacctgaggtcaggagttccagaccagtcgggccaacatggtgaaaccccatctctactaaaaatacaaaaattagccagaggtgggggcaggcacctgtaagcccagctacccaggaggctgaggcagaagaatggcttgaacccaggagg

SEQ ID NO: 583120 - DNA, 936 bp, Homo sapiens
  misc_feature (936)..(936): n is a, c, g, or t
tgcggtggtgcactcctgtaatcccagcactttgggaggctgaggcaggaggatagcttgagcccaggagttcaagaccagcctgagcaacatagcgatactccatctctattagggaaaaaaaaaaaacgtggagccaacaacatgatagggataggggtctggctatgggcagcaattcaaacaacagggctcaagcaatctctataaaagggtctgggaacaagaatttaccggagtgggcttatcatgaagctacagatttttgttcctggtaatatcaccctattcggtcccagaaacacttcctggaaaattccctttatcatggtcacacagaatttattgagaaagtccttaaatacttattacctcggtatcaaaggtcgtggtcggaccgttaaatgagccttagtaatattaacccgaggcactaaaggaattcttgactggcagaaagtagaacatcaacctgggtggacctcccataagtagccaaccccgttcatgaccaaggtcacgtccactgtcctacaacactacagcaggcaaaaacttgatggccctaaccagttttcccaactagacttattctcgcgcataaaagtccttatgccgatgcgattacaacagagtttcggcctgtataacccttacttctccctatacagctttttcgttacctgactgtttccccgacggttttggccgttggtccacacctttgggattgtacaccggattccgcactttctatactacaacaaccagtttccccttcgcaacctagaacgtgcaaccttccacattggcgtacgacacgtggctccagaaacagttccaggttacgggccgcacaacactcgtcgacacaaacgcggtggccgggaggcacctctgtgcacgatttgatcctctgtctgtattagtatgtgn

SEQ ID NO: 583121 - DNA, 481 bp, Homo sapiens
  misc_feature (58)..(58): n is a, c, g, or t
  misc_feature (70)..(70): n is a, c, g, or t
  misc_feature (72)..(72): n is a, c, g, or t
  misc_feature (83)..(83): n is a, c, g, or t
  misc_feature (92)..(92): n is a, c, g, or t
  misc_feature (106)..(106): n is a, c, g, or t
  misc_feature (123)..(123): n is a, c, g, or t
  misc_feature (125)..(125): n is a, c, g, or t
  misc_feature (127)..(128): n is a, c, g, or t
  misc_feature (131)..(131): n is a, c, g, or t
  misc_feature (133)..(134): n is a, c, g, or t
  misc_feature (143)..(143): n is a, c, g, or t
  misc_feature (148)..(148): n is a, c, g, or t
  misc_feature (163)..(163): n is a, c, g, or t
  misc_feature (165)..(165): n is a, c, g, or t
  misc_feature (172)..(172): n is a, c, g, or t
  misc_feature (178)..(178): n is a, c, g, or t
  misc_feature (246)..(246): n is a, c, g, or t
  misc_feature (261)..(261): n is a, c, g, or t
  misc_feature (274)..(274): n is a, c, g, or t
  misc_feature (283)..(283): n is a, c, g, or t
  misc_feature (299)..(299): n is a, c, g, or t
  misc_feature (303)..(303): n is a, c, g, or t
  misc_feature (313)..(313): n is a, c, g, or t
  misc_feature (317)..(317): n is a, c, g, or t
  misc_feature (339)..(339): n is a, c, g, or t
  misc_feature (346)..(346): n is a, c, g, or t
  misc_feature (370)..(370): n is a, c, g, or t
  misc_feature (372)..(372): n is a, c, g, or t
  misc_feature (385)..(386): n is a, c, g, or t
  misc_feature (388)..(388): n is a, c, g, or t
  misc_feature (391)..(392): n is a, c, g, or t
  misc_feature (395)..(395): n is a, c, g, or t
  misc_feature (400)..(400): n is a, c, g, or t
  misc_feature (481)..(481): n is a, c, g, or t
gtgcacagtctggtacccgtggcggtgctggcaacacaagcaccagctgcggggactncaaaagcatctncncggccccctcnacgatgtcnaaggccgaggaggnaagaagctgccgggccncncnnttntnnagaaaaaanttatnaataaataattgctntnaattgtnaagttntttttataattgtccatgctgtgcagcgaatagctgaaagggtgaagcaagaaaatctaaacctcgtntgtattcccacttcnttcaaggcccgcnagctcatcntgcagtatggcttgancctnagtgatttgnatanaaaaccataaatacaaattgcnatcgatngtgctgatcaagtaaatcttcatntnaattttataaacnntncannagnttgcntcaaaaaccacaacattctccttccttatcttagttcttttattctcatacttgattttagcaaaaattcgaaaatcttcn

SEQ ID NO: 583122 - DNA, 436 bp, Homo sapiens
tgtattcggcacgagttgtgagagagtgtgagagagagagagagagtgagagagagagagagagagtgtgtgagagactgcgcttgttctactctgtgaaccccttccccttctgacttttcgtgtttttgcctgctcaatttggctgccttcccatctctcctttactttttctccaaggcccttcgtttgtttatccctttctgtgccctggctgttatttttcttgtttcctgcccctattccttcctgatacttttatccctcacatcctattttcttccttgtcctctctttgtttctgtttatttatgtgtacctctttcgcttattcctgttattctctttttccctcctctcctcatcaccctgtcttcttttcatgccttttttttttcttctaccccttttttctttcctctttctattctttctt

SEQ ID NO: 583123 - DNA, 246 bp, Homo sapiens
gtgggggccggaacccctcttttttgggccaaaggggggccccttccctcccttttgggccccttaaaagggggtttttggcccaggcccccccttcccaagggggggggggggtttgggtttccctttttttttttttttttgggggtcctttggggcccgggttgggggggggagggggggggtttggggggggtttttttttggccccgggtttttgggtataaatttttttgggttttttta

SEQ ID NO: 583124 - DNA, 187 bp, Homo sapiens
ctctttgggtggctctttgtgaagggcagggcgccctggaatgggttcgccccaagagccccaccatgagccacgccatgagccacccaaagcgccccccaaagagccacccaaagagccaaccatactcccccaagcgccacacaaagagccgcgcgaagggccacgccatgagccacacaatggg

SEQ ID NO: 583125 - DNA, 178 bp, Homo sapiens
  misc_feature (5)..(5): n is a, c, g, or t
cgggngttatagtgaggagttagtgtacaccagtaataagttagtctggccaagaattggtctggaatttggattgtcgatacctccagagttagatcggcttgatgccctgcggttacttacgaaactccttcaggaaagctagtttttccctgcttcagtttctgtgccggatgtg

SEQ ID NO: 583126 - DNA, 259 bp, Homo sapiens
  misc_feature (28)..(28): n is a, c, g, or t
ggtcggacctcagtcttcgtcctcaggntgaagcaaagttctttgatgtaaccccgcctacattggcttcttcaatgtaatgagtcagtcgtactgatgggagcaagaccatctggcgtcccatcagcgcacaaactttttttttttttttggaaatggattttggctctatcactcaggtgggagtaaaagggtgcaatctccattcattgtaccctctgcctctcgagttccagccatttctcctgcttcacccttc

SEQ ID NO: 583127 - DNA, 110 bp, Homo sapiens
accgtacgccacatgactgcgtatgatgttcacctattggagctcccagtgggaagtcaacctgaccgtcctcagggagccagagtgtggaaacacccccaacgccatga

SEQ ID NO: 583128 - DNA, 394 bp, Homo sapiens
  misc_feature (104)..(104): n is a, c, g, or t
  misc_feature (120)..(120): n is a, c, g, or t
  misc_feature (394)..(394): n is a, c, g, or t
gcctaggagttttaatccaaaactgtttcctttccttgtccctttcactgcccctaaaacttgccaatcaagttcctcagattaatttatcaaaagtcagagancggccgggccgccagntgtcacgccctgtaatcctagcacattgggagaccgaggcgggcagatcacgaggtcaggagttcaagaccggcctgaccaacatggtgaaaccctctctctactaaaatacaaaagttagccaggcgtggtggtgggcacctgtaatctcagctgctcaagaggctgaggcaggagaatcgcttgaacccaggaggcagaggttgcagtgagctgagatcattccacggcactccagcctaggagacagagcaagactgtgtctcaaactttn

SEQ ID NO: 583129 - DNA, 240 bp, Homo sapiens
tctagagtatccccctaaaagcaatatcaattgagacgactctaactcagatcgttataccacagatttttctatattctaggcatctaagctagacactgtttatatcactgtttaacgttattagagatcctcccctcaaagagctagatcaataacacatacagatccttcagcaatgtgacaagtgctaaaatacgatatgtaaagggcacagcatacaggattacagagtcataa

SEQ ID NO: 583130 - DNA, 263 bp, Homo sapiens
  misc_feature (1)..(1): n is a, c, g, or t
  misc_feature (37)..(37): n is a, c, g, or t
  misc_feature (52)..(52): n is a, c, g, or t
  misc_feature (127)..(127): n is a, c, g, or t
ntcacacccagtagtccccagctacttggggaggctngaggtaggaagactngcatgagccccaggagttccagcaactatagtgagacctcatctctacctaaaaattttaaaaaatggctgggcngtggcagtgctcacccgtaatcccagctactcaggaggctgaaatgggagaattgctcgagcctgggaggttgagactgcagtgagccgtgatcatgcgcttgactccggcctgggtggagagcgaagtccatctt

SEQ ID NO: 583131 - DNA, 129 bp, Homo sapiens
cttccgcggtgactcagcccaggacactcgctgatacctgcccccttcacacctggcaagcagggatgcccggcatcagaagaatgtttcgtgtacgaaattggttagaggggtttagggtttattatt

SEQ ID NO: 583132 - DNA, 652 bp, Homo sapiens
  misc_feature (15)..(15): n is a, c, g, or t
  misc_feature (23)..(23): n is a, c, g, or t
  misc_feature (60)..(60): n is a, c, g, or t
  misc_feature (68)..(68): n is a, c, g, or t
  misc_feature (104)..(104): n is a, c, g, or t
  misc_feature (112)..(112): n is a, c, g, or t
  misc_feature (131)..(131): n is a, c, g, or t
  misc_feature (145)..(145): n is a, c, g, or t
  misc_feature (150)..(150): n is a, c, g, or t
  misc_feature (158)..(158): n is a, c, g, or t
  misc_feature (179)..(179): n is a, c, g, or t
  misc_feature (182)..(182): n is a, c, g, or t
  misc_feature (188)..(188): n is a, c, g, or t
  misc_feature (191)..(191): n is a, c, g, or t
  misc_feature (204)..(204): n is a, c, g, or t
  misc_feature (237)..(237): n is a, c, g, or t
tgagaccggatcccnaggatccnccgggcccatccccccattcccctaagggagggaccncccacccngttcccaccagatggcccactggggttgccaagttngccagagnctgggtgtagtggctcacncctgtgatctccancattngggagccngggccaggtgattgcttgagnccnggagtncangacccagcctggncaacatggtaaaacctcgtctctacaaaaaatncaaaaaaattagctgggtatggtggagtgcgcccgtggtcctagctacttggaaggctgaaggagtctggggagtttgaggctgatattgcgccattgcactccagactcggcaattggagtaagaccctgcctcaaaaaaaaaaaaaaggaaagtatagaaaaatatatttagaaaaggtaagagaagttgagttcccagttatctagaggcaagctaatatggatattttggtatatatctttccatttttttattattaaagaaaaaattttatagttttaaatttgtttttctacatatttattataaactcagctataattatgtctcatgactttttcactttatattattatgtgagcagtttctcttgttatatttttctaaaacagctttatttagatattattca

SEQ ID NO: 583133 - DNA, 589 bp, Homo sapiens
ccaagaggcgtttttgagagtggaaaagaaatttaaacttcccgaaagaaggtccaccatcaggagatgaatatggaacatctcctatgtaccaggcactgtgctaagtgctggaatacattatctcattgaattatcacaacgaccttttcaagtaggcattatcaccatgcgacaggttgaggaccgtgaggcacgctggagttatttgactcgacttgcccagggtcccaggtcagtgctcctcaaacctgaacatgctaagagtcacctggaggtccagttaaaaatgtacatctggccgggcgcggcggctcacgcttgtaatcccagcactttgggaggccaaggcgggtggctcacctgaggtcaggagttcgagaccagcctggccaacatggggaaaccccgtctctattaaaaatacaaaaattaggccaggcgcggtggtgcacacctgtaatcccagctactcggaggctgaggcaccagaatcgcttgaacttgggaggcagaggttgcagtgagcagagatcgtgccactgcactccagcctgggggacaagagtgaaactacatctcaaaaaaa

SEQ ID NO: 583134 - DNA, 321 bp, Homo sapiens
agaaggttgcagatggctcatacctgtaatcctagctctttgggaggccgaggttggcggatcacttaggccaggagttcgagaccagcctggccaacatggcgaaacactgtctctactaaatatacaaaaattagccgggtgtggtagcgcacacctgtaatctcagctacttgggaggcggaggtgggaggatcaactgagcctggagaggtcaaggctgcaatgagctgagatcacgccattgcactccagcctgggcaacagagtaagactctaacttaccaccccccgaaaaaaacaagggggtaccggagctcg

SEQ ID NO: 583135 - DNA, 571 bp, Homo sapiens
  misc_feature (547)..(547): n is a, c, g, or t
tcttctgccagatatcctaaatcctctctgaagtttaaggttccacagatctctagggcaggtgcaaaaatgctgcagtctcttgctaaagtatagcgagagtgacatttgttccagttcccaataagttcttcatctccatctgagaccacctcagcctggactacattgtccatatccgtatcagcattttggtcaaaagcattcaacaagtctcttggaagttccaaacttttcctcatcttcctgccttctgagccctccaaactgttccaacctctgcctgttactcatttccaaagtggcttccacattttcagattatctttgcagcagtaccccactctgctggtaccagttctctgtattagtccatgttcacactgctataaagatactacctgagactgggtaatttataaagaaaggagttttaattgactcacagttctacatggctggggaagcctcaggaaacttagaattatggcagaaggggaagcaggcatcttcctcacaaaggtggtaggagagagagagctcaggngaaactgccacttttaaactatca

SEQ ID NO: 583136 - DNA, 223 bp, Homo sapiens
gcccaagatccctccgatatcttccccctctgtcctccgtccggaccagctcgttatgctgtcagaggatggagagccactctcaagaggcacctcccaccatccggctccccgactgcagcccgggcgcgcccatcctatcgccctcccgacagctccacgcggttggccccgcgcgcaccgccactcgccgcgtgttgacccgattattgtctatcgcaga

SEQ ID NO: 583137 - DNA, 479 bp, Homo sapiens
  misc_feature (99)..(99): n is a, c, g, or t
  misc_feature (118)..(118): n is a, c, g, or t
  misc_feature (165)..(165): n is a, c, g, or t
  misc_feature (196)..(198): n is a, c, g, or t
  misc_feature (223)..(223): n is a, c, g, or t
  misc_feature (229)..(229): n is a, c, g, or t
  misc_feature (264)..(264): n is a, c, g, or t
  misc_feature (273)..(273): n is a, c, g, or t
  misc_feature (279)..(279): n is a, c, g, or t
  misc_feature (289)..(289): n is a, c, g, or t
  misc_feature (300)..(300): n is a, c, g, or t
  misc_feature (308)..(308): n is a, c, g, or t
  misc_feature (321)..(321): n is a, c, g, or t
  misc_feature (338)..(338): n is a, c, g, or t
  misc_feature (353)..(353): n is a, c, g, or t
gcgaaactgggtttcaagttaaaaaaagaaagcaaggaaagagtaatttccaacgaaggaaaaaaacccccagcacccccttcgcggctgtcagcgctntcctaatgtcacagtggcngggtgtccttggggtgggtaaggtgtggggagcccagcccctggccntgcctcccgggccccgctccccttttttttnnnattgggttaagccaaagcgaggccnccgctngtttcaaaaatgaatttgttttatagattataaanaggcaaaancagggnatgtataaancagaaggcccncctttccnggttattttttgncccaaattgtaaattanattatttattttttnccaattttgggaataaaaggtgttttggttatttaatataataaaagctgttaaacttttgtttaaatttccagttcaacttgtaaatgtttttattgggcataaaaacaaactaatgttgtttta

SEQ ID NO: 583138 - DNA, 427 bp, Homo sapiens
tcgaagatggcggttgggcgcgagggagtgaggtgcagagaaacctcctgaggtacagaagtgggggcgagactggagagcggagagcaccccagtggccccacagtctggcggcagggctgaataccagaggcctcccacagttccagaagctggcgactttaaaacataaagacatccctggaattctgccagggctaagatcccaagctctgctgaagggaaagtcctaattctactctgaacacatttaaagccggtggtaaagaaactccaataaaagctgcccctaaactttttttttttttcaagaaagaaacaaataaagaataaatattttttttacagatgaggttcacacagcccctccctcttgtggctcaacaggagaaatgtgtgccattttcttatttgtttatttgtttta

SEQ ID NO: 583139 - DNA, 516 bp, Homo sapiens
tctgtggtacgacgactgcaggagactgaaatgacacgaatcatttgggaattgattacagagaaactcatttttccctacgtggaattggatctacatagctatgatttaggcatagagaatcgtgatgccaccaacgacaagtcaccaaggtatgctgcagaagctatcaagcagcataatggtggcgtcaaatgtgccacgtatcactcctgatgcaaagagggtagaggagtcacagtcgaaccacatgtggaaatcaccaaatggcaccatacgaaatatcctgggtggaccggtctacagagaagccattattctgcaaaaatataccccggtcgagagtgacatgggtacaaacctatcatcatagttacgatcatgctatatgggggactcaaaaccacaacagatgaatagtagtcatgggactggaacacctccacctcacctacccaaaagtgacgaacccaacacgtacatacctggtaataaaatggaggcttacattcaaag

SEQ ID NO: 583140 - DNA, 716 bp, Homo sapiens
  misc_feature (527)..(527): n is a, c, g, or t
  misc_feature (562)..(562): n is a, c, g, or t
gagcttcataacatgcaacctgaccttgcagaggtcgcgtgctgtgggatgacagcgggacgggagctcacaagtgctttcactgaagatttgttcatatactgtgtattgattgttgtgtaatatatcatcattgcttttgtaaatacgtaaaactgtaattttttaatggtgtgcttcccttatacttttttgatcagagaattttggaaagtaccaaagaagcaggggaatcattggccagtgttacgttttcacattgtctgtctcccaccctcactgatcacgcctgccccagagcagtgtgtggcggtgacaccgtcacccagcatgcgccacgccgtggctcccaccagcagtgccaccgtcaccacaccccagatcccacccaccttgcagtggcctttccttgtcatcagagtacagaatgcacaggtgttggtgagggcgtgtggctgaacactacatgtcaagttcagagtcagtttctatcccatttctcctgcaggcttgagacggatcttgtnttcaatgtcagacaaaagaggctttttttgtgctntgaccatctagcactttaaggattaaagggatgggaaaatcctgatgcttgatggagtttttttttggggccacacgtgggaaccccaggctttactccatcccaatggaggcttttcttttttgataagcgcagggaaggacaactatggtgg

SEQ ID NO: 583141 - DNA, 420 bp, Homo sapiens
  misc_feature (2)..(2): n is a, c, g, or t
  misc_feature (15)..(15): n is a, c, g, or t
  misc_feature (405)..(405): n is a, c, g, or t
anttcggcacaggantttttatttggggctgaattatttttaaatgtaaagcaagatgtctaaattacattaatatgttactaaattactatgatttttccagaaaaatattagcccatgcaatattctttaattcctgtgattaagttggtcttctgcaaagaaatttctgttgacttccttagattaaatgcagccctgagataggtgtgcaggtccaggaagtggcctgtgcagttctccctgtgcctgcaggggtggcttcttgaggatactttcgcagtaagggcttagcaatatgcgcatgtctaaggagtctatcagaaaactacctccactgtggaagggcttggggatttgtattttttgtgcttttgaagcaccctgtacacttgctgttaactnccatttaactgaaga

SEQ ID NO: 583142 - DNA, 161 bp, Homo sapiens
ggttattgatgaggcagatcggggagagtagatcgacgcctgaaggtcaggattgtggaggccagatggaagacgttgttctcaacgcccatgtccgcatacagctgagcaagacggacaaaactctggttggtagtttcgaagtcagcgatggcatcggg

SEQ ID NO: 583143 - DNA, 175 bp, Homo sapiens
acgagtgaggaaagaaggtagacgagtgaggaaagaaggcagactagtaagaaagtgactaataaggaaagaaggcagactagtaaggaaggaagactggtaacaaagtgactaataaggagagaaggtagacgagtgaggaaagaaggtagccaatattctgagcttgaagttt

SEQ ID NO: 583144 - DNA, 285 bp, Homo sapiens
  misc_feature (2)..(2): n is a, c, g, or t
  misc_feature (18)..(18): n is a, c, g, or t
  misc_feature (22)..(22): n is a, c, g, or t
  misc_feature (109)..(109): n is a, c, g, or t
  misc_feature (189)..(189): n is a, c, g, or t
  misc_feature (213)..(213): n is a, c, g, or t
tnatcactaagaattgtntgtnaatgcttccgtttggttttaagatgaagttatttcctttactacagtaggcctcaaagcagtccaaatctccaatcgcagattctanaaaaagattgtttacaacctgctctatctataggaatgttcaacactgtgactcgaatgcaatcatcacaaagtagtttntgagaatgcttccatctagttttnatgtgaagattttccttttccaccacaggcctcaaagccctcccctggcctatccctggaaataaagaacag

SEQ ID NO: 583145 - DNA, 737 bp, Homo sapiens
aatcccagcactttgggaggcagaaggtgggtggatcacgaggttcaagaaatcgagaccatcctggccaacatggtgaaaccccatctctactaaaaatacaaaaattagctgggtgtggtggcacgcgcctgtagtcccagctacttgggggactgaggcaggagaatcgcttgaacctgggaggcggaggttgcagtgagccgagatcacgccactgtactccagcctggcgacagaacactccgtctcaaaaagaaaaaaaaaaagatataacatttgaatccataacaagaccattgtgaccatgctaaggacttttaaatatgaaagcaaaatgcacgtggaaagaatgtgtgagtgggagagaagagctcaaatgcaggaaaaggaaagaccatttcctccttggacaatcttttagaaggaggggcccacatcccttcttccagtacacagggccctcacacatgaagcgggagcgccacctctgcgctgtcagaaatctgggagatgtgtgaattctccctcctgctatatcatgaacaaaggaaaccaaatccatcttatcaccttttacaacaaaccactttgggtaagaaaatcagcttacaccatagaacctatgagaaacaaatgacaatggcccttagtcttctaagggtcgggaggaacctgcctaaatctaaccggagtatcaacatttttagcctttaaaactatgtcacccttcagaa

SEQ ID NO: 583146 - DNA, 342 bp, Homo sapiens
  misc_feature (248)..(248): n is a, c, g, or t
gaagcgggaaacactacgggcactattccagaagagagtcaccggtccagctccatggagccttgagatggagcccctgagtcctttgaggatgtggctggcacagaagatgagtcagtctgacagtggggtggacctgagatggggattctcagagtgtcatcaaggtcccatgcagccagcgcaagttcccactgatgagaggactcaacgggggcagcaagagggaccccccatagaggcctggnaggctcctacacccctagaatgctgttaccttggtgagggtccaccatggctcttgaacctccttaggagaccaccactctgcccccctacgat

SEQ ID NO: 583147 - DNA, 217 bp, Homo sapiens
ggtcgctcagaggatccccgcgctagcggcatagtgaacgaaggcctgtggtcctcatagtagttattattttttctttttcttttctttctttccttcttcttttttttttttttccgtctttttagggctgccccctgggcttttgtgggtccccgggctgggttcgaccggggggtttcgccaggggccctacacccgtttcatttagtggccg

SEQ ID NO: 583148 - DNA, 227 bp, Homo sapiens
ccaccttcacttagtcgctagggtcagtgctggaaagcgccctacactacctgcgctgacaagggccctatctactactgtcgtgtgggagtggttccgggctagagggagctagctccttagcacctgataaagaaggtgtctctttcatccatggttaagtcataaaaagcttattggtttaggtttagactcacctgaaagttttttttggtttaaaagaagaa

SEQ ID NO: 583149 - DNA, 499 bp, Homo sapiens
tagatccgggaaaagttggccatgtgatgaggacgactgggaggcttgaaatctccgttcaacaagaaaagtattggcatgtgtctatagagaattaccgatgacagagtcgtacgatggatcgagacaagtcgtatacatacttgaggaacgcatggcacaagaatgaacgagttgtttgtcagccaatactgtggaagaaattatggaaaagttacatggagatggtacatcttttggccctgagagcaattgaaggtaatgtaatgaagaatgtctcctaatgatctcgtagaacgatcgacactaaggcaactcatggaggggtctacaaagacttgcaagaagtactaagctatggagtatcggctaaggtcaagcccgtatgaggaggtcatgagtttcatgataggcgtttagagcttgttgtgaacttggataaagaccaggagtaccaaaagtggaaaccagatgactctacaaagaagtaactgaggag

SEQ ID NO: 583150 - DNA, 728 bp, Homo sapiens
  misc_feature (10)..(10): n is a, c, g, or t
  misc_feature (101)..(101): n is a, c, g, or t
  misc_feature (117)..(117): n is a, c, g, or t
  misc_feature (139)..(139): n is a, c, g, or t
  misc_feature (176)..(176): n is a, c, g, or t
  misc_feature (182)..(182): n is a, c, g, or t
  misc_feature (186)..(187): n is a, c, g, or t
  misc_feature (193)..(193): n is a, c, g, or t
  misc_feature (197)..(197): n is a, c, g, or t
  misc_feature (201)..(203): n is a, c, g, or t
  misc_feature (206)..(206): n is a, c, g, or t
  misc_feature (209)..(209): n is a, c, g, or t
  misc_feature (214)..(214): n is a, c, g, or t
  misc_feature (216)..(216): n is a, c, g, or t
  misc_feature (223)..(223): n is a, c, g, or t
  misc_feature (226)..(226): n is a, c, g, or t
  misc_feature (229)..(229): n is a, c, g, or t
  misc_feature (231)..(231): n is a, c, g, or t
  misc_feature (234)..(234): n is a, c, g, or t
  misc_feature (237)..(237): n is a, c, g, or t
  misc_feature (241)..(242): n is a, c, g, or t
  misc_feature (249)..(249): n is a, c, g, or t
  misc_feature (313)..(313): n is a, c, g, or t
  misc_feature (329)..(329): n is a, c, g, or t
  misc_feature (333)..(333): n is a, c, g, or t
  misc_feature (337)..(337): n is a, c, g, or t
  misc_feature (340)..(340): n is a, c, g, or t
  misc_feature (343)..(343): n is a, c, g, or t
  misc_feature (355)..(355): n is a, c, g, or t
  misc_feature (357)..(357): n is a, c, g, or t
  misc_feature (364)..(364): n is a, c, g, or t
  misc_feature (368)..(368): n is a, c, g, or t
  misc_feature (370)..(370): n is a, c, g, or t
  misc_feature (373)..(373): n is a, c, g, or t
  misc_feature (378)..(379): n is a, c, g, or t
  misc_feature (381)..(381): n is a, c, g, or t
  misc_feature (390)..(390): n is a, c, g, or t
  misc_feature (392)..(392): n is a, c, g, or t
  misc_feature (438)..(438): n is a, c, g, or t
  misc_feature (449)..(449): n is a, c, g, or t
  misc_feature (457)..(458): n is a, c, g, or t
  misc_feature (466)..(466): n is a, c, g, or t
  misc_feature (470)..(470): n is a, c, g, or t
  misc_feature (479)..(479): n is a, c, g, or t
  misc_feature (484)..(484): n is a, c, g, or t
  misc_feature (506)..(506): n is a, c, g, or t
  misc_feature (509)..(509): n is a, c, g, or t
  misc_feature (531)..(531): n is a, c, g, or t
tttcttcctnatttttagcaggtttagaggctgcagcttgagctacaatcaggagggaaattggaaggattagcagcttttaaaaatgtttaaatattttntttttttaatttgttnatccttattaatttcatttttncaaaatttatttttccttcttttttccccattttttncttttntaanntattcnttantttnnntanttnccctnancttcatncancantnttnatntttnnccatttntctggtttccatgtattctaggccaggtaggcaacacagagccaaggcgggtgctggaaaccanacggaacagtgttggncagnaagntgnatnctgttgtcatgnanctgtggnagtngncantcgtnngntggtggccntntcgggtcacatgttcacagtgcagctcctggcagacttgggttttntctttggtggnttttaaanngccttatntgcnaacaacttnttttntccttcaggaactgtgaatggntanaagaaggaggtcagtaaactanaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtaaaaaaaaaaaa

SEQ ID NO: 583151 - DNA, 1419 bp, Homo sapiens
gcctgggcctgcccacactggagcctgctggctgctgcactgtgaatgctgtccctgcctgccacaattgctgctgtgctgaatgcaggctgtgcctgcgaccttggctgaggtggtccctaactgtttgcctgctctggcatcctttagaacctgtgccgccccgtgacgcctgcgcggggaccccagtctgccctgctgcgccccatgcgctcactcttcgtgtagccctggacccggtgcccggacgccaatcgacagcaacgctggaagcccagcagccggagttgacaggtgacactatggcctggcatagcatggctgccaccatgggacacaaagaaccacgcaccacaagagcaacaagaaggagaacacgacgacacgcagcatcggagaagaccacaccgagcatcacaacacagagaaaccaagcacaataacaaagaaagagacagaccgagacaaaacacgaaatgacccacaaaagttgcacacaaccctcgaaaaagcaaaacaagacaaccacaaaaagacagacgcacgcacacacaccacacccacagaataagaaacacacactaaattatccctaaataatcacataaacaaatactattcaacaaaaaaaataaattgaatacacaacaaataccaacataaatacacccacattatcataaaccaattaaccattatgcacacccacaataataataaccaatcaaccatcaatcttaacaaaacattacaaaaacaacacaccagcggtcacgacgaagaggactggataccagtaaagtaatgaagaaagccgatgacgagcaaggcgccaggacaacgccaagagcaagagaagcaaatagaaaagagcagtggccgacacaggcaccggatgcgaaaagacaaagacaagccgaaaaagagtacataaggacagggacagtcggagtaaaaatgacacatatcacacaaacaacaactacacaaactcacatgacactacccatacaacaccacacaatgagaccaccacatccagacagaccatcaaacacaaccaaccatcacacactaagaaaacaacaaatcaaaatataacacacaacccacaaaactaatatcaaatcaaaaataatatattatcagtcactatcaacttatacatcatacatacatctaaacataataccaagacacacaatctgtcgattcaagatcttaataaccacatcgatcctgttaccgatatatccgtagctaagaatcaaaaataagagaaagacacttgaacatcgaactcgacacatcataaatctctacaactaaaaggactatacctcacaagagagaagtaaaactacaggaatatacatgaagtactatacatgctaattagcatacatctgacaaatagtc

SEQ ID NO: 583152 - DNA, 175 bp, Homo sapiens
tggcagatggagtttcactcttttggcccaggcgggagtgaaactccatctcaaaaaaaaaaaacaaaaacatctttaagggtttagttttattttgtgggttttctctggctcaaagaggcgtgggaacgaggaagcaagcattggagttgcacaaagggggaggtgcctcccc

SEQ ID NO: 583153 - DNA, 166 bp, Homo sapiens
agatttaattccaggcagggtggggatagaaataattgacacgctcttcagctaaatttattctttacttgaaaacttctgtctggccaggcacagtggcccacgcctgtcatcccggcacttggggcagccgaggcagatggatagcctgaggtcagtatagata

SEQ ID NO: 583154 - DNA, 138 bp, Homo sapiens
tagaggataccaccacacacaagacaggatgtgaaggatgcagaagtagcaggcagattgttgtcactgaagaggccatctttggatctcaagaatttaagaagaatcagggaaccgtactaaaattgaccagggcca

SEQ ID NO: 583155 - DNA, 228 bp, Homo sapiens
ggcacgagcgccccaataatgcaaagtagcttaatcttgctcacaatataaaatttgtggccaggcacagtggctcacgcctataatcccagcactttgggacgctgaggtgggcagatcacctgaggtcgggcgatcgagaccagactaactaacacgaagaaaccccgtttctgctaaaaatataaaattagccaggcatggtggtgcatgactgtaatcccaact

SEQ ID NO: 583156 - DNA, 269 bp, Homo sapiens
aaaaatatgaccccccttatactctcataggtagactgaactgtttactgagcacatatggaagcattgtattaacttgtcgtaatattgtcaaagttaaggatccaagagaaaactccagctgtgaaagcaacataaatggattttaaactgtctacggttcttaacctcatctgttaaggttcccatgcctggagaagctaatgccaactcatcatgtgataattcaatttgcacaataaattatgaacccggaagaagaaaatgat

SEQ ID NO: 583157 - DNA, 494 bp, Homo sapiens
gcggatgatcacatgtctcggaatatcgatagtggtgatgtttacacaacaatgtgactatactaaaaacacttaatgtacaattttaaaaggtcgatttgatggtatatcaactatatctcaaaaaagctattatagaaaacatttcaaaagcaaattttaaaaagcttatatggcatttaatatttaaaactgatttacatgagtaattacacaaaaccatttacgttttatttttgagacagagtctcgctctgttgctcaggtaggagcgcagtggtgcgatctcagctcactgcaaccttcgcctcctggttcaagcaattctcctgcctcagcctcccgagtatctgggattacaggcacatactatcatgcctgggtaattttttgtatatttagtagagatggggttcaccgagttggccaatctggtctcgaactcctgtactcaaatgttcccccgtggccggccatgaataagatttgaatag

SEQ ID NO: 583158 - DNA, 181 bp, Homo sapiens
aattggcgcacggaagatttccgtatgttaaaaaatggatctttttggaggctaccaccattaaatccgtacttgcatggcatgtcacaggagcaagacacacaggcttttttaagaggacccttgtaaaagggcgcacttatggaggaccacagggatacttggaggacattttcgggga

SEQ ID NO: 583159 - DNA, 102 bp, Homo sapiens
gaaggatggttgtctttgggtatactacagcgatggctattgaggagtatctgaggcatgggggtcagggtagaggtctggagagtgtaaagtggggtagcg

SEQ ID NO: 583160 - DNA, 158 bp, Homo sapiens
ctggcttatgttagaatacaaatctttattattctgaaaaccacagcaaaggcacctcagtaatctccagtgtaccctagtctcagtatgcctgttcatgtggggacagagagtgtgtgctgattggcataggtcatacgccttgtctagtgtctgca

SEQ ID NO: 583161 - DNA, 532 bp, Homo sapiens
gtattagtatatatatatctacatactagtctcatacatgtgtataattgcaatgtttcccaatgtgtggatgtggttctttaacagtttcttttggcccaaaacttatattttgaatgaagtgcagttattctatttattcttttcttgcctgtgcttcaggtgtcacatctgaaagaaaccattgtctaatccaaggtcacgaaagtttaccctgtgccttctgctaagagtcgtatatttactcttacatttaggtctgtgatccattgggttcattctgtgtatgagggaaaggtccacatcagttcgttggcgtgtggatatccattggcccaggacctgttggttgaaaagatcattcttccctcatcattggttatactttcacctcagtagttgtgtagcgaagtatgtatattaaatcttttataggcaaccttgcattgaaactttgtgctctgaaccatctaactgtattcaggctgggtgtggtggtcattcctgttatcccagaactttgggagatcca

SEQ ID NO: 583162 - DNA, 521 bp, Homo sapiens
gtagaaacttatgttttataaaggcagaacctcgatcacaagaagcatgcgccctccacaggtgggggttgggggctccaggactacactgccagggtcccactcccggctctgtacgggctatggggtgcccgtgcacaaagacgggcggggcctccatttgcttcttcctgaaaagggcgtgagacgtttcccacgggcccttggtccttggtgagagcgaccaggccgactccaaacattatttgaaagtcccccccctcggccgggaacatctttcgccgcccttcagccgaatttcctgaagcccggggatccactaaattttaatcggcccccaccggggcggaaatccagcatttggttcctttagtgagggtaaaaacgcgccccgccggaaaacaaggccaaaactgtttccccttagaaatggtattctgtccccacccccaaacaaataaaaaaccgtggaaccctaaagtgtaaaccctgggggtgccaaataaagggagcccaattcc

SEQ ID NO: 583163 - DNA, 804 bp, Homo sapiens
  misc_feature (27)..(27): n is a, c, g, or t
  misc_feature (86)..(86): n is a, c, g, or t
  misc_feature (138)..(138): n is a, c, g, or t
  misc_feature (160)..(160): n is a, c, g, or t
  misc_feature (168)..(169): n is a, c, g, or t
  misc_feature (181)..(181): n is a, c, g, or t
  misc_feature (224)..(224): n is a, c, g, or t
  misc_feature (278)..(278): n is a, c, g, or t
  misc_feature (337)..(337): n is a, c, g, or t
  misc_feature (352)..(352): n is a, c, g, or t
  misc_feature (420)..(420): n is a, c, g, or t
  misc_feature (423)..(423): n is a, c, g, or t
  misc_feature (428)..(428): n is a, c, g, or t
  misc_feature (462)..(462): n is a, c, g, or t
  misc_feature (492)..(492): n is a, c, g, or t
  misc_feature (564)..(564): n is a, c, g, or t
  misc_feature (572)..(572): n is a, c, g, or t
  misc_feature (579)..(580): n is a, c, g, or t
  misc_feature (582)..(582): n is a, c, g, or t
  misc_feature (593)..(593): n is a, c, g, or t
  misc_feature (650)..(651): n is a, c, g, or t
  misc_feature (666)..(666): n is a, c, g, or t
  misc_feature (681)..(681): n is a, c, g, or t
  misc_feature (684)..(684): n is a, c, g, or t
  misc_feature (713)..(713): n is a, c, g, or t
  misc_feature (736)..(736): n is a, c, g, or t
  misc_feature (742)..(742): n is a, c, g, or t
  misc_feature (751)..(751): n is a, c, g, or t
tgcctccaaatgcagtcatgacttgcncataatgtgaatttggcagcaaacacattggagggaccactgcagtagcatcttgaaantttaacatttctttccaagtatctgtatcaaaaccaaggaaaaaaccaaagnaaaacactaccaacagtatgantggcaagnngtacccgcaganggtttctacctccaagccagaaaacccaaatgcactgtctccntccacacagatgatccattgcccagggcttctatctttagccaccacggcagcngcaatagcaaatcccaaaccaacacccattgttccgaaagtaccagcatcaagcctgtnacgaggaagggagtnctgaagcacagtccgtccaatgtccatagtgatttgctccccacctacccacgaaacagaaacaaggnagnaaganactagaacatgggagaatactgtgtaaacaattncataggcagggaatttttagaagcccagtnccctcgggatgcagcctcattgctcttcattttttctctcagagttttccaccacccgctccccggaggganaccgccanggggggnntnaacaagtgccncctaaaagctgcttagtgacagcatgtaagtatcctagcaaagaaacagcggggccnnacattattccccaantcttctgccacaganatnaacctgggataacttcacatctggcgganatctgggaggcaggacaaaaagnaaaacnatatagacnggcacaaatacacaatacacagcaatagcaagcctggatctggctgcactaca

SEQ ID NO: 583164 - DNA, 230 bp, Homo sapiens
ttcccctttttttttggttcgaaccttgcaatgccgtcatgtttggagatgggtcagccctcttgcaaattggaggcagcaaggctgagggaaatgccctcctgcttcagagggcagaatggaaagaggagccttagatggccatggttcggttgggcagctgagtcaggtctggggcccctgcctttcggtttcaagggagaaaaataaacccctgtttgttggcctca

SEQ ID NO: 583165 - DNA, 333 bp, Homo sapiens
ttttttttagtttggatgctttttatttctttattttgtctgatcactctggcttggatgtcccatactgtgttgaataagagtggtgaaagtgggcatccttgtcttgttccagttcttagaggaaaagcttttcaatttttcccagtgagtaggatgttagctgtagattagtcatatatgccttttcttatgttgaagtgttccttctatgcctaatttgttgagagttttcatcatgaagcaatggtaagttttaccgagtgatttttctgcatctgctgagatgatcagatagtttttgcctttcatcttgttgatgtgatgtatcac

SEQ ID NO: 583166 - DNA, 244 bp, Homo sapiens
acgtctagagggagatgtcgacaagtcaccgcattcgaggtgccacaggcagggactgtcaagtagtccaggatttctctgagaacgggatatgtggcctttcaggttgcttgtaatctttcatctggaaacggggtgagggtctaccccaggagtactggcagacggcccaacacaggggggggtatgggctgcagggcagggaaggcatggccgactagataaccgtgtgagctgggcggga

SEQ ID NO: 583167 - DNA, 700 bp, Homo sapiens
  misc_feature (20)..(20): n is a, c, g, or t
  misc_feature (73)..(73): n is a, c, g, or t
  misc_feature (78)..(78): n is a, c, g, or t
  misc_feature (81)..(81): n is a, c, g, or t
  misc_feature (125)..(125): n is a, c, g, or t
  misc_feature (132)..(132): n is a, c, g, or t
  misc_feature (149)..(149): n is a, c, g, or t
  misc_feature (158)..(158): n is a, c, g, or t
  misc_feature (164)..(164): n is a, c, g, or t
  misc_feature (171)..(171): n is a, c, g, or t
  misc_feature (185)..(186): n is a, c, g, or t
  misc_feature (197)..(197): n is a, c, g, or t
  misc_feature (247)..(247): n is a, c, g, or t
  misc_feature (271)..(271): n is a, c, g, or t
  misc_feature (273)..(273): n is a, c, g, or t
  misc_feature (292)..(292): n is a, c, g, or t
  misc_feature (294)..(294): n is a, c, g, or t
  misc_feature (303)..(304): n is a, c, g, or t
  misc_feature (309)..(309): n is a, c, g, or t
  misc_feature (311)..(312): n is a, c, g, or t
  misc_feature (337)..(337): n is a, c, g, or t
  misc_feature (341)..(342): n is a, c, g, or t
  misc_feature (352)..(352): n is a, c, g, or t
  misc_feature (376)..(376): n is a, c, g, or t
  misc_feature (407)..(407): n is a, c, g, or t
  misc_feature (441)..(441): n is a, c, g, or t
  misc_feature (462)..(462): n is a, c, g, or t
  misc_feature (471)..(471): n is a, c, g, or t
  misc_feature (501)..(501): n is a, c, g, or t
  misc_feature (685)..(685): n is a, c, g, or t
acataagtggagacttctcnactttgtacacaattattctcactctccacagaaaggctgcttaacttctcanatggnggnggcaagcactaaaatcctgattttaacagaatagtagtaaaaanacctcantaatttaagtagaaaanagtacactngtacanaaatctngaacccagtatcannaatgtacaaanattttttattcaaaaatacaaaataaattatctgtaggcatggccaatgncagccgtcaaccattatatatttngncaactgccacccgtccctncnggttatcgnnttttncnncccgcctttttcttctttttctccncctnncttctctggngtttttgggggggggcactgcctngggcttcctgtcccagttcattaataagggnaaggccctagtctaggggttagaacaagccaccncccataccacctcccattccncccattgcncccattccagggtccttctcttctttaggnttttctgtgactacaacttctgctgtagttaacagaggggccaccccggcggcctccaataaagcagttctcacaacctttgttgggtcaatgattcctttttcccccatattcacaaaatctccagccatagcatcataaccaacttctggggggctttgcataattttctcaactatcaaanatccttcaacacctg

SEQ ID NO: 583168 - DNA, 886 bp, Homo sapiens
  misc_feature (477)..(477): n is a, c, g, or t
  misc_feature (488)..(488): n is a, c, g, or t
  misc_feature (490)..(490): n is a, c, g, or t
  misc_feature (492)..(492): n is a, c, g, or t
  misc_feature (515)..(515): n is a, c, g, or t
  misc_feature (517)..(517): n is a, c, g, or t
gctctgtaagccattaaacctttggaagaggcagctttgctggtagagtcgtaagtgaaattggaccaaaagtgagtttatgaagactggtgggcaggagctcaacagcgtgcgagggattgtccgtgcagccagtgtctgtatgtgccccagcatgggaaagcatgtatgaagtagctgagtatctgtatctgtggacctgagatgttgatccctcgcttcagattgacagtacctgatgcgctcagtgagagagacaaagtcaaatttacatgtgcacacaagagacgcagtacgtgcccagcgtatcgatgagcccagagttttctgttacaagggcgaacgatgaagactttgtgtggctacatgacactcttattgaaacaacagactatgctgggcttattattccacctgctcctacgaagcccgactttgatggtcctcgagagaagatgcagaaactgggagaaggtnaagggtctatnancnaagaagaatttgccaagatgaancnagaactggtaagctgagtatctcgctgtgtgaaaggaagactgtgtcctcccatgaagtcttgcttcagcgggtttcgttctcaccctgttctcagtaagagatcgcaagctttcatgttcttcctggaatatgagtcaggatctaagtgttaggcggaaataatactaaagagatgttcggtgggttcttcaaaagtgtggtgaaaagttgctgagtgaagttctttttactggagttgaaggaggtagattgagttcgatgaggcaagagaagaatttccttattaagtattacagtaggatcagagattctggtgtgaaatgctgacaaaagtgagatgatctcataaaaatgttgccgatgacta

SEQ ID NO: 583169 - DNA, 1296 bp, Homo sapiens
tctgtgtggagaatctgcagtgaatctagcgtcgctcggatatcacgggtaaggagatcggtcagccttgcgatggtatccgaggttggatgggagctgcccctaggatcgacaaggatctagcctatgacaacgtcctagcgaaatatagtggatagttagtaagccgagtccaatggtacgcctctttcgagtgtagaactctcacaacgtcacgttgagtgcatcattgcttcgcgagtactgaatttcgatccacggtgcgcaaattcgcaatgtacgacacagtacaatagtcatcgaagtcacaggcgtaaagcgtttagttcgcatccattgcgtgaaagaattctcattcaacgctttcgttttcgcaacgcgaaagcgtgagcactcctctgtcgccaaaggcatctagttgattgagggagtcggatttgctttggggcaggcctatgatatgcctacccgttcgagctagagaggtttcccctatcgggcgagctattttcccacccgaggacacctagagacggagagaaagctttgcgaggagcacttccaatgtctaagcgaacgaggttgggtgaccggcctatttggtttgggagctctaggtccaccattcgtgccataggcccgccctccaattctttgcgattggtgggtgcctcaacccttaattggcttttgccagatcccgagtgtggccatggcctaggcaaagcactatggtggaattgaccacaggttacttcgtaaacccttaggcttgtggcaccttaccgacagttgacgttccaattctggagacacaatcctttggggccgttcccttctgaggacgcccacaccaccgaaaaccacttgccggtgtaaagcgcacaccgccctcggcgttgttggccccttaaattgggggtacgacatttcccaatttgggaacaccaacactctgttactatggcggatttaattttcagggtttggggcaaatatgccggtaaaccgttaccaagattaggtaaaaccccacaccttttggggtaaacctccacatgaggggcctctcaatattagccaaaggcaataggaacggcatatccaacccgcgaggcgtaaaaaaggacaggcataagggctaggaggaaaattcggggggaaccggccgcccccgtaaccctctcgcccgcggttatgggacacacaccttttggatgtgggtgtgccccgaattgggacggtagtaaggccacgccggttaaggggggccgagggaccattgccgtgtgccac

SEQ ID NO: 583170 - DNA, 127 bp, Homo sapiens
gttatgacagaacatggcctgtcttggtggctcaagaggggtcagagacacctttgtgaagggtgggggagacagcagggtttcacatttggcagggcagggcagaacgggaagggcttgggggaga

SEQ ID NO: 583171 - DNA, 294 bp, Homo sapiens
tgcgcagcaaccaccagaccgtcatgtacgaacagtaccaacagaacctgcaaaaacaggcacaaaaacaggccctgagaccaggccgaagcaacgcgcgtaacctgtccaaccccaaatgccagttctggctgcaacaagaccagaacgcccccaatgaaaagacgcgggccaatgtcctgcaattctgcgattgatgtcaaataccgccatgaataaacacgccgtgctccagttgatcctggaaaagctcaccgtcgacctcgacatcgtccaacgcgccgcgcagagttt

SEQ ID NO: 583172 - DNA, 230 bp, Homo sapiens
tgaggaatggagaacacaaagcagggaaaggggattctctgtagaatgtggatttgattattattaccctgcaggggacggctggcgagtctgagggtctgagacccaggagagtcgagggggtcagctccagtctgagtctgacggggtgaattctagtgtgagtcagaaggcctgagacccaggagagccactggtgtgagttccagtctgagtctaaagtcctgaga

SEQ ID NO: 583173 - DNA, 336 bp, Homo sapiens
cgtcacagtatctgggccgcgtacgccccgccgttttctccgcgtcttgtcatcgcgcaggcctgaggagagtggataaatgtcttgagtgcaatacaaggacgagaatgagagactgggaggtcctagtgggtggggagccagcaaaaaaaaaaaaaaaaaaaaaaaaaagctagggctcgattttacccaagcgctgatctcaggtgaaagagcagcaggtgggaattccacaccttgagagagggagaaaagacttgcgttcgtctcgctccgggttttggccaaagttattacccggcactaattcactccattgttgggccttctggagaa

SEQ ID NO: 583174 - DNA, 155 bp, Homo sapiens
ggacagagcgggatgccaccagcttgtccaaagggaagttccaggagctcctggtgggcatcgttgttggagattgacgttggccgcggcgagatcaccgagttgaggcaggtggagggaagagctctcgtcacaacacccacagagaaaactct

SEQ ID NO: 583175 - DNA, 202 bp, Homo sapiens
  misc_feature (56)..(57): n is a, c, g, or t
  misc_feature (179)..(180): n is a, c, g, or t
  misc_feature (186)..(190): n is a, c, g, or t
tacctacctatccatccatcatctatttatcatctatgtatctcatctattatctnnctctctgtatctctaaattatctatctaatctatctaatgtcagtcaatggatctgtatctattgtctagttattaatcatctaatatgcttattatgtcatcaaatctatttatctattanntatatnnnnnacggtaggtatg

SEQ ID NO: 583176 - DNA, 152 bp, Homo sapiens
agctagcagaacaggagctcagctggtcacacacagcaacgaatacagacttgataagtcagagaagttaccaaacagtggtaaccataacatgtaccacatgaactatggggagggaggagatctgattacagagtaccacatatatacta

SEQ ID NO: 583177 - DNA, 502 bp, Homo sapiens
gtaaggttacacgtcccggccgtcgtttgcggcctacactgtctgccgtcgcggtcgcacggtatactataggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaagcaaatagagagaacccggacgttaaggggccattcccaagagtcgagagatcaatgcctggacacgggttaggggtccagaccggtagcctcaagaagacgcccaagggttgggtttggagcacaagctgaacggtcgggaaagcctgaaggcgacttcttatgagttcaaggcggaagaacagagtctcggcgggaaactcaggtggaccttccgggaccatatcctgtaccaggcttttctgctgaagcaccactggtgtgacggaagccac

SEQ ID NO: 583178 - DNA, 431 bp, Homo sapiens
  misc_feature (407)..(407): n is a, c, g, or t
  misc_feature (431)..(431): n is a, c, g, or t
ttgacttcctctcttcctatttgaatactctttatttccttctcttacctgattatcctggctagaatttccaatactatgttgaataggagtggtgagagaggacacccttgtcttgtgccagttttcaagggaaatgcttccagtttttgcccattcactatgatattgactgcaggtatgtcatatacggctcttaatattttgaggtatgttccttcaatacctagtttattgagagtttgtaatatgaagggatgttgaattttattgaaggcctttttttgcatttccaaatagatttttaaattcttggtttaattctaattattattctttttttttagattcaggatgtacatgtccaggttcgatatgtgggtatactgtatgacattaaggtacgngcttcttgatcctgctgctcatgn

SEQ ID NO: 583179 - DNA, 117 bp, Homo sapiens
gaccttagaggatcccggcttaggaggtatacagcaatcgcacagcaggagcttgtcatcctcatcccctcgagtaacacatccgacagacatatgactcaataaactgggcattgc

SEQ ID NO: 583180 - DNA, 169 bp, Homo sapiens
catgcatgcatcgtgcttgattgaagtaatgggggctgtctgtgaactctgcagcagtacagcccaggtaatttgctgagcctagagggtgtcagggtcagtccaagtgaaagtgaagagaggctgggacgaggggtgcaggggaatagtgaaaaaagcatctttaaga

SEQ ID NO: 583181 - DNA, 369 bp, Homo sapiens
  misc_feature (119)..(119): n is a, c, g, or t
gattttaagtagagacagggtttcaccgtgttagccaggatggttcgatctcctgacctcatgatctggccgcctcagtctcccaaagtgctgagattacaggcgtgcagcgtgcctgntaatttttgtatttttagtagagacggggtttcaccatgttggccaggctggtctcgaacccctgacctcaagcaatccacccaccttggcctcccaaagtgctgagattacaggtgtgagccaccgcactttgggaggtcgaggtggtagtatctcttaaacccaggagttcaaaataagcctgatcaacatagcaagactctgtctttacaaaagaaaaataaaaaattcagctgggtgtggtggtgc

SEQ ID NO: 583182 - DNA, 102 bp, Homo sapiens
ctgatcatagtgacgtcttgtcgtacgctctggatcatcagggtcagctctgtgtacgaaggggaaatgtaggtgaaggggcctttaggcaggctcttggcc

SEQ ID NO: 583183 - DNA, 160 bp, Homo sapiens
  misc_feature (121)..(121): n is a, c, g, or t
tttagtttacttctgttccaccttttattgaaatattagttgttaggctgaaagcctccagttaagaacttgctgagtttttttgttcagcaacttgacatttactatgcgcattatatanctcaattatgtctgttttttatgctaagtaggaaaacca

SEQ ID NO: 583184 - DNA, 278 bp, Homo sapiens
  misc_feature (22)..(22): n is a, c, g, or t
tagagatcctgttgctaggtgnagtgggtgggggatctcggctcatccaactttcactcccgggtcatgcattctctgctcagctgtgaatagctgtgatacagggctgcatatgccgactgatttttctatttttagtagagagcttcctgatagctgaacatgcagaggctgctgggaagggcatagaatctctgcagtccttctcacataccttatcctatgtatctcttcatctgtatcctttgtaatagccttcataataaaccggtaaacat

SEQ ID NO: 583185 - DNA, 209 bp, Homo sapiens
cgtccacgtatgatcccctgcacagccgatctgtccatcctccgcggagggggccagatcatccccacagcacggcgctgcctctaccgccagtgtgctgaccgcccagccacgcctcatgtgagcccatctaccttgtaggagatccagtgtccagagcaggctagatcagtggcatctacggagatatcgaacaggaaagcggggcc

SEQ ID NO: 583186 - DNA, 189 bp, Homo sapiens
cgagttcccatcatagaggccacggagacggtgacagggttcactggtcccaggggtcgaaatagtagcctattgtagtgaggactcaggtccactctcgcacaaaaatatacggccgtgtcttcagatgtgagacccctcaactccatgtaatttgtgcgcgttgactcgtccgtggcctctactaat

SEQ ID NO: 583187 - DNA, 1329 bp, Homo sapiens
acgcggcagcgcctctgtctcgctttttcttatttttcccccctttcccctttcttatattttatattttcttattcttttctcaccctcccccccttacaaaatttccccatacggaaggcgcttatcccgcgggacaggggcagaagcgggtctcacccaacggaggaagataaaacgggaacaacgaaaaacaagaagagaaaaagagaagaaacagaagagaaaaagagaggaggagaaaagagaagaaaaagaagagaaaaagaaccagaagacccatacaaagcagagcaacacacgcgagaacaaggagaaacgcacacaaaagcgaaagacagaaagaaacaagaaagagaaacagcggagcaagaaaaacaccagcaaaacaaagaaaacagaccacgaaaaaacaaacaagacaaaaccacaacacgacaacaaaacagaaacagaaagagaaaaaaaaagacaacacagaaaaagaacaacagacaaaacaagaaaacaaaaaaaagaaaaaacgaagaaagagacaaacaaagagaaacacacagcaagagaaaaacagagcagaaaaacaacaaagagaaaaaaagaaaaaagaaaaaaaacacaagcaaaaaaaaagagaaagaactacgacagaaaacacacaaagaaacaaaaaacacagaaacaagaaggacaagaacaacaaaagaaacaaaaagaaaaaaggagacaaaaagcaaacaaaagaacgaaaaacagcagagaaacgccaaacaaaaagagacaagaaacaaagaaaaaagaaagcaagaaaaagaacgacaaagagaaaagaggaaaaaaaaaaagaaaaaaacaaaaagaaagagagaagaaacagaagcagaacaacacacaccaaaggcggacaaagacagcaagacaaaacaaagcagagaacaaacaaagacagagcaacaaacaagagtagagaaagaacagacagaacaaaaaaacaaaaaaaaagaaacaagaagaaaaaaaagaaaaaaacaagaacaaagaaaagaaaaagaaagaagaagaaaacaacaaggaacaaaaaaaaaaaaaacaaaaaaagaaaacaaaaaaaaaacaaagacaaaagaacaagagaaagaagagagaaaaaaaaaaaaaaaaagaaaacgaaagaaaaagagagaaaaagaaggcgcgtgaaacaagaaggaagcaagagagtcaactagaacagaaaagaaaaaaaagaaacaacaccgcacagcatcagcaaaagagaacgacacgagacaaatagcgaagtaagactcgtgcgccgcgctgggtagcaaa

SEQ ID NO: 583188 - DNA, 525 bp, Homo sapiens
ttctgaagcttcacctattttgtttacatttacaaaagccgggctcgggggcgggataatacaccaatagcctctctccttgtacacttgatatagggatccacaaatgaaaacccttcacgctggtttaacgaggaatttggggcttatgagagatattttcctaagagcgaaaactcttctaaggaccacaggatcagaactactctatgcgctcacccatgggccccttgagctgttttccagtcccctaagggtgagacccaatgtcctctatccccggcctatatcgaaaaagcgcactggtgtatctgccatatgcggacctggccctgggtcaaaacgggcgaaaaagccttcatgcgttaacccggcttttacccagacccgttctgctagccccataccctctaaaacctttgaattattggacctcgcttgtgcccgcgcaggtcatcttatcctgaacgagtcctataacctgaacttcctttcaccaaggttggaaggagggggccgggtaac

SEQ ID NO: 583189 - DNA, 191 bp, Homo sapiens
gatcagctgttactagctatgatcatgtcatgctcatcctcacgctctaagtgagtatagtgaaatccggtcttcaaaatacgtcaatcgatctaattaaggaacaaagttaaaccgtacatcaggatctctcacacccttccaatattgccatctaccaccacttagctcaacccattctcccatctctt

SEQ ID NO: 583190 - DNA, 830 bp, Homo sapiens
  misc_feature (830)..(830): n is a, c, g, or t
gctcatgactatccatcgacgtgagtgaaggctactcgtcttcaccagctacgggacgaagacgggaaaatcgtgcgcgaatctcggagaaacgctgtgctacgtcgccctggacttcaagcacgcaggatggccgccgacgccctcctcctcttctactgggaagcaacgagccttatgcaagactgccgcggagtaggtcgctagagctcagtctactgcgagtatgggcgaatggagcggttccggtgtcccggtaggtcgtcggttccaagcactatccttcctgggtatggaatctggcggaatccacgaaagccaacttcaagtccatcaagatgtgtgacgatggcatcgatgccgcgaagagatcgctgtacagtcgaacaacagtgtgctgtcgggcggaaccactcatgtagtccgggtattgccgacaggatgcagaaggagatcaccggcctggcgcccaggaccatgaaaggatcacatgatcatcgctacccccagagcgcaaagtactctggtgtggatcggtggctccatcctgagcctcactgtccaacttccagcagatgtggattagcagagcaggagtatgagagtcgggtccactccatcgtccactcggtaaatgctttctgaaacggactcaggcagatagcgtgagcgattgcggcatgggttaatggagaatagaatatttggcccctggaaaatggcaaaactcatgttagctcacgaaatggaataagccttcgaaaagaaattggccttgaagcttgtatctgatatcagcgctggatgtgagaaatgttgctgatttgacn

SEQ ID NO: 583191 - DNA, 827 bp, Homo sapiens
gagccgtggaccagactgacacggctggtgctggtgaatgccctctacttcagcggccagatggaagactcccttccccgactccagcatccaccgccgcctcttccacaaatcagacggcagaactgtctctgtgcccatgatggctcagaccaacaagttcaactatactgagttcaccacgcccgatggccattactacgagatcctggaactgccctacccgacggggtacacccctcagcggtgttcgattgctgccccttatgagaaagaggtgcctctctctgccctcaccaacattctgagtgcccagctcatcagccactggaaaggcaacgatgaccaggctgtcccgcctcctgggttctggccaagttctccctggagactgaagtcgatctcaggaagcccctagagaacctgggaatgaccgacatgttcaggactagtttcagggcctgacttcacagagtctttcataccaagtagtcctctccacgtcggcgcaggctgctgcagaaacgtgaagatcgaggtgaacgagagtggcacggtggctcctcattcacagactgtcatagatctcagccgcatgggcccgaggagatcatcatggacagacccttcctctttgtggtcgcgggacaaacccccacaggaacagttctttttcatgggccacggtgatgggaacccctgaacctgggggaaaagacggccttgcatctggggacaaagacttggggatgcctcgggacacaaacacacactccggagaacaacaatttgggggggaacggcccccctgcggaggagacaaaatc

SEQ ID NO: 583192 - DNA, 323 bp, Homo sapiens
  misc_feature (63)..(63): n is a, c, g, or t
  misc_feature (93)..(93): n is a, c, g, or t
  misc_feature (102)..(102): n is a, c, g, or t
  misc_feature (119)..(120): n is a, c, g, or t
  misc_feature (152)..(152): n is a, c, g, or t
  misc_feature (154)..(154): n is a, c, g, or t
  misc_feature (229)..(229): n is a, c, g, or t
gtcctgttttattggaccccccctcccagccccaggggtgcctgtgggggtccatttgggtangtttgggcccccactttcaccagtttttgnggccttccnccgggcttgaaccacannggaggagttccgttaagacctccccacccccntngggggtgggggcgggtgtccgtccggaaataaaggaatagcccaaggcccgggctggggtttatttaaactgttntgtgtgggtttggggagggaaagccccttaatattattggggttggttggggtggggcaggatttcacccataaagtgccagtttgcttagtta

SEQ ID NO: 583193 - DNA, 713 bp, Homo sapiens
taaaaaataaccaacctttattttataatagtcttacaggaagcaaaatttcatttaatacaactgtgaggctgctataattctaatcgggcatcgtacctatccttacgggtcaaaggcaacgggaaaaatttgtccaattatagttgaactagtgtccctaatcggggtctcgggtggccagctttaaatgggttataactttctggtgaaccgaacagaaccaccaccgagagccccctccccctctccccaggtatcctgcaacacctgtgtgatatctataaagactgatctgaaagagtatagcgcctgcgtcaaataacaaacatggtaatgtttatactatcgtgtaggacaaaagaggttatacctacaaaggcaagagttctacccaaggtgttcaagggagccagcggagatctcggccgggcttaacgtctcacctcggtgtctcgtaggcaccctcgggattcctcctccataggggacgagacccatggggctagaaagtttcacccagtgtctatgtctcgaaaatccaatgccagggagatcttggaattctcgcgggaaatcccactgtttgaggtcgatctcattcacctcaacaggtctcttcagagctgctgtgcccaaggtgggtgcttccaggtggttatcctatgagcgccttaaagctccgggaacaacgatcagactccgctataggg

SEQ ID NO: 583194 - DNA, 1027 bp, Homo sapiens
  misc_feature (610)..(610): n is a, c, g, or t
tcaaattttttatatttttttaaggaaaaaaatttaaaaaagggtttttttcccttttaaataaaaaaaaaaagacaaatacccccatattctttctgttaaaagagaggagggggagagaggggaggcccatttagtgaagaagagaataggtcccatcatataccccaattttaagttagaatgggtggttctctacatttactgccacacagagagatagtaacatgagcaggggtgaaagagctctcccttactatcccacgagtatgctgcgtgttcaacaaataaaagcagtcagcacgacgtatgtcaggcggccttcctacattacgccgtcagcgagggaggaacaaatagatcacgtgcggcagatatatctcatcggagagggagagcgtgcggagaattgtccgatcatctgtctgtttcaactacaatagttaattaggggcgcaaccaccctctctccggggcgcgagatatatcgagcaagggttgattctcccccccaatggcttctggggtttttttgatcaacagatcctcctcggtgataatatgaagggagaccgacgaaccatttggtataatatagatagtagagcgnggaaagcccacgttggaggagatagtaacaaacaccccgcttgggcgcgcaagaaaaatcttgcgtggacagagaaatataagcaccattggggtaggagcgagccccagaagcgagaagagctcctgtcagtaagaaggaccaccacgcatcattagtggcgggagaagtggtccacccagggcctgtgagagcagcacgacgacgagaggatgtgggggctcccccaaaaattaagtgcgagaacagcgaacacaccactatctgtgggcgcggccgaccaaaaaacaaacaccggcctaaatgacagtaggcaagtgtcgtcactaacggggaccacccaagaggtggtaactaccaagtattcagccacaggggagaaaaaaatcggctaggaagcaccgaaggagactatct

SEQ ID NO: 583195 - DNA, 377 bp, Homo sapiens
tcgaatcaaaggctagccaggttataggagtcaacaggtgcaagagaagttaactgaaggatctacctggcaaccaaaggtagcaccaagcgagcgcttggaatgctgcaacaatgaatggaatccattatatcacacaatacgcaccccctgtaatggcctatcctgctacaacaccaacaggcatgataggatatggaaatcctccacaaatgggaagtgtacctgtcatgacgcaaccaaccataatatacagacagcctgtcatgagaccaccaaacccctttggccctgtatcaggagcacagatacagtttatgtaacttgatggaagacaatggaattactccaaaaagacaagtgcacaagcagcaaaa

SEQ ID NO: 583196 - DNA, 416 bp, Homo sapiens
gcaaaaacttgcattctgggacgatgctattctaagaaatgaaaatgcttcattccgaaaaataatgcaggaagaaaacaatcaaattttactattcaacatctgtgtacagtatcttatagaatgatgatgtgagacagggataatgttgaatttctttccctcataatgttgtaacctaagcccagacctactagaatgtacatacattcatgcactcattaattcattacacaaatatactttagtgccaccaaaaattaatataagagcaagggctctgatcttaagaagaatacaacccaaggggaaagagaggcctcatgcaagtatacacaacagttcagatcatcaaatatactctgaagaaaataaagcaagattatgtgacagagtactgaggagtcaaagaggat

SEQ ID NO: 583197 - DNA, 751 bp, Homo sapiens
aaggctggtaccggtctggagggtgtaaggatcagttgacagcacaaacaaagtcccggagatccgtgatgtaacaatggattgagcgaagtcggtgcccactcccacatcggggactgtggctggacgatgccttgcgagacctcggcagagcttcgcaagtgcatggtgggtcagctggcggtacgagcgggcggcgtggcgtggtgctggagatgatccagggaacgggaacgattgccggtcgggcagtccttatttgctggccagctcgggcacggtgaagacggccatcgccatgggcatggcgcaggccctgggccctgactacgccattcacagccatcagcctggcagatgaaatcttctccctgtgagatgagcaacgaccgaggtcgctgactgcaggccttccggcggtccatcggcgttcgcatcaaggaggacgacggagatcatcgaaggggaggtggtggagatccagattgatcgagcagcaagagggacgggctccaatggtgggctaatactgacgcctcattgagcacagagatggagaccagtctacgatctgggcaccgatgatgattgagtccctgaccaaggtcctgggtccaggccggggacgtgatcaccatctgacaaggctgacggtgcaagatctccaagctgggccgttccttcacactgcgcccgcagattacgactgctagtgggactcccaggaccaagttcgatgcaagttggccag

SEQ ID NO: 583198 - DNA, 817 bp, Homo sapiens
accgcggcggacatggcagctcagatcaccaatgcgcaagtgggaggcggcccatgcggcgggagcagccagagagcctacctggagggccggtgcgtggagtggctccgtcagatacctggagaacgggaaggagacgctgcagcgcacggacccccccaagagtacatatgacccaccagcccatctctgaccatgaggccaccctgaggtgctgtgccctgggcttctaccctgcggatgatcacactgacctggcatgcgggattggggagagaccacgacccatggacacggagctctgtgtgacgaccagtgcctgcaggggatggaaccttccagaacgtgggcggctgtggtggtgccttctggagaggatgcagagatacagctgtccatgtgcaagcatgatgcggtctgcgccaagtcccctgcaccctgagatgggaggctgtctattcccaggcctcaccatccccattcgtggtgcagttcattgctggcctggttctccttggtaagctgtgaatcactggagtctgtggtcgctgccgtgatgtggaggaggaagagctcaggtggagaacggggtgaaagatagaaaaggagggagttacactcaggctgcgaagacagttgacagtgcccaggcctctgatgtgtctcttacaagcttgtaaagtgtgagacagtgtcttgtgttgggacttgagaggcaagagttggtccctgcccttccctttgtgaccttgagaaccctgaatttgtttctgccaagggcccctgcatgtgtctggttccggtggcctatggccgg

SEQ ID NO: 583199 - DNA, 1046 bp, Homo sapiens
cacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttcaatgagaagattagagaacagattaggaaatggcgcctgtatttcttaatctggttctctaactcttctcattaagaaatacaggcgccatttcctacgatgtttgtcacaacaacaaaaaagcccaacggtaccttcttcatggttaggagtgtgtggtagcaatgcatcaagctcagcttatctccaagattccacatatcttgaaggagatgtacgatgcagaccttctagaagaagaggtcatcatcagcctggatcggaaaaggcctctaagaaatatgtctccaaagaactgccaaagagatcgcgtcaagccagaaccagtatataaaatggagaaggaggcagaggaaagcactccaccggcgccgcacgcaacgaacgacggcacagatgaaaaccatagaacgtggcgaataccaacggcagacagagagccgcaaccgccgccactggcaacgcagacagcacaggcaagacgacaacgaccttgaagcaaagaaaaagagccacccaggcaacctaccgcagcagacgaaactccaccaaaatacccccaactaagcaggcagccagggcacaccgaacgccgcccacaagcgcaaaatgggccacaacacacgcgaacacgcgcgcgtaacaaaccaaaaggagcaacagacaaggaacaaacagcacggacaacacaaagcaggacacaccccaccgcagcagcacacagaggagcaggacaacgcgccgccgcgaaccacgccggcaca

SEQ ID NO: 583200 - DNA, 323 bp, Homo sapiens
gaggatccccatcgggtgaacaatcacttataagttagagtagtttgagtagccagtggaatagtaagtgcgaacgttgttctgaaactatgcccctgtgcaattttctgcaatgaaaaggagcagtaggtcattctcttataatgctcagcctccgacatagaacactggaggcaagaaattaataatttagtaacagtgaagctccagctggtcattacgtcacttcatgtagctatcagagcgcttgatctgcatggtggacctaatgctgctgctcagcactcgtatagacgcacgagaggtagaaccaagttagaggc

SEQ ID NO: 583201 - DNA, 187 bp, Homo sapiens
aggggtaataccatgcagtaggacaatgcatctactagacaatctcttctatatcagaggaactaagtcttctaggacctttactcccttcactctaccatgagggggttaccaacctcctttaaatgtgtatgaatcaagacctaaatcagcaccctccaattcaacatcaataataattataagt

SEQ ID NO: 583202 - DNA, 993 bp, Homo sapiens
  misc_feature (565)..(565): n is a, c, g, or t
taaccatactgcaactactattaggacgaacctgatctcttaattctagatatccattaatcatttttaattgcgctacaactaacctcctcgtgactccatgcctcacgtacatttactaccgaacactacactcaaacatatcttataacacctagacctatggcctatccctcttatgagcagcgcgcacagctgattctaggctttcagcttcctaagcatttaataaatgccctagcccactttcttaccactaaggtcacacctacaccccttatcccctatactagattagtcatcgaaatccatcagcctactcattacaacctaatagccctggaccagtaacgctcataaccgcgtaacgattactgcattgcctatcatactcatgtcactcttaattggaagcgccagacctagacaatgatctaacgcattcaaccttgccctctaccatcttatcatctttcacaacttctatattctcacgtgagctgatccatagtaaatcggctcgtcgaccttaatccaagactctacgttatatcacgacttactnatgtaatgcctctaaccttgcacggacagagcatcagaaacccaccaaagctggttttcaagccaactttcctttgggcctccatggacttttggaaaaagtcttttagaaacccaattcgacgtgtgaggggcaggagggtccccaggagggtgttagtgggccacaactggtgggaacaactacgtctggtagaaccccaaaaggagaaaaatccgacgcgtcagatagacacaatagcggggcaggaggatatcacacacaagcgacgaatagaaaaaagaggggcccccgggagagagaacccagggggcgtttcgcaaacaagcatctgcgaaagttgcgacgtcaagggaggcacacaagcgcggggggataaacaccacaggagtctcaaacacaagaccccgagaatgaaaatagcgcaa

SEQ ID NO: 583203 - DNA, 239 bp, Homo sapiens
tcgtcttttgatagggaaaaaaaatgaaatgagaaataaggaggaaagactactctgacaagagttaagctagaaagagaatgaactagagccaagaacatcctataaaacttctatagagagatgacgcatggcagtaggaatgaatatgaaaggactgataggacctagtgacaaactgcatgttagaagttacgataagtggatggggattcctaaggcatcctatcaaaagacga

SEQ ID NO: 583204 - DNA, 333 bp, Homo sapiens
ggatgttttattatcaaacatgaaaacattaatctccttctgcatctccatcagagcttttgggtgaccaagtgcactgtcaatgggtgtagtattttgaaaggaatgtttttttctgagcagtagttctcaacagagggcttaaaatattcagtaaaccatgctgtgaacaggtgcgctgtcatccaagctttgttgttccatttctagagcacaggcagagtagatttagcataattctcaagggctctaggattgaagcactggcttcaacttagccaccagtggccaggtgcagtggctcaggcctgcaattccagcactttgggaggc

SEQ ID NO: 583205 - DNA, 612 bp, Homo sapiens
atgcgccagcgctagcattctaatatgcatgcgcatcaacagggtagcgtcaaccctctgcacagattatatttcaaagtttgtttgtgaatgactgcggtttataaattaaagtgagatcaaagacctctacatcttgatagttgcaacgcgtcaaaaacacgataacaaggtaagcttgcatagattgtaactcagaattattgtggcgcacatgctaaaaaaattagcaattcaggtgttataattatagaggaaattgagcacagtttgtaatgtctattgttgtgtaagggtgacaaataacctgtagaaccagatgatatcacagtttttggtctttaatacagaatatatgtagtaactgtaagcagttgtgtatgtacagatgtccagcgcatatggagctgtgtatggtagaatgaagtgtgaggtcatctaacagtacctatattgaagttagtactagggtcttgatgtcttagtaccagtaagtgtcatgagctgtgaatctctaacatccctagcctagagatgataccggtctttgtgttcgaactcggttgtcatgccacccgcttgtacaaggcttgtagtgcaaatgaatcttgg

SEQ ID NO: 583206 - DNA, 325 bp, Homo sapiens
tgcgctagagtaggctgtggcccatgccgcaagatgctgcgacggacaaggctcaagagagacccttgatgtgcggctggggtcatggaggagtgagatgtgtgagaaagcgctctgcctggccgtcagatgggaaatatcacacagcagacattcttatcttttccacagggtattaagttgagcaggaagactgacatggcatcaacagaatgaagatcttagaaacgctacttagtacacatttagaagatgaccacagaagatgactgtgggtccagaacataatgcactgcatttgaagaaaaccacaaggcacgccagc

SEQ ID NO: 583207 - DNA, 3083 bp, Homo sapiens
  misc_feature (20)..(20): n is a, c, g, or t
  misc_feature (30)..(30): n is a, c, g, or t
aaagcaggctggtactgccntggggtgcantggccggctccagctggggccggagaggctgagtggttggtacgctgctcgctggcctcccagtcttcccagcaaccggtgacactgcccgcgccagactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgtcaggaggtggaccccagagtgtgagtggcacgcttccctgtgaacccgtcctcaccatgtttgccacatctggggcagtggcagcggggaagccttactcgtgcagcgaatgtggcaagagcttctgctacagctcagtgctgctgcgacatgaacgagctcacggcggtgacggccgcttccgttgcctagaatgcggtgagcgctgtgcacgggctgctgacctccgagcgcacaggcgcacgcatgctggccagaccctctacatctgcagtgagtgcggacaaagcttccgccacagcggccgtcttgacctacacttgggcgcacaccggcagcgatgccgcacttgcccctgccgcacatgcggccggcgcttcccgcacctcccggcgctgctgctacaccggcgccgccagcatctgccagagcggccccgccgctgcccgctgtgcgcccgcaccttccggcagagcgcgctgctcttccaccaggcgcgggcgcaccccttggggacaacctctgaccctgctgccccaccccaccgctgcgcgcagtgcccgcgagccttccgaagcggcgccgggctgcggagtcacgcgcgcatccacgtgtcccggagccccacgcgaccccgtgtctcagacgcccaccagtgtggcgtgtgcggcaagtgctttggcaagagctctacgctgacgcgacacctgcagacgcactcgggggagaaacccttcaagtgcccggagtgcggcaagggcttcctggagagcgccacgctggtgcgccaccagcgcacacacacgggcgagaagccgtacgcatgtggcgactgtggacgctgcttcagcgagagttccacgctgctgcgccatcggcgcagccatcagggcgagcggccacatgcgtgcgccacttgcggcaagggtttcgggcagcgctccgacctggtggtgcaccagcgcatccacacgggcgagaagcccttcgcgtgccccgagtgcggccgccgcttcagcgaccgctcggacctcaccaagcaccggcgcacgcacacgggcgagaagccctaccgctgcgaactgtgcggcaagcggttcacgtgcgtgtccaatctcaacgtgcatcggcgcaaccatgccggccacaagccacacaaatgccccgagtgcagcaaggccttcagcgtcgcctccaagcttgcactgcaccgcaagacgcacctgggcgaacggccagcggagtgcgcagagtgcggcaagtgcttcagccacagccgctcgctgtcacagcatcagcgggcccacacgcgcgcccgcaccgctgccgccgttgccatccagtccgcagtgggcactgccctcgtctttgaggggccggctgaacaggaaaagccagggttctctgtgtcctagttgagggaggcttgctgaggcttctctaaaggtggttgggcaagcacctatatagtatcacggggacagttgaggcaactcgtagatggagatttgggaaaagacgatgtggcctcctacctttccagtttctgttggcagcccttcacgtagcctcctgcctcgcctctacacctactaccctgtcggcccttttgccatgctgtcctcgtataactcggattctctcctcaggtgtaggtgcagggagtcagggaacccttagactcccctgtgtgcaagagcccaggtgttggtgtgtccctttaatgctactgtgctctctggtgtttctgattttcctgcctttattctgtcttctcttgtcctatctcattccagcccacatcttctcctttcctgattacttttgttgtcctgcctcttcaggtaatggtcacagatttggctgtaggcacgttaccagccctgtggcttcttgactcttggttccctgttaactctgtttctgagaaatgtgggtatggaggtgggtgggaaagctcacttccatgaaggatgtctccatgctaggagctgcctgcaccctggcagaggtggccagtcacgtgaaggtgggcagggcccttagcatggccacacatgtccccagggcagatcaaggggcctctcagaaccatgttccccagccaggtgaggaccattttcactgggacccaggccaaaaccatgtgggtgcacaaagccaggcactgccaagtggaacatgaggttatttccaaatcatgggagccaccagcagggagagggcaggatggaaaatcccctggagccggtcaactttttgctcatggctagtgaaataaagttgtttgagtactagatgccaagtgccgcctttatc

SEQ ID NO: 583208 - DNA, 1367 bp, Homo sapiens
  misc_feature (20)..(20): n is a, c, g, or t
  misc_feature (30)..(30): n is a, c, g, or t
  misc_feature (867)..(867): n is a, c, g, or t
aaagcaggctggtactgccntggggtgcantggccggctccagctggggccggagaggctgagtggttggtacgctgctcgctggcctcccagtcttcccagcaaccggtgacactgcccgcgccagactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcagattcatcatattcaaaccttcacaaacaacttggatatcctgacaattattatagaatggatgccccttgattctccccagcctttcctgaaaatgggaaaagtgttcttggataatgccaccaacttttaataatgttttttgtgaattatctatgctcccgtttttacccctttactgggtcctgagttgctttctcaactttggggctgtatactggcatggggtagtgtgtttatcaagtgctgtcaaaagccaaggaacaatatnttggggtttctcaaataccttcccttggccaggccccagccccttcagtaacttcagggtctgagccctttgcctaggctgttgctgctggacctgtttgtgcttcatcacattacccgctttgttcttccagcccaagtctggctgggttcatgtcagtgactcaggaaagctgggtttcggaggaaggcgtggtatagtctaaacgcaggcgacttctcactgccccatcctgccttggtcatttcctaatgcattccccagacaaggatccccatctaaggccagcgaacaggcttggggttcctttccctcagagcagtgttgatgggttccagggctaaatggcgaggctcccttttgagtccattcctgtttgtgctcccaggcgacttgtttggttctctcctgagctttccaagtgggtcatgagaccccttcctttttccgggatgcccatggtttgggctgctggggaaagggaatctcggggatggtac

SEQ ID NO: 583209 - DNA, 151 bp, Homo sapiens
ttgccgcgtcaactgggatagcataaacaaggaccagagagcatcatcgcatccgtgacctccagacaagggagccaccagattggatgggagcccacactcctcttaaaacacactctgcgatgctaagtctacgccgccgaataaccag

SEQ ID NO: 583210 - DNA, 200 bp, Homo sapiens
gaactgggtgttggtgctgggaccctgtagatagtgtgagtgtgagaacggggcgtcggtgcggggaccctctagacacgtgtgagtgtgagaactgggcgtcggtgctgggcccctgtggacactgtgagtgtgagaattgggcgtgggtgcgtgggaccctgtagacactgtgagtgtgagaccttgggcgtcggtgc

SEQ ID NO: 583211 - DNA, 1467 bp, Homo sapiens
  misc_feature (834)..(834): n is a, c, g, or t
  misc_feature (1008)..(1008): n is a, c, g, or t
tcattcctgtgggaagattctccccccctgccatattagggctccctttgttgtgctgttgtgtatgagccgatccgtggtggtgccgccccccaccggaggggccgtgttgttccaccccaacaatgtctccctccatgatttgctcgcctgttcccgcccccaccagtgctcttcttttgggggggggtgtatgtattttataagtcggggggctccccccctcttccccccgtggtgggagactgctctcgtgaagctttgttgtgctgttgtgcctcgtggtccacaccggggaggagggggacgtccttcgcgggtgtgtttttgtccccccccaggcgcccccacgatgagcacgccctgcggcgttttcatctcggagaaaataagtggtgaagtaatcaccaggggcgcgtctcattctgatgtagaggtggacgactaccctccaccaccactgggggcacaaccacaacagtgtctctgtataagtagggccaccgcaccacagcccttgttggtggccctcataagaagatctcgtcggggtgctcaccagctggtaataatatatggcggcggcccacaggtttcgtccctccgtcccctctcctcctctcgtctctcttctggggcgcccctcctcctgggggcgcacgcctcttttgggtgattatagttaatatatcgccaccccccacccgcgcgggccctctgggttataatagagctgcccccctctcgctctctcgtggggaccacactctctcacagaggatttctcaccccaccgctcgtgtttatgcctcgagttctcacgcgagatatttntagtagaggcatctctctctcgtctctcggggctgctcgggggggagagagcggggagaaattgtggcgcacacgcgccccaagccccacagtgtccttcttcccgcgtgtctctgcccctcctttggcgtcacacacttcttagagaggttgtcttggagacacacaggtttntgggggatatattggtgtcgcctcgtgtgagcacataacaccccacaccgtctgccacgccctgcgggagacacactccacactcgtgttctctctctctcttctcacacgcctcaagaccctctcgcctgagagacccccgcgcgtgtgtgtgttgtgagagagttatgagagggtggggtgtggagagagagggtgttgccacacttgtgcgggagaatgtgggcccccgccacgacttgtaccctggaaactcgcttacaccacaggttgttcccctcttctgggggcttaaagaaacctgggaccccgaccccacataaaggcccctggtgcctggttggggtggggccctccaccagaagatcttagattaccgcatttccacttcccaaaaaaagtaggtttgttccactgagtttcccccatttcaaaaaaaaatgaccttcttaaacaaca

SEQ ID NO: 583212 - DNA, 1279 bp, Homo sapiens
  misc_feature (398)..(398): n is a, c, g, or t
  misc_feature (779)..(779): n is a, c, g, or t
catttgtatccaaacacataaggaccctgtatatgggggtatattaaccaaagttctgagctatttatgatgaactttcatctgctaagaagaaagtgacagctgaccattttgtttgtgtcctctcccgcatctgttgagcgacaaggggctatactgtactagcaactagacctaatctccagtaaggctggagactgacctgtggcccctgagagaagtcgtcagtgctgaggccaggtgaggagggcagccacattgtgctcttgactagagggcatgtgaggttctgtgcacatactacaaaggctgaccctgttcccagacagctgcccggagcaacctgtcagaagcaattcagggatatcatgtgagacaaataggataatagagcaganttggtctccgtaaaggagtttttctgctactccagattctcagattcctgtggctgagacagtgaggaaatgctgcagaatgttcataaacaatatgtttttcttgatcagattcatcatattcaaaccttcacaaacaacttggatatcctgacaattattatagaatggatgccccttgattctccccagcctttcctgaaaatgggaaaagtgttcttggataatgccaccaacttttaataatgttttttgtgaattatctatgctcccgtttttacccctttactgggtcctgagttgctttctcaactttggggctgtatactggcatggggtagtgtgtttatcaagtgctgtcaaaagccaaggaacaatatnttggggtttctcaaataccttcccttggccaggccccagccccttcagtaacttcagggtctgagccctttgcctaggctgttgctgctggacctgtttgtgcttcatcacattacccgctttgttcttccagcccaagtctggctgggttcatgtcagtgactcaggaaagctgggtttcggaggaaggcgtggtatagtctaaacgcaggcgacttctcactgccccatcctgccttggtcatttcctaatgcattccccagacaaggatccccatctaaggccagcgaacaggcttggggttcctttccctcagagcagtgttgatgggttccagggctaaatggcgaggctcccttttgagtccattcctgtttgtgctcccaggcgacttgtttggttctctcctgagctttccaagtgggtcatgagaccccttcctttttccgggatgcccatggtttgggctgctggggaaagggaatctcggggatggtac

SEQ ID NO: 583213 - DNA, 784 bp, Homo sapiens
gaaaacacaggctcgcagcgctggagcccggggccgcggagccgggccggggcagcgccgtctccgcctcggggccgcctgggggcgccactgctgagctgctacccacgtgctgtccgcgccatctcgacgggcgaccccagcaggccaatggaccccggccggagcggcatccctgggcgcccagaactaggccacacacaactttgggccgaagtttagcctggcgcctctccccgacccccacgcggcgcgccggggccgcggaccggaaggcggcccccggggatgcgccttacccggggtacccctggcgcgccctgcgctgctgctgctggctgccggctgcatcagcgaccgcatgactgggaaacgtggatgcagccgacacgaagcctggcggggatccagccggtgcgggctggccgggaacggggcagggatgacccggagggagagcacttgcaaggcgggcacaggaggaacgcggcgaacaggcaaatcaaggactttcgaagcctgggcggccgaagccccgggaccgggccgaacccattccggtcttcacttaaacccggcctgaacttaccaacgaaacgggcatgggtggcaaacgggaccttgaccacggggaccccttggacccccccttggcgggccgacggcattggagcagaaaacaggcggggccccaggcagacagagagatagcccagagaggccacataccgtggcagcaagcggtgagagcgccaacgctttggcccagggcgccgaaagcgca

SEQ ID NO: 583214 - DNA, 1441 bp, Homo sapiens
  misc_feature (255)..(255): n is a, c, g, or t
  misc_feature (807)..(807): n is a, c, g, or t
ggcgcggagccgcctcgtttgatgtgtgtgtcttccgggggggcacacactttggtggggcggcagacctcgttgagaagacgggagagaatttttgggggggaaaaaaacgagcgatgattggtggggccccctccctgaccgcgtggttcagcacgggtgtttctggtggttggagcagaagcaccccccctttttgtgcaatgggtgtgtagcgcctgttgcgtgttggcctcgttggggcgctgttgttgnatcacacgcccgtgggtggtagccccccctgggtttgcgggcgccccccccttgtttgttgcccaccaaatgagccggtgggtttcgcccgttccgggttgaaattaaagcacttcccggggggaagtgtcctctcgtccgccctccaagcggggtttttttttagaggctccccacacggggggaatattccaaggggggacaccaccccgcgtttgaggacgtctcccgcccccctgtgtggtgcgccacaaggaaagaccccccacgaggttgtctttggggttggtggctccccccgcgtgtgttaaaatgcgttagccattggtggccttctcttcttcggggggggttttccgtggaatgttgtttccccgggccccgcgtgtaaatgtgcctgggtgcctttccttcccttgtggtggccctcaaatgcgtccactgtggcccacggcccccaaacatatgtgtttgctcccctggtttgcccctgggagtgtaagaccttttttgggctttggtttccctggcgcgctctcttctcacggttanaatggggttcacacacgagattttgggcgctcgttaaaggacacacgcttatccccacgcccccctcggttggggctcttttctagaactctctttgggttttcccgtcgtgtaacactctctcgttgttctcggaggaaaaatgttgtggatatatgggaaggttgtggtgggagaaagcctcacctctccacatgaaaaggaatggtcctccaatggcataaggagagctgcccgtgcacaccctggcacagaaggtggggcccacagtcaccggtgaaaggtgtggcacagggccccttatggcacatggcgcaacacacacatgtccccacagggcaagaatcaaaggggcctttctaagaaaccacatgttccccacgccacaggtgagggagccacttttcaactgggagcccacggcccaaaccacatgtgggtgcaccacaagccacggcacctgccacaagtggaaacacatgaggttaatttccacaaatcactgggaagccacccacgccacgggaagaagggagagggcaggatggaaaatcccctggagccggtcaactttttgctcatggctagtgaaataaagttgtttgagtactagatgccaagtgccgcctttatc

SEQ ID NO: 583215 - DNA, 245 bp, Homo sapiens
gaatgagcaccgtggccatgccgcccccatgcctgataaaatggcgaatacggtcttttcttttttcggagcacgtttgaaccgcggcattcgaatgccccaatacatgttacgagcattacgattccgaaaataaaccctagcttcattactttttcacctcttgctccggaaacccttgtggagcggcgttcatgcccggccggcgggcgtacgcttttgttttcaccacgatttcaacgggt

SEQ ID NO: 583216 - DNA, 383 bp, Homo sapiens
gctcgaccaactcctcaaaaagaaaaccagcctaagggctggtgcggtggctcacgcctgtaatcccagcactttggaaggccgaggcaggtggatcacttgaggtcagtagttgggagacgagcctggccaacatggtgaaccccatttctgctgaaaatgcaaaaattagccaggcatggtggcacatgcccgtaatcccagctacttgggaggttgaggcaggagaattgcttgaatctgggaggcggagattgcagtgagctgagaccatgccatcacactccagcctgggtggcagagcgagactgtctcaagaaaaagagagagagagagagagagagagactgtctcaagaaaaagagagagagagaaaaaaaaaa

SEQ ID NO: 583217 - DNA, 130 bp, Homo sapiens
tcagacagcggacccttcttcatgatgcctttgaaacgggtagctcaggccatggactggaagcctccagacttcttcttcttcttgttcttgggcacgcaccaatctcccgggggtccggctgtcatga

SEQ ID NO: 583218 - DNA, 552 bp, Homo sapiens
  misc_feature (20)..(20): n is a, c, g, or t
  misc_feature (30)..(30): n is a, c, g, or t
aaagcaggctggtactgccntggggtgcantggccggctccagctggggccggagaggctgagtggttggtacgctgctcgctggcctcccagtcttcccagcaaccggtgacactgcccgcgccagactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtgaggggactgaagggcaggggagggcaagggtggctcggggcagcagtcctcagctgtggctagtcttctcccatctgcctcgggcgactggtgtctgcggcggtcgggagcgccgcccgggctgcgagtgacgcggggatactgcggggcgagcgattggccggacacgtccgcgcggcctgctcctcccaggccttcccctc

SEQ ID NO: 583219 - DNA, 480 bp, Homo sapiens
aggcacgttaccagccctgtggcttcttgactcttggttccctgttaactctgtttctgagaaatgtgggtatggaggtgggtgggaaagctcacttccatgaaggatgtctccatgctaggagctgcctgcaccctggcagaggtggcctcctacctttccagtttctgttggcagcccttcacgtagcctcctgcctcgcctctacacctactaccctgtcggcccttttgccatgctgtcctcgtataactcggattctctcctcaggtgtaggtgcagggagtcagggaacccttagactcccctgtgtgcacaaagccaggcactgccaagtggaacatgaggttatttccaaatcatgggagccaccagcagggagagggcaggatggaaaatcccctggagccggtcaactttttgctcatggctagtgaaataaagttgtttgagtactagatgccaagtgccgcctttatc

SEQ ID NO: 583220 - DNA, 230 bp, Homo sapiens
aggtatctagagatcccttgacgggtgctgattaggctcaacaggcattcgaggtgcctttgaaagccccaggccactgtggccaggtacacattggccaaggtcatcatgtccatccgcaccaagctgcagaacaagggagcatgtgattgagtgccctgcgcagggccaatgtccaggtttcctgtgccgccagaaagatccactatctcaatagacagtggtggctt

SEQ ID NO: 583221 - DNA, 915 bp, Homo sapiens
  misc_feature (415)..(415): n is a, c, g, or t
agcgggccagacactgagccgccgtcaaggattcagcagtctgccccctgaatttttctgctactccagattctcagattcctgtggctgagacagtgaggaaatgctgcagaatgttcataaacaatatgtttttcttgatcagattcatcatattcaaaccttcacaaacaacttggatatcctgacaattattatagaatggatgccccttgattctccccagcctttcctgaaaatgggaaaagtgttcttggataatgccaccaacttttaataatgttttttgtgaattatctatgctcccgtttttacccctttactgggtcctgagttgctttctcaactttggggctgtatactggcatggggtagtgtgtttatcaagtgctgtcaaaagccaaggaacaatatnttggggtttctcaaataccttcccttggccaggccccagccccttcagtaacttcagggtctgagccctttgcctaggctgttgctgctggacctgtttgtgcttcatcacattacccgctttgttcttccagcccaagtctggctgggttcatgtcagtgactcaggaaagctgggtttcggaggaaggcgtggtatagtctaaacgcaggcgacttctcactgccccatcctgccttggtcatttcctaatgcattccccagacaaggatccccatctaaggccagcgaacaggcttggggttcctttccctcagagcagtgttgatgggttccagggctaaatggcgaggctcccttttgagtccattcctgtttgtgctcccaggcgacttgtttggttctctcctgagctttccaagtgggtcatgagaccccttcctttttccgggatgcccatggtttgggctgctggggaaagggaatctcggggatggtac

SEQ ID NO: 583222 - DNA, 141 bp, Homo sapiens
  misc_feature (21)..(21): n is a, c, g, or t
gcctactactactaaacggcngatagaagacgacagaagggagagggcaggatggaaaatcccctggagccggtcaactttttgctcatggctagtgaaataaagttgtttgagtactagatgccaagtgccgcctttatc

SEQ ID NO: 583223 - DNA, 767 bp, Homo sapiens
ggggcccagcccattacacggacctgctgtcgcatggatgctcatggccggaccttcttcatcgccttcttcctgcgcaaattcatagaacagacggttctttccatggccggatccggcgggtgattggggactttggggtgcccatcgcacatcctcatcatggtgctatgtggattacagtattgaggacacctatacccagaagctgagcgttcccagtggattcgtcggtgactgccccagaaaagaggggctgggtcatcaacccccctgggagagaagagccccttccctgtgtggatgatggtttgccagcctgctgccccgcacatcctggtcttcattctcatcttcatggagacacagatcacacacgctcatcatctaccaagaaggagcgcatgctgcagaagggctccggattccacctggacctgatgactcatcgtggccatgggcggacatctgtgccctctttggcctgccctggttggatgatgccacatgtccgctctgtcactcacgcacaacgcgctcacttgtcatgagcaggctgtggcacctggggacaaagccccaagattcaggaagtcaaggagcaggggtgaaggtgctgtgggttgcctgctagtgggactctccatgtttcggcgatctgatcgggaaataccctggcggagccctagggaataactgtcatggaagcacatcctaaaggaccaacaagagagagaatagtgaatgcgccaaaacacaatgcagga

SEQ ID NO: 583224 - DNA, 3057 bp, Homo sapiens
  misc_feature (20)..(20): n is a, c, g, or t
  misc_feature (30)..(30): n is a, c, g, or t
aaagcaggctggtactgccntggggtgcantggccggctccagctggggccggagaggctgagtggttggtacgctgctcgctggcctcccagtcttcccagcaaccggtgacactgcccgcgccagactgaccactagccgacgcgggcgagagggacaggagcgtgacctccccatcccgaggggccggacgctcgggcgcctccccgctccggcgcgcgaggtcgagcggcgccgttccttctcgtcccgcggcagtccggcgagggatcggcggctatgggaaccgcgcgttgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgtcaggaggtggaccccagagtgtgagtggcacgcttccctgtgaacccgtcctcaccatgtttgccacatctggggcagtggcagcggggaagccttactcgtgcagcgaatgtggcaagagcttctgctacagctcagtgctgctgcgacatgaacgagctcacggcggtgacggccgcttccgttgcctagaatgcggtgagcgctgtgcacgggctgctgacctccgagcgcacaggcgcacgcatgctggccagaccctctacatctgcagtgagtgcggacaaagcttccgccacagcggccgtcttgacctacacttgggcgcacaccggcagcgatgccgcacttgcccctgccgcacatgcggccggcgcttcccgcacctcccggcgctgctgctacaccggcgccgccagcatctgccagagcggccccgccgctgcccgctgtgcgcccgcaccttccggcagagcgcgctgctcttccaccaggcgcgggcgcaccccttggggacaacctctgaccctgctgccccaccccaccgctgcgcgcagtgcccgcgagccttccgaagcggcgccgggctgcggagtcacgcgcgcatccacgtgtcccggagccccacgcgaccccgtgtctcagacgcccaccagtgtggcgtgtgcggcaagtgctttggcaagagctctacgctgacgcgacacctgcagacgcactcgggggagaaacccttcaagtgcccggagtgcggcaagggcttcctggagagcgccacgctggtgcgccaccagcgcacacacacgggcgagaagccgtacgcatgtggcgactgtggacgctgcttcagcgagagttccacgctgctgcgccatcggcgcagccatcagggcgagcggccacatgcgtgcgccacttgcggcaagggtttcgggcagcgctccgacctggtggtgcaccagcgcatccacacgggcgagaagcccttcgcgtgccccgagtgcggccgccgcttcagcgaccgctcggacctcaccaagcaccggcgcacgcacacgggcgagaagccctaccgctgcgaactgtgcggcaagcggttcacgtgcgtgtccaatctcaacgtgcatcggcgcaaccatgccggccacaagccacacaaatgccccgagtgcagcaaggccttcagcgtcgcctccaagcttgcactgcaccgcaagacgcacctgggcgaacggccagcggagtgcgcagagtgcggcaagtgcttcagccacagccgctcgctgtcacagcatcagcgggcccacacgcgcgcccgcaccgctgccgccgttgccatccagtccgcagtgggcactgccctcgtctttgaggggccggctgaacaggaaaagccagggttctctgtgtcctagttgagggaggcttgctgaggcttctctaaaggtggttgggcaagcacctatatagtatcacggggacagttgaggcaactcgtagatggagatttgggaaaagacgatgtggcctcctacctttccagtttctgttggcagcccttcacgtagcctcctgcctcgcctctacacctactaccctgtcggcccttttgccatgctgtcctcgtataactcggattctctcctcaggtgtaggtgcagggagtcagggaacccttagactcccctgtgtgcaagagcccaggtgttggtgtgtccctttaatgctactgtgctctctggtgtttctgattttcctgcctttattctgtcttctcttgtcctatctcattccagcccacatcttctcctttcctgattacttttgttgtcctgcctcttcaggtaatggtcacagatttggctgtaggcacgttaccagccctgtggcttcttgactcttggttccctgttaactctgtttctgagaaatgtgggtatggaggtgggtgggaaagctcacttccatgaaggatgtctccatgctaggagctgcctgcaccctggcagaggtggccagtcacgtgaaggtgggcagggcccttagcatggccacacatgtccccagggcagatcaaggggcctctcagaaccatgttccccagccaggtgaggaccattttcactgggacccaggccaaaaccatgtgggtgcacaaagccaggcactgccaagtggaacatgaggttatttccaaatcatgggagccaccagcagggagagggcaggatggaaaatcccctggagccggtcaactttttgctcatggctagtgaaataaagttgtttgagtactagatgccaagtgccgcctttatc

SEQ ID NO: 583225 - DNA, 3035 bp, Homo sapiens
gcgttcccttctttcatctggagcccacagttcgcgcaagtggagctatggaaggcccatgctgtgctgttctaatcatgtgagggattcttaggggtgagggggaaggactgaaaacggctgcagaccgtttaggatgcctggagtggagacaggagttaagccccttactcagagtcgctcttaagaactgcccagggccgggcacagtggctcatgcctgttatcctagcacttgggaggccaaagtgggaggctctcttgagctcgggagttcaagaccagcctgggcaacatggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgtcaggaggtggaccccagagtgtgagtggcacgcttccctgtgaacccgtcctcaccatgtttgccacatctggggcagtggcagcggggaagccttactcgtgcagcgaatgtggcaagagcttctgctacagctcagtgctgctgcgacatgaacgagctcacggcggtgacggccgcttccgttgcctagaatgcggtgagcgctgtgcacgggctgctgacctccgagcgcacaggcgcacgcatgctggccagaccctctacatctgcagtgagtgcggacaaagcttccgccacagcggccgtcttgacctacacttgggcgcacaccggcagcgatgccgcacttgcccctgccgcacatgcggccggcgcttcccgcacctcccggcgctgctgctacaccggcgccgccagcatctgccagagcggccccgccgctgcccgctgtgcgcccgcaccttccggcagagcgcgctgctcttccaccaggcgcgggcgcaccccttggggacaacctctgaccctgctgccccaccccaccgctgcgcgcagtgcccgcgagccttccgaagcggcgccgggctgcggagtcacgcgcgcatccacgtgtcccggagccccacgcgaccccgtgtctcagacgcccaccagtgtggcgtgtgcggcaagtgctttggcaagagctctacgctgacgcgacacctgcagacgcactcgggggagaaacccttcaagtgcccggagtgcggcaagggcttcctggagagcgccacgctggtgcgccaccagcgcacacacacgggcgagaagccgtacgcatgtggcgactgtggacgctgcttcagcgagagttccacgctgctgcgccatcggcgcagccatcagggcgagcggccacatgcgtgcgccacttgcggcaagggtttcgggcagcgctccgacctggtggtgcaccagcgcatccacacgggcgagaagcccttcgcgtgccccgagtgcggccgccgcttcagcgaccgctcggacctcaccaagcaccggcgcacgcacacgggcgagaagccctaccgctgcgaactgtgcggcaagcggttcacgtgcgtgtccaatctcaacgtgcatcggcgcaaccatgccggccacaagccacacaaatgccccgagtgcagcaaggccttcagcgtcgcctccaagcttgcactgcaccgcaagacgcacctgggcgaacggccagcggagtgcgcagagtgcggcaagtgcttcagccacagccgctcgctgtcacagcatcagcgggcccacacgcgcgcccgcaccgctgccgccgttgccatccagtccgcagtgggcactgccctcgtctttgaggggccggctgaacaggaaaagccagggttctctgtgtcctagttgagggaggcttgctgaggcttctctaaaggtggttgggcaagcacctatatagtatcacggggacagttgaggcaactcgtagatggagatttgggaaaagacgatgtggcctcctacctttccagtttctgttggcagcccttcacgtagcctcctgcctcgcctctacacctactaccctgtcggcccttttgccatgctgtcctcgtataactcggattctctcctcaggtgtaggtgcagggagtcagggaacccttagactcccctgtgtgcaagagcccaggtgttggtgtgtccctttaatgctactgtgctctctggtgtttctgattttcctgcctttattctgtcttctcttgtcctatctcattccagcccacatcttctcctttcctgattacttttgttgtcctgcctcttcaggtaatggtcacagatttggctgtaggcacgttaccagccctgtggcttcttgactcttggttccctgttaactctgtttctgagaaatgtgggtatggaggtgggtgggaaagctcacttccatgaaggatgtctccatgctaggagctgcctgcaccctggcagaggtggccagtcacgtgaaggtgggcagggcccttagcatggccacacatgtccccagggcagatcaaggggcctctcagaaccatgttccccagccaggtgaggaccattttcactgggacccaggccaaaaccatgtgggtgcacaaagccaggcactgccaagtggaacatgaggttatttccaaatcatgggagccaccagcagggagagggcaggatggaaaatcccctggagccggtcaactttttgctcatggctagtgaaataaagttgtttgagtactagatgccaagtgccgcctttatc

SEQ ID NO: 583226 - DNA, 392 bp, Homo sapiens
ttagtggttccagatctgcttcattttcatccatgtgtagtcatcttctcctctcagttactgctggtttctcccttccccggcagcagaaactgagaggagaagatgactacaacatggatataaccaccctaacccttctaaaggtcagatttgctacgtgatcaacaggggtacttgaatcgaatcgacacaggcacagcagtgtgtacagggcttatgagtgtaggcaggtggttcactttggtcatcatctccatttgcccacctgattcacacatgagaatggcatctttcactcaccagcaacagccagtattataggaggtgtaggaggcattcttggcacttgtagcacaagcacatggttgtgtcagcaacttccattgact

SEQ ID NO: 583227 - DNA, 869 bp, Homo sapiens
caaaaacaaaaccggggggcccccagccctcgcagaggggctcgtagaattgtgacgccccccctgggggaacccgggctcccaccaaggattaccagacaggggcaaacacacaggagtggaccaacccttggaggggtaatagcaaatgacaagaccagtctttatgggccgcccgcccttgcatgttactccacggcaacaaaaaaagtgatgcgtagcgatattatttgcgaacagagccacccaaacccctgttggccgaaaggaaaatttcccgcctcttatggaactagaccaccccctggatcctacgagaaagtcacggacgttcatactaagagacaacccggtgagagtcttagggagagggacccccaccgcgggggacatacatgaaagacgaggtacgccaatgacgcggcgtaagagacacgaggtgtcaagaagccctcatgtggatacacaaagaaagtggtgattctacccgcgaaatcgctgtgcaaagctccaccaaaggcccatggctgcggcaaagtgagagctaccgcaagacgtggcccaggcccgcgcctctgtcataacgagcggagaaggaaccctcaaacgcctgttctaaaacgaacgatatctcacaccaagtaatgacacaatctgttatgagggataccgccggaaggcggaggatagatggaagacccgccaggttgaccccaacataacgaggcgagcaaaaaacacgggtgggatcaacagaagggcccaaaacccaaagtatgaacaagtcgcggaaaccgaatggaggaagagttcccaatgggcccaaatgcgagcgggcaaacatggaaatttccccggcgggcatgaca

SEQ ID NO: 583228 - DNA, 252 bp, Homo sapiens
cttcgactggcggtcacttacagggacttgatttttgttttgttttgttttgagacagagtcccactctgtcacccaggctggagtgcagtggcacgatcttggctcactgcaacctccgcctcccaggttcaggtgatcctcctgcctcaagctcctgagtagctgggactacaggtgcacaccaccaagcctggctaatttttgtatttttagtagagattgggtttcactaagttgcccgccaatcgaa

SEQ ID NO: 583229 - DNA, 191 bp, Homo sapiens
ttttttttaggcccctgcctgtttgcccatttgcccctcacccacccaaggttttgccccccgcctggacctgcccacccctaaaaaattggcccctggctccccgcccctcggtttccacgtggtgtatggatttgtggtcattgtccctttgcaaaataaaaattgctcaggcctgcctggcaaaaaaa

SEQ ID NO: 583230 - DNA, 147 bp, Homo sapiens
tcaagcttctaacgatgtacggggacatgaggaaagagatgctcctcccacctaaggtccaggaatctgagaacaggactgtgctgagtctcccagaggcaagggggttcccctaatgctctatcaataaagaatattgagcctgga

SEQ ID NO: 583231 - DNA, 150 bp, Homo sapiens
ttttctcgtgctgtggttgctcactggggattgtcattttctatttggccagcttttctataccacagttggggtaccctgtatgttatttatttaacaaggttactgggttcccgaaatcaaccaggcctcaaactcttcctctctccg

SEQ ID NO: 583232 - DNA, 381 bp, Homo sapiens
gctgggactaaggagttgcacccacccgacaaatgttgtattttaatagagatggggttcaccatgtggtcaggctggtctcgaactcctgatctcgtgatccatctgcctcggcctcccaaagtgctgggattatagtcgtgagccaatgtgcccggccctagcctgcgttatatgtcggtgtgtttgcaatccatagcatcttcagcgtcctgcaactgatcagttgatgtaaatggacacaggcaaaaataaagccatcaacgcaactctgcactcattgccaggccagttcccatatacattatgttgtggtacatatttaggtatttaacagaatacagaatactacttgatgttcatttgcgaatgtgcagtcat

SEQ ID NO: 583233 - DNA, 202 bp, Homo sapiens
gtcccctgaaaaggaagtcctttttccccccccccccccttttttccaaaggagggcatcaaggaacttaacccgcccgcctggggggtttttatttaaaacatttttgggattatatttaacccgcaattgggctttgggttaatgtttagcccccgggacttgtaaaagattaaaattcaataaaccccttttttaagta

SEQ ID NO: 583234 - DNA, 450 bp, Homo sapiens
  misc_feature (42)..(42): n is a, c, g, or t
  misc_feature (307)..(307): n is a, c, g, or t
  misc_feature (332)..(332): n is a, c, g, or t
  misc_feature (340)..(340): n is a, c, g, or t
  misc_feature (354)..(354): n is a, c, g, or t
  misc_feature (369)..(369): n is a, c, g, or t
  misc_feature (388)..(388): n is a, c, g, or t
  misc_feature (437)..(437): n is a, c, g, or t
  misc_feature (445)..(445): n is a, c, g, or t
gtctctattgaaaatataaaaattggtcgggcctggtggggngtgctgtagtcccagctgctcgggaggctggggcaggggaattgcttgggcctaggaggggaggttgcagtgagccgagatcacgccattgcattccagcctgggcaacaagagtgaaactccatctctaaataaataagtaaataaatagatgaatttttctcctaaggcaaattgaaaaagcttcttgtgtactccaaaattggaacagagctacctttttgacttaaaaatgttcattttttaattgaggcagtatttttcntggaacacaaaattttgtaccaagngtgttctnccattggcatttanttttaatttttgttnattaatttttttcccccantggaagggggaaaaagtatttttgtaggctccccccttcccctaagggnaaatttcntttaa

SEQ ID NO: 583235 - DNA, 1084 bp, Homo sapiens
gccctgttacgacagctgtcccgcgtggcccagcctgagcgccatctcacgcctgtctggaggagctgcagaggctgtgagacagagattgtggccaacccgcatgagctgctgtgaatgtgacacctgtggacctgtggtgaatagtgcttgcgcagctgcactctgatggtgcctgtgcccagacagggcctgtgtggacaccactagactcaccatccctatgatatgtccaacacagaaaacaccaagcacataacagatcagacaatctgcataggagatgtgtatccattgcaacgagaaggagtgccctgttgtggctccaaaccatagaagcctcaaagccattgtgaacacagactgacactagacgtatagtgtgcgtctaaacgcacacgagtcactgtggggtcacacatggatcaaagatgcgttgtcgcctagacgcagtcgataacagaacacgacgacacacattgattaatcaaagggccccaaggatatccccagagaaacaacgcgcacagcaggaaaagattagaggaacaaacaacgagggtatctcctaatcacgaagaggggaccaacccctacacttaggttgacccacacagcaacatagatggtgatggacgctccctacttctactatgaacacagacacctattggtcgcaacagagcacacccagcaattggggaatatcacacgtcaggccgttgtcgaaatccacaatgtaacacccaaaagtgaatcgccaactgagacatttgcagcgttacccactaacaaggagaaccataacaccgggttggttgctgaatcatccccacatgaaagaaattgcacaacatcggagagtagcatatccaaccatcagtcaaaccatttatgagcacgtcgtcaagatgctagcgacacgtagcacattggaatctatgccaaccgccatggagtcacaacaggccacacccaaccgattacctgcggagacatacgtcaccccccatatcaacaaaaccatgcggtgatgaacaacgacgaagacgaggcgccacatcaaaatagtcagaacgattgc

SEQ ID NO: 583236 - DNA, 386 bp, Homo sapiens
caagagcaaatgttagccaattccttgtgaagagggcctggggctgacgccctgctctcacctggcttccagacatttcttgtgctgtcatccagtccctactcgccatgctctgagagtgtcttgctctctgacgtcctcctggtctcatgggctcgcccacccagtagcagggcataatcactagaggaactcctctctccctcttcggaaagcatatattattccccataaaagttcctaaaggccaggcaaggactgattctccaattccacatcagagagagctgattctgcagggaaacggctggggaggctccagctctttcctccccacaaccatttactgggaagtagtgtatacttggcagtgtgggatgaaggta

SEQ ID NO: 583237 - DNA, 564 bp, Homo sapiens
  misc_feature (15)..(15): n is a, c, g, or t
  misc_feature (262)..(262): n is a, c, g, or t
cccaaccccaaaggnccaatatggatgttcccctaatatgaggtaactggagtagccaattcatagagccagaaatagaagttaccaagggttacggggaagaggcaatgatcagttactgtttaatggatacagagtttcagtttgggatgatagaatagttcagatctggaaatggaccgttgcacattgtctattaatgccacttaattgtacacgtaaaaatggctaaaatggaaattttcatgtgtatattttaccncaatataaaaaaaattaggccggacacagtggctcacgcctgtaatcgcagcactttgggaggccgaggcaggcggatcacaaggtcaggagatcgagaccatcctggctaacacagtgaaaccccatctctactaaacaaaatacaaaaaattagccaggcgtggtggtgggcgcctgtagtcccagctacccgggaggctgaggcaggagaatggcatgaacctgggaggcggagcttgcagtgaggccgagatcgcaccactgcactccagcctgggcgacagagcgagactccgtctc

SEQ ID NO: 583238 - DNA, 173 bp, Homo sapiens
ttagaactctgcgctgagttcgattccagtcgggctctgttccttctggctcctcatctgaggcaggacgtatctccaggccgagtgagaggagctattcagtcaacagtcaagaggtgaggagacaccaaatttgtgattgttactgcctagtagtgccaggttaggggtag

SEQ ID NO: 583239 - DNA, 462 bp, Homo sapiens
ctaaccagtattccactgtatggatagactacattttgtgtcttccatgttttagctattgtgagcaatgctgctatgtttatttatttattattctattttttttgagacaaagtctccgccctgtcacccaggctggagtgcagtggcacaatctcggctcactgcaacgtccgcttcccgggttcacaccattctcctgcctcagcctcctgagtagctgggactacaggcgcctgccaccacgcccggctaattttttgtatttttagtagagacgggtttcaccgtgttagccaggatcgtctcgatctcctgaccttgtgatccgcccgccttggcctcccaaagtgctgggattacaggcgtgagccaccacacccggtctactatttttttaagacagtctcgctctgttgcccaggctgaagtgcaggggtgcaatcttggctcactgcaacc

SEQ ID NO: 583240 - DNA, 441 bp, Homo sapiens
ggaaattcggccttattggccggggaccttaccggtatttaaggccggttttggtttccaaatggcggggcttaaaatggccttggcttaaatccaatttttaggaggtggaatggttagtggggttttcctggatttttaccagggaattattcaggaattttttctttaggttaatctgcaaggccagcttgggtcctgtaaagggtttttaacagcatttccggttaaccggaaaccggtattcagggaaacctaagtcccagaccagggattttttggaaaattatggccggccttaattcaggtcagccttctgggtagaagcagttttaatcccccaattgcccaatggtaattttggaccacctaatttttcttccggaaggatcctgttaaaaggcttgcactttcaatggattggccactggttcctggttc

SEQ ID NO: 583241 - DNA, 210 bp, Homo sapiens
  misc_feature (47)..(48): n is a, c, g, or t
  misc_feature (107)..(107): n is a, c, g, or t
tgtggatggagatcagttgcattggttcattaattcgtataagcatnnaacaggtatataaaaagcttccatgattctatttatatgtacatgagaaggaacttccnggtgttactgtaattcctctacgtattgtttcgacagccctcatttgatgcacgatatacgctagatgaagttgtactttgttgagctattgctgttctctgg

SEQ ID NO: 583242 - DNA, 546 bp, Homo sapiens
  misc_feature (459)..(459): n is a, c, g, or t
  misc_feature (482)..(482): n is a, c, g, or t
  misc_feature (504)..(504): n is a, c, g, or t
  misc_feature (509)..(509): n is a, c, g, or t
  misc_feature (535)..(536): n is a, c, g, or t
tatccgagattgtgcctggacaacaagagcggaactctgtctcaaaaaataataataaaataggctggcgcggaggctcatgcctgtaatcccagcactttgggaggccgaggcagacggatcacctgaggtcgggagttcgagaccggcctgaccatggagaaacctcatctctactaggaatacaaaattggccgggtgtggtggtgcatgcctgtattcccagctattcaagaggctgaggcaggagaatcacttgaatccgggaggtggaggttgtcatgagccgagatcacaccattgcattccagcctgggcaacaaaaagcgaaactccgtctcaaaaataaataaataaacaaatgtatgacaaaatttgccattttaaccatttttaagtgtacaactcagtggcattaattatattcacaatattgtacaaccgtcaccactatctatntcaaaacttttccatcaccccanacagatgctctgtaaccataangcaantactggcatccccccttccctttagnnccctgatact

SEQ ID NO: 583243 - DNA, 153 bp, Homo sapiens
ctgctcccgttaaggtgcagtgcatacacaatggcacacctaccccttatccccatactatgttattatctgaaaccatcagcctactcattcaaccaatagccctggcctgtactgcctaacctgctaacattactgcaggccacctactca

SEQ ID NO: 583244 - DNA, 443 bp, Homo sapiens
tctcttttcttttctccccttccccccctttcacgcaattgcccctcggaggcgctttccccgggcaaggggcagagccgggtctcaacccccacgcctctccccggccaggccgccctatggcgaaagggagcccccatcccaaacgccgggactcaagcggcgagaggcctcaaggccgggggggtcaatcacgggaaactgaattcgggtgaccgaccaaagcggcacggaaaccagtagcattcccgcgtacgaagcgccagggcccgagagaccacgagggccaccgcagaaaaagagaattaacacactttaactccaactctctcaaggtggcgcccgaattacggtccacgagacaacaaagcgcctaccgtagcgcctactggagcaatgagggtggtaacacgggaccccgcggatgaccccgcggtagaacg

SEQ ID NO: 583245 - DNA, 948 bp, Homo sapiens
ggtgtttgtaacgactcttgagtttctctagagactatgaaagatttgttgccctccaacgatcgtttttttagttgcccatcccctgttgtgcggatatttgttgcgtgtcccccccataagcagcgcctgcatgttttcctcccccacttgtggggtgtttatcattccaggttcgccccgcattgaaatgtcttcggcaagcagtgggtctcgcggatgcgtctcccagaattactgcgcaataataaaggcctttgtgcaccttcatgaattatttctgcgcgcttgctcttcgctggaccgagactgttgtctccacacagtagtgtatttaagttcgaagggggccctcttttggtaccaaataagggttcccccctttccttcatttgcgggttattctttttctttcacaaatggagtcagttggccccccctttttatgctccccagttagatgtgcgcattaggaaaacaagcatgtatccgcccattagtgcgtttccaccctgtttcgtgtttgttctccaagctataatctttgattgcatttgtctttgtttctgctcgaagcaccgtttttgtgatgttccatctgttgaagaagtttgttctgaatgtagtttttatgtgggaccaatacttgaggcattcttttcggggagctatttgcatagaaatcatcccgtattgttataatagagcaccttatttttcctaatacaagacggttctttagggatatttctctaaacgccgcattgtgtttagtggaggggtcccgttcttgttcgaagaacaacaagatgtacagcctccgaggagtttttttcccggctgctcatctttgttcatattggcagacttttctggagggaagctcggaaagtactgctcccggggggaacccgaaccaaaacacccacagggctcccaacatgacaa

SEQ ID NO: 583246 - DNA, 3043 bp, Homo sapiens
  misc_feature (232)..(233): n is a, c, g, or t
  misc_feature (301)..(301): n is a, c, g, or t
  misc_feature (318)..(318): n is a, c, g, or t
  misc_feature (2429)..(2430): n is a, c, g, or t
  misc_feature (2447)..(2447): n is a, c, g, or t
aaaattctgccccgattagaggatccctgtggagatgggtctcattactgtcacccagtggagtacagtggcacaacctctgctcactgcagcctccacctgccaggctcaagcaatgctcctgcctcagcctcccgagtagctgggattacaggaagtgagctcacaatgactcaagctgccacatagtgttgattgtgaaatgccagttgaagctatgtcctgcgagttnngggtgctacagttgaccactgcagcagtaaagatgactctgaagaatggcgtgggatggatcctttcnaatgcacttgagcagcngtctccaaccacagggccacagagctggagctggatctaccatgaaagacttctgaatccaggaagagagactgactgggcaacatgttatctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatctaggttgcgctgtccttatgagagtctaatacctattgatctgtcactttctcccatcacgctcaggtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583247 - DNA, 2288 bp, Homo sapiens
  misc_feature (30)..(30): n is a, c, g, or t
  misc_feature (38)..(39): n is a, c, g, or t
  misc_feature (1674)..(1675): n is a, c, g, or t
  misc_feature (1692)..(1692): n is a, c, g, or t
ttgatgtaacccggtcatctggcaaccgcnagaggcanncagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatctaggttgcgctgtccttatgagagtctaatacctattgatctgtcactttctcccatcacgctcaggtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583248 - DNA, 112 bp, Homo sapiens
atagcggctgaagtatcattaggagatggctgatacctcgtaaaaggatgatttatagtaagagacaaagaatgtgtgtgtgtgtgtatacgtatatatacgtatgaccagg

SEQ ID NO: 583249 - DNA, 247 bp, Homo sapiens
tggccaggctggtctcaaactcctgggtcagggatccccctggcctcggctcccaaagtgctaggattaacaggcatgagccaccatgcctggccaatatttcagtttttaaatgtgccatcttatatgcacaatgttaatgttttatgtgctttctctgtgccttttgtgtatatgtgatcactatgtgttcgatgtttgcccatccatttttattttcctgagcgtctgagtctaaatgcaatca

SEQ ID NO: 583250 - DNA, 2737 bp, Homo sapiens
  misc_feature (2123)..(2124): n is a, c, g, or t
  misc_feature (2141)..(2141): n is a, c, g, or t
gctggactgtagtggcatgatcatgcctcactgcagccttgacctcccaggctcaaacttccgcattccgaatagctgggactacaagtgtgcaccaccacccccagctaacttttttcttcttttggatggagacagggtctcactgtgttgtccagaccggtctctagctcctggccttaagcaatcctcctgcattagcttctcaaattgctggaatttcaggcatgagccaccatgcctggcctgggctagtcctatattctctagagttctctttactttgtgctagccaatctctcattatgctgttcacctgttataatgaataattctctgtattaaattttaccactttaaacttttgagtggtttatgcttcctgattggactctgactaatatgttaggaagggtcccaggagataaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583251 - DNA, 246 bp, Homo sapiens
agcctgaaaggtactggaagtcctagttgaaggtcctacccagtgaggaaaacataattggtgaccacttaagaaatgcagtctagccatattttttgcaggacagctctgctattcagagtgtaccacttccgcccccagtttattttggattctaccaaatgccatgaatggcttggaacatgctacacgtcacaccaacacatgcatgaaattgtggctttatgggtgtacctgatgcctcga

SEQ ID NO: 583252 - DNA, 326 bp, Homo sapiens
tgcgtgcccaccaacataaccatttagtgaaagcaaacataaaaggataaacctcttgtggcatgatgcaagggcggagctaggacttggcctgtgcctttggaagctgaggcaggaggaccatctgagcccaggagcctgagaccagcctgggcaacatagagaatccgtctcaacaaaaaaaaattttagccaggtgtgctgtgagctgtagtcccagctacaaggcgggaggattgcttaggcctgggtgattgaggatgcaatgagctgtgattgtgccaccacactccagcctgggcaatacagcaagactgtctcaaaaa

SEQ ID NO: 583253 - DNA, 906 bp, Homo sapiens
  misc_feature (11)..(11): n is a, c, g, or t
  misc_feature (149)..(149): n is a, c, g, or t
  misc_feature (198)..(198): n is a, c, g, or t
  misc_feature (200)..(201): n is a, c, g, or t
  misc_feature (272)..(272): n is a, c, g, or t
  misc_feature (409)..(409): n is a, c, g, or t
  misc_feature (412)..(412): n is a, c, g, or t
  misc_feature (416)..(416): n is a, c, g, or t
  misc_feature (422)..(422): n is a, c, g, or t
  misc_feature (459)..(459): n is a, c, g, or t
  misc_feature (464)..(464): n is a, c, g, or t
  misc_feature (488)..(488): n is a, c, g, or t
  misc_feature (491)..(491): n is a, c, g, or t
  misc_feature (511)..(513): n is a, c, g, or t
  misc_feature (590)..(590): n is a, c, g, or t
  misc_feature (833)..(833): n is a, c, g, or t
  misc_feature (885)..(885): n is a, c, g, or t
gaaatgggaantgggaaaaaaaaaaaacaaaaagcattggaattggatttgggggaacagcaaaaaaagagaagtatcattcccccttgtcaaattaaacggtttccaaacatttgggaaaaaaataaccggaatgtggtcggtcaccngcaccgggggacaagattagaacaagaggaacacagagggagtcaaatngnngtggggggagtgcagagagagggtggcctaaaaaaagcaaacagggccaacggccacaccaaagtcctgancaggaccaccaatgtcagagggggcaatagccacaacagggaggcccacagcccggcggggccgagacccaaagaccggcgcgccccaccccccagggcgtctcgcgcaaccaccccccagaaccggggaggggaanccnccancccccncagccctgaacccaccctcacccgaccccaccagccncaggnccccccccacaaccccaccggccnganccatggaggcaaggccatgnnngcagggagaggggaggggcggggaagcgcggcgcggagagaagtcgaaggaatgccagccgcacatcaaggacaacnccaggaagttcaggattgccgtagccaaaccgaaaacacaccacccaaggacgcgccaaaccaaacgtgtttcttctcagcactagaatctgtccaccagtgtttccgtggaacattcaaaggattggcacttatgcatgtttccccagtttccatattacagaataccttgatagcatccaatttgcatccttggttagggtcacccagtattctccactcttgagttcaggatggcagaanttcaggtctctgcagtttctagcggggtttttacgagaaccatcaggactantgaggctttctatttgtccat

SEQ ID NO: 583254 - DNA, 2818 bp, Homo sapiens
  misc_feature (232)..(233): n is a, c, g, or t
  misc_feature (301)..(301): n is a, c, g, or t
  misc_feature (318)..(318): n is a, c, g, or t
  misc_feature (2204)..(2205): n is a, c, g, or t
  misc_feature (2222)..(2222): n is a, c, g, or t
aaaattctgccccgattagaggatccctgtggagatgggtctcattactgtcacccagtggagtacagtggcacaacctctgctcactgcagcctccacctgccaggctcaagcaatgctcctgcctcagcctcccgagtagctgggattacaggaagtgagctcacaatgactcaagctgccacatagtgttgattgtgaaatgccagttgaagctatgtcctgcgagttnngggtgctacagttgaccactgcagcagtaaagatgactctgaagaatggcgtgggatggatcctttcnaatgcacttgagcagcngtctccaaccacagggccacagagctggagctggatctaccatgaaagacttctgaatccaggaagagagactgactgggcaacatgttatctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583255 - DNA, 307 bp, Homo sapiens
cgcgagcgccacaaggggctggaactacaggatcatgccatcatgcccagctaatttttgcattttcagtagaaatggcatttcaccatgtcgcccacgagggtcttaaactgctgagctcacgtaatccaccctctttggcctaccaaagagctgctattataggtgcgagccaccacgcccggccagactaatatattaatgccacttctgtaacaaccacaactgcctccattaccttatacagaacagaatcgagagccattgacatgtgtattaggatattgaacaataggtatccattcta

SEQ ID NO: 583256 - DNA, 305 bp, Homo sapiens
gcagccagcacatacctgtccttgaatgctcgctcataccaacctactcgggcacctttacgccatccccaccaagccccacctactagagcctccacccaacgcaaagtccttctatagaaaactttcctggatcactcaaccacaacaatcattaccatctacacaaaattccagacctacaaccagacaattcacttagtacgcgccaactactgctgcatactctacacaacatgctccctgagagcagacaccaagtctgacatgccccagcatcaccgcaacagactgactaagtgacc

SEQ ID NO: 583257 - DNA, 2494 bp, Homo sapiens
  misc_feature (5)..(5): n is a, c, g, or t
  misc_feature (1880)..(1881): n is a, c, g, or t
  misc_feature (1898)..(1898): n is a, c, g, or t
tgtantcacatgttcccagactgttctcaaactcctgagctcaaagcagtccacccaccttggcctcgcaaagtgctgggattacaggtgtgagccatcttgctcattctagtttaaacttttgagtggtttatgcttcctgattggactctgactaatatgttaggaagggtcccaggagataaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583258 - DNA, 3032 bp, Homo sapiens
  misc_feature (2418)..(2419): n is a, c, g, or t
  misc_feature (2436)..(2436): n is a, c, g, or t
gctggactgtagtggcatgatcatgcctcactgcagccttgacctcccaggctcaaacttccgcattccgaatagctgggactacaagtgtgcaccaccacccccagctaacttttttcttcttttggatggagacagggtctcactgtgttgtccagaccggtctctagctcctggccttaagcaatcctcctgcattagcttctcaaattgctggaatttcaggcatgagccaccatgcctggcctgggctagtcctatattctctagagttctctttactttgtgctagccaatctctcattatgctgttcacctgttataatgaataattctctgtattaaattttaccactttaaacttttgagtggtttatgcttcctgattggactctgactaatatgttaggaagggtcccaggagataaacccacacagatgggatttgggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatctaggttgcgctgtccttatgagagtctaatacctattgatctgtcactttctcccatcacgctcaggtgggaccatccagttgcaggaaaacaagcttaacacgcccactgattctacattatggtgaattctataattattttattatatattacagtgtaataatggaaatgaagtgcctaataaatgtgaatgtgcttaaatcttttggcccagctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583259 - DNA, 460 bp, Homo sapiens
attctagagtatccctcatttaggccaattgtactgttgtctgtgtcaattgcaaatgacaacactctgaacaaattgaagaatggcggtcacgagtcagcccagtttgaatagcattgtggactaatgatggcaatgttcactcgggtctccattagtgccaatcaggacaattctatatgacatgtatctcctatgtgtgggatatcaacgagtatcatgtctcatggtgaggacacccgtacggtggttagggtgtcgtagtcattcttcagcacaattcttaattggagaccaagaaccctgggcctttagaggtggtctagcgggagagttccagcgtttgctgccaattgatggggcaaatgatctcttttttcagccacctccactgactcctacctccaaagtttatactatcagaccttattttcctaaggatgaggcatccgtgtacaag

SEQ ID NO: 583260 - DNA, 2427 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (1813)..(1814): n is a, c, g, or t
  misc_feature (1831)..(1831): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctgcctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583261 - DNA, 352 bp, Homo sapiens
acggcatgggattgggcagggtagctcccaccaacggccccagtgcgagatccactaggtgaagccagctgggctgctgagtctattagggacttggaaaatctttatgtctagctaagggattgtgaatacaccaatcggcactctgtatctagctcaagttttgtaaatgcaccaatcagcactctgtgtctagctgatctggtggagacttggagaatctttctgtctagctaagggattgtaaatacaccaatcggcactctgtattctagttaatctggggggacttggagaatctttatgtctagctaagggattgttatacaccaatcagcactcttaatctaac

SEQ ID NO: 583262 - DNA, 541 bp, Homo sapiens
ggatctcttgagctcatgatctgtccacctcatgcccgctcaaacgtgcctgggactttacgttgaatccacaccggcctcatgcctcccaaagtgctgggattacaggcgtgagctgtgcctgggccaccccagcattttttaacgatgtatgtattcagttagttcatgatgtttcccacgatgatatccttggtccgttaacaaccgggtgggaactcggcagtacatttggttatcgggattcctggacttagttaagcgacaacagccaaggttacacacccacagggatggccagtaatttatcaccccagcggggtacatttaatgatggacgcttgtgcgcgcccattattaaattttcacacacggcattgtttcccaagccacaatttctcacaccgttgggttttcccacccaacagtgggttgccgtggcacattcccatgcttcagccattccccatgtggccaaggggtcaccctggttatatcatgcggcagcacacacaggtccccaggtggcttggtgcacagg

SEQ ID NO: 583263 - DNA, 248 bp, Homo sapiens
aactggaggatccccagcgatgggtctactgtatcttctcatttgaatattcagcttcagctaacaatagtctgaatgattggccagtggggaccgtgctgtatagcacagataattctacccaatggtcagtctatgctggaaggaatctgaaagagaatggatgtgggtacatgtataactgggtcactttgttgtgcagcagaaatgaccacaatcttgtaaatcaactctacccatcggcgttg

SEQ ID NO: 583264 - DNA, 2381 bp, Homo sapiens
  misc_feature (30)..(30): n is a, c, g, or t
  misc_feature (38)..(39): n is a, c, g, or t
  misc_feature (1767)..(1768): n is a, c, g, or t
  misc_feature (1785)..(1785): n is a, c, g, or t
ttgatgtaacccggtcatctggcaaccgcnagaggcanncagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatctaggttgcgctgtccttatgagagtctaatacctattgatctgtcactttctcccatcacgctcaggtgggaccatccagttgcaggaaaacaagcttaacacgcccactgattctacattatggtgaattctataattattttattatatattacagtgtaataatggaaatgaagtgcctaataaatgtgaatgtgcttaaatcttttggcccagctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583265 - DNA, 199 bp, Homo sapiens
gtgactctgaggatcccagtacaaagtttgctctgctaccagtgctagattgcagtggcatgatctcaactcactgcaacctccgctcccgggctcaagcgattctccctgctcagctaccgagtaactgggattacaggcgcctgccaccacgcccggccaatttttgcactttcagtagaaacagggtttcaccacc

SEQ ID NO: 583266 - DNA, 693 bp, Homo sapiens
ggttcgcgtcgactgcccagtagtccgcgaatcctccgttccgaacccgttcgtactcccccgatcccgagtgttctctcctttgaaaacactagacgaagtaagtgtcactgcgatctagtttttacatatggagccaaatcaccttgtcagtgcctggcacgaaggggattctgtactcagattgccctcgagtcccaataatcactgaagtgcacatctgtaaggaagaacgggagccagtggggtgaaagctcattgacacttcaaagggagcacaacggaacacatcacagggtatgtgaactggggctccccaagagcgaccgcattgtcactttgtgggtagacatagaccggcaaatgcctaattgtctggagacgtccacgaacaacgcatgggttgtcagagcgaagccaaccccttggtggatccttgagaaattaaatacggcgcagcttaactttcttggtcgacaaggtggtccccccccttaggagacacaacactttgtggctcgttgggagaaggtgtgacgcaacgaatctcaaattatctggtattgggtaaactttatgcagttcttgcaacaattgacttcggtgggtttgaagcaaaaggcacatttcaaaaaatgcccgcattccgcttcccaagtcccttcactttgggattgggacattcccaaacaa

SEQ ID NO: 583267 - DNA, 146 bp, Homo sapiens
ccagattatgaaccagatataagtagcacaattctcgtggctacttccacttcagcagtgtcatgtctattgatgtggagctttctgaatagggaggttaaggcacacctggtgagtaaaacaaatatttcttgtgtagcgttcca

SEQ ID NO: 583268 - DNA, 3034 bp, Homo sapiens
  misc_feature (2420)..(2421): n is a, c, g, or t
  misc_feature (2438)..(2438): n is a, c, g, or t
gctggactgtagtggcatgatcatgcctcactgcagccttgacctcccaggctcaaacttccgcattccgaatagctgggactacaagtgtgcaccaccacccccagctaacttttttcttcttttggatggagacagggtctcactgtgttgtccagaccggtctctagctcctggccttaagcaatcctcctgcattagcttctcaaattgctggaatttcaggcatgagccaccatgcctggcctgggctagtcctatattctctagagttctctttactttgtgctagccaatctctcattatgctgttcacctgttataatgaataattctctgtattaaattttaccactttaaacttttgagtggtttatgcttcctgattggactctgactaatatgttaggaagggtcccaggagataaacccacacagatgggatttgggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatctaggttgcgctgtccttatgagagtctaatacctattgatctgtcactttctcccatcacgctcaggtgggaccatccagttgcaggaaaacaagcttaacacgcccactgattctacattatggtgaattctataattattttattatatattacagtgtaataatggaaatgaagtgcctaataaatgtgaatgtgcttaaatcttttggcccaatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583269 - DNA, 216 bp, Homo sapiens
aaaccgccccccttgcggcgcactttggctcctccaccgcggcacggaggccgggccggtccccgcggaccgccaaattctccgagcagcgcacgaagtcgtcccccgtacgagctgtcggccgttcagaaaatagtgaggcaacgtcccggcctcgagcactcggccgagctcgtctagcagcccgaggagcaggcgcccgcattttctggccgc

SEQ ID NO: 583270 - DNA, 2761 bp, Homo sapiens
  misc_feature (232)..(233): n is a, c, g, or t
  misc_feature (301)..(301): n is a, c, g, or t
  misc_feature (318)..(318): n is a, c, g, or t
  misc_feature (2147)..(2148): n is a, c, g, or t
  misc_feature (2165)..(2165): n is a, c, g, or t
aaaattctgccccgattagaggatccctgtggagatgggtctcattactgtcacccagtggagtacagtggcacaacctctgctcactgcagcctccacctgccaggctcaagcaatgctcctgcctcagcctcccgagtagctgggattacaggaagtgagctcacaatgactcaagctgccacatagtgttgattgtgaaatgccagttgaagctatgtcctgcgagttnngggtgctacagttgaccactgcagcagtaaagatgactctgaagaatggcgtgggatggatcctttcnaatgcacttgagcagcngtctccaaccacagggccacagagctggagctggatctaccatgaaagacttctgaatccaggaagagagactgactgggcaacatgttatctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583271 - DNA, 935 bp, Homo sapiens
ggaagtctatgtacaaggacttttagcaaagatctttgagttggaaaagaaaacggaaacagcgtgctcattcactccgcacagcgagacaataaaagcctgaatcagaaggttatcttcaagaagagaagcagaaatgttactagacgatctcttgggaagtgcaaaagaaagatcttgaggttgaacgaaaagccataactcgagcgtgagttttgaactgagtgaatttcggaagaaaggtatgaagaaacccgaagaaagaagttcagaatttaacatcagctgttgtattcacaacagtaagggcagatgtgcaacatctggaagatgataggcatagaacagagaagatacaaagaacgtcaggcaagagaatgatattgctaggggaaaacgtttgaagaagagaagaagagatccgaagagctcttatctcaggtccagttgtctttgacacatctctgctatagcagcaagaagaacaaacaagggtagctctgttggaacaagcagatgccggcatgtactttagacttttgacacaatgagcaaactcgacgtcaacatgtgcagcatcaatgtgcatgtaattcttaaggagctccgaaaagcaagaaatcagataacgaacagttggcaatccttgaaacgagttcatgagtttgccatcacacgagccattagtcactttccaaggagagactgaaaaccagagaacaaagtttgccgcctcacaaaaaagtccactgctgactcaatgaaagcctggtggaaatgtcccaagtgcaatacaccaggtatccagcaatgaacattgggaactggttgtcatgtggaatactgtgcaaagtagcacagtagtattggggggagatacaagatcagtaaggtttgcggtaatgggggattgaaattattttgctttggtaaag

SEQ ID NO: 583272 - DNA, 276 bp, Homo sapiens
  misc_feature (16)..(16): n is a, c, g, or t
  misc_feature (108)..(108): n is a, c, g, or t
  misc_feature (138)..(138): n is a, c, g, or t
  misc_feature (172)..(172): n is a, c, g, or t
  misc_feature (208)..(209): n is a, c, g, or t
  misc_feature (228)..(229): n is a, c, g, or t
tgtcattgactcaggnctgtgtgcggcttatagggtcctcgtccctgaagagtgtgaggttgtgcttttggatgtgtcccagcagcaccgtgtcctctgctgctccangggtctggaggacactgcttacagccccantgggctccgccttggcttttcccagtaacactgnggtccatactgcgagcgagcattcagcagctatgtnntctgcagacaccctgtatnngcgagaaccttctactggcagactcaggaaaccgcgatctatgccct

SEQ ID NO: 583273 - DNA, 107 bp, Homo sapiens
atcgtcccgaggtactctccaaaacacgcccacgattttagctggagtcaggtccaggcacccaggactcacctacaaactcacggaccgttacatgctaaccctcc

SEQ ID NO: 583274 - DNA, 305 bp, Homo sapiens
cagaccgtggtgtctgactagctcggtcagagcgtggtgagtctgcactgacacgctcgtaggcagaaggtgcacctgggctgtgaggttgcacagacaatgctgagcactctagcactgtgaggctcgcggggcaaagctgcggcggttctggagccggccatattcacaggagctgtggcatactctcaaacgcagagaggagaagcaacggaacggtcgtcatctagcaatgaccacgaagtgatcctgaactcctacttacgtcatgcataactcaagacgtgttcattcccggactccgc

SEQ ID NO: 583275 - DNA, 162 bp, Homo sapiens
tccggatcgtataggagtactgagatgtagcagacaatgaagacgtattcagtcacgtgtccggccactacgtgtccggccacgtggccgacacgtagtggccggacacgtgcagcagaaagcatatgcacttttctatagacttgatttgtacgtgtccgg

SEQ ID NO: 583276 - DNA, 159 bp, Homo sapiens
ggtgcctttgccttttccttccagctgtgcatgtgcacacctccttctccttgcgtctcttcttgcatcgcctggcaggctggccgcattccctagtggctcacggtggtgtgcatctaggcagctgctgtctagctgcaggcaggggtcacgcagctc

SEQ ID NO: 583277 - DNA, 137 bp, Homo sapiens
tggccggacacgtagtggccggacacgtcttgacttgctcagcttttctttaacgtgtgtggccgacacgtagtggccggacacgtgcagcagaaagcatatgcacttttctatagacttgatttgtacgtgtccgg

SEQ ID NO: 583278 - DNA, 367 bp, Homo sapiens
atcccttctcagacagagaattcaagatagctatgttgggacacttaataactcagctacatcatgagaaggaattcagaattctatcagataaatctatcaaagagattgaaatcctaaaagagaacctagcataaattctggagtttaaaatgcagttgaaagactgaagaatgtgtgttttttaactagctgaattgatcaagaagaagaaagaattggtgagcttcacgacaagctatttataagatacaaaataattaagaatgacacatgcctagaagactctagaataatgcctctaaagggcatctctccgagttcttgaccattaagaagtggtagagagaagtatagcgtgacagtc

SEQ ID NO: 583279 - DNA, 232 bp, Homo sapiens
gctttgagagcgtatggctatttcaaaagattttattgaaacaagaacatatgattgagctaattttgctacttcacagcagtaaaagttactaaaagatcattagataatcaatatgcaaatcaaattaataatttaatttcacaaaataatgctgaaattaattctattaacaaaagagaaatagaattagataaaattattaaagaatatgatcaaaaaaaaaaagctt

SEQ ID NO: 583280 - DNA, 256 bp, Homo sapiens
  misc_feature (110)..(110): n is a, c, g, or t
gctgggtgtggcggctcacggccctgtaatcccagcactgtgggaggctgaggtgggagatctttttgagccctggaattcaagaccagtctagtctgggaaacacagcnaagacccgccttgctgggcgcggtggctcacgcctgtaatcccagcactttgggaggctgaggcgggcggatcacgaggtcaggagatcgagaccatcctgactaacacagtgagacactgtctctgctaaaaaaatagtcgacgc

SEQ ID NO: 583281 - DNA, 746 bp, Homo sapiens
gtgtgccgtggagatggggttcgccatgttgccaggctgtctcttaactcctggctcaagcaatccacccaccccagctcccaaagtgctggattacagatatgagccatcaacccagcctagatctctacttttaatatttcactttttatccctattaacaactacagtgcctggcatatagaagtcactcagtgaccaggtggtacggataatatgggtattaagctacaaccagattgcaaaaatactttcttttttaacggcagttatcagttggggtctcaaaggaagatagtgtgtctgctgctgcaactatttctccaacttttatcatccagataccaccttcacaattttgcagattcttgtgccacctgttaatattaattaaactctcacttttcacaattatttactcagtaatagatatagtctttcacaagtcatagttctaataaaagccttaagacaaaaagtcacctatcccagaggcaaccactttgtgagttccgcgttcctttccatattcctacattaatatctataatatactgatattcttggattggggacttctcaacgggtaattaaccttatggtaaacctgattaaccttcttggtgttcatcacattcatttcaatttccctaacttctggataccttaacattttctccgtggccctttgttttgcacactttcacagcacgaacgtcgacccactttaggaacccttttacaca

SEQ ID NO: 583282 - DNA, 383 bp, Homo sapiens
gaggcgagtggttttcggaaagccgccttcggtgtaaccgtggtggcgcaggaatttcgcgagaagggatatgccatcgatctcgcggtggtccgccgtcatgcgatcgtgcaccacgccgcgtggatccacgagctcgctgccgatcgtggtgtcctcgccttgctggtgcaagagatcgttatagtagccgagccagtcgcgcgatctggcccggtacacgctgaaagtcatgcctatgattttaaggcatgcgggagaacgcggctactgccgcgcgcccttacccggtagccggggcttcagagagcgcagctttcgctcgcttccaccacggtaggagtggtggtccaatactcgccgccggggcagtcaccgttgtt

SEQ ID NO: 583283 - DNA, 628 bp, Homo sapiens
tgaatcaggcaagatagtcccatataattcatgaattttgtttacagcactatcataatacagcattgggtcattgcatgtagccgtggtcgtaattaagtccacaataaaatattctgtagcccgaacaccagaccaactaaaatcaccaactgctcacgagccataatggtcagtgcaagaagttgcggtctctgtagtgacctccaagatgggtaaggctcttctgccagtgagtctctgaactatcgagcggctccttctcttgctcagcgaggacttggccgtcctcacttggagtcttggtcttcctattcatcctaacgggccggagtggctccccagctgtttcagttcatccaccacgtcccccttctggtgcatctgcagaatattgtcactgccccctacacagctcgccatggaggtcccttgcgggatgctgggccggttggaatactctttaatgccttgtcggagctccgggtcgtccagcacgttgtaggccgcgtaatcgcggccgccgtgcagccgcagtatctgcccggggggtgcttaagcggctggggctcccggggtcctgtagaaaccccactgttctctcccggggccaatttccgcggcgcgc

SEQ ID NO: 583284 - DNA, 175 bp, Homo sapiens
  misc_feature (3)..(4): n is a, c, g, or t
  misc_feature (35)..(35): n is a, c, g, or t
  misc_feature (39)..(39): n is a, c, g, or t
  misc_feature (141)..(141): n is a, c, g, or t
  misc_feature (147)..(147): n is a, c, g, or t
  misc_feature (151)..(151): n is a, c, g, or t
  misc_feature (162)..(162): n is a, c, g, or t
ttnnacccctccccaagtaggtgaaaacgtgcttntctnacacaaagacaaatggatcttctattcccagaggacagtggacaccaaaacctccctcttcagaatggaggtagacagataaaaatgagaggggcttgagtntcacangacnatctgaaagtnataattacgggct

SEQ ID NO: 583285 - DNA, 221 bp, Homo sapiens
  misc_feature (205)..(205): n is a, c, g, or t
tggacatcgaagactgagtgcagtagaatttattaagcgaaaaggaaaggtctcagcaaaaagaggggtcctgagagcaggttgctggttgcccccttcccagttgactacaagtggcttttacatatgaagctgagtggggctgggctcccgtgtttgcatacaggagcgaatttctgtgtggctccaccccgattcccccatngtgtataggggaccct

SEQ ID NO: 583286 - DNA, 1027 bp, Homo sapiens
aagtcaatacttgggtggtacccaaatctgcttccccatgaaacaaaaaaaaaaaaaaaaaaaaaaaaaaaaaaattttgggcggccctgggccccaaaaattttttaaaccattccgttgtgggcgcgcgggcccagtaaggttaagtatcgaaagtggctcatagcggggtctcctaaggaaagaacccgggccacgacaaagcgcgtgggattctcctcacaccaaaataaaaaacgccggcgggcacacggagcgtttgtggaaaaacatcccaaagggcagctcccgaggccacacagggggacctcacaacgcagcgcagcttccaaggcggagcctcgaatatatcaaattacacgccccgcactggacgacatcaaacgcgcagagcacgggccggacacatcccaatacaaccatgtgggccggcagcctggagacacgaccaatccaacgaacgacggcagtgattggcaaacacgaggcaaaccggcccaggggcgacactcaagcaccccgtggccgaccccatgtggcaggtacatacatatttcggcccacgtggctggcaacaccgcggggccccgaaccagatgtaggccgcagcagatggggcaccagttacaaagtccacaaaccggcgtggacacaccaccaaggcatgcgctgcaacagacagcagaaatatccgaaataccccttcggggacaaaaggcccagggctcgcacacggaaaaggcaccggactgaggcgcacagcttgtggtgtaaacaacgcgccgacaaagcggatgggacgtacatcgagacaccagaaaggtgcgcatgtgcctcggcacaggcgtttccaaggggtccaccatccaccgatatcccagcaacgggtacagctgcacaggaaacacgagaggtcatacaggcagagatatgcaccagggcaggggcaccagcacacagtgctccaacgtgtcgacacaccacagggataggagaccgagcagaacgagacatcaagcgtaacgg

SEQ ID NO: 583287 - DNA, 1935 bp, Homo sapiens
aatccattgcagctcgtcttatcaatgctacctttttatttttttcttttttgagttagggtctcactctgttacttaggctggaatacagtggcatgatcacggctcactgcagccttaacctcctggggtcaagccatcctcccacctcagcctcccaagtagctgggactacaggcacatgccaccacgcctggctaatttttgtattttttgtagggacggagtttcgccatgttagccaggctgcttttgaactcctgagctcaagcaatctgcctgcctctgcctcccaaagtgttgggattacagaggtgggccactgtgcctggccttctaatcaatgatacctaattctgtcttcggtcagtggaactcaactcaatttgtctcctgagtccttttgaaactattctaatcttgtcagtttcctcgctttctggtatggtaagatttccaggatcatgttgtacattttcagtccagatctgaaatcagtcatttctccaaggagccctggttttgttggaaatggtatttagcaaccagtctgggcaataagcaaattcattgccacttgtttggtcataggccttttcggtggacagagctaggaaaatattacctgattctccctctagccacacaaatcatgttaccttctggtcatctgaaggtcctctcttctccaagcggaaaccctctcaaccctgcctcagtcagtgccacagttttgaatctcctaactatatgttgtctttctgcactcttaatttgtgagtgccactcttttttttttttttttttttctgtgacagagcaagactgtctcaaaaaaaaagaaaaaacagaaaactacgtgggggcgagtgcggtgtcccacacctatgggaggccaaggtgggaggagttcaaggagttgaaggccaggaggcagaggttgcagtaagccaagatcaccccactgcactccatcctgggcgacagagcaagactctgtctccaaaaaaaaaaaaaaaaaaaatgccttaccagatgtgtggtagattacattactataagaaatatttattgtctcccttttctgcatttatgagtacttccctcacttgatgttggccaatggaatttagcaggcatgatctatttggtaggctgaatgatgccctcccccaccccccaaaaggtccacgagctaatctccagaacctgtgaatatgtaacttaacattgtaaaagacactttgcagatgtaattaaataacgttctggagatgtaattatctggctaggcccagtgtaatcacaaagggaggctttttttttgactctccagcctcccttataatctagagaggctggagagtcaaaaatcagaaaaagttggtgtaaaactggaagcaacagtagattggagatgctctactgtcagctctgaagatggacggagccacggaacaaggaaacggattctccctaagggagcacagccctgccgactccctgactgggcccatgcctccctccctcccttgattggcccagtgaaacccatttctgacttttgacctccagaaccataagacaataaatttgtgttattaggttggtgtaaatgtaattgcagtttttgccattactttgaaaatattttaggccgggcgctgtggctcacgcctgtaatcccagcactttgggaggccgaggagggcggatcacgaggtcaggagatcgagaccatcctcactaacatggtgaaaccccgtctctactaaaaatacaaaaaattagccaggagtggtggcgggcacctgtagctccagctactcgggaggatgaggcaggagaatggcgtgaacctgggactcggaggttgcagtgagccgacatgtgccactgcactccagcctgggtgacagagcaagactccatctc

SEQ ID NO: 583288 - DNA, 741 bp, Homo sapiens
  misc_feature (464)..(464): n is a, c, g, or t
cagacaccatagggagaaagtacatcagccaggtggcagtgtcagagacgcagcactgggagaggaggacatcgctcaggcgtggcccccaggactccgaggggggaaaggcggggcaacgcgcaaaccttttggccaaagaaacccgggcggggcctttggcgaacaatcccccgttagcccaaaggcgcgcgccaacggggaccctttaaggccaggcgtgctgcggcccaaggaggctaggcctttttaggccccacgggcccctatagctaggcgggacgcgacgcgagcgaaagcgggcacgcggcggcgcccagttgggggcccaacaattccttgaacccaattgtggcgcccagggataccccctagccttggaacttgagtgctccccaacctccttaagggaaagcccccacaagttagagcccccaaggaagcctttagcgagttagttgctnagaccgaagctacggcgttggaatccaccctaacttggggagtttggcttggagccaggcaacttagaaagcgaacccgtgagcgaaaccccgggtgggaacccttaatttccaatcaccccccttaaagtacgtggccaacagctggaggaacttttctagagggccgttccctctcggggccaaccttccccacaaaggggaccttggggcgaacagcctggggaagtatccttggctccgtagggggcaaggccaagttgaacttcaagacctg

SEQ ID NO: 583289 - DNA, 877 bp, Homo sapiens
gaattcgtttgaactttttaggccaaaggcagcatgtaggaaactaactttaaatgggtatgtggtagaatataactgtatattttactgttactgcaatagcatctttaatgggatttattaggtgatatactgcatccttaatgtaattgagtgtagcaacactcatgtatcatgtgtagaaattaacacttgcagttaactgctaaaaaaaacaacacttagaacaattggtgcagggctaagtaagattccattaaccgttattttcaaaaggatgggcatttttaacaccaaactagcaattttattttctcaatgagcaggtatcgggaactccctaagccatctactcttacaccaaccccttcatcggacccaaacacctctctgatgctcagagctcaactcctagtaccctttaagccaccctatccccacgattccaggctgcaactcctcagccacactttgttaattacagttggctcacgcagcaaaggtctcctgagcacaggccatgctgtcaacaaccatccttattttccacaattggtacctatctaataactcccaggacacccacggcacacaccaggtctatggcaaaactctgtgtggacttaaattattaacggtgggggcatgatgtggcggccaagtatgagaagtggttaaaccatggtggcgtgtacacatgtgtgctaattccttgaggaaaacactgaaggtttaccctaggagttgtaccatgtatgccattgatgagccattaacagggttcttgtgttcaacttctagtctggcctacaactcaaacagggactattatccaattacgcaacaggtccgtacacaacgtcacatctacacacat

SEQ ID NO: 583290 - DNA, 414 bp, Homo sapiens
  misc_feature (279)..(279): n is a, c, g, or t
tgggtaaaagcctgtgagcctaagagctaatcctgtaacatggctcctttacctacacactggggatttgacctctatctccaactctcaattaatatgggtggcctatttgctcttattaaaagaaaaagggggaactgtgggaagccgcccccacattcgccgtcacaagatggcgctgacatcctgtgttctaagttggtaaacaaataatctgcgcatgagccaagggtatttacgaccacttgtactctgtttttcccgtgaacgtcagctcgnccatggctgcagccaatcagggagtgatgcgccctaggcaatggttgttctctttaaagagggaaggggttttcgttttctctctcttgcttcttgctctcttttcctgaagatgtaagaataaagctttgtcgc

SEQ ID NO: 583291 - DNA, 2395 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (1781)..(1782): n is a, c, g, or t
  misc_feature (1799)..(1799): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583292 - DNA, 2428 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (1814)..(1815): n is a, c, g, or t
  misc_feature (1832)..(1832): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaagacgcccactgattctacattatggctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583293 - DNA, 2427 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (425)..(425): n is a, c, g, or t
  misc_feature (459)..(459): n is a, c, g, or t
  misc_feature (1813)..(1814): n is a, c, g, or t
  misc_feature (1831)..(1831): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatncagttgcaggaaaacaagcttaacacgcccactnattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583294 - DNA, 2020 bp, Homo sapiens
  misc_feature (1406)..(1407): n is a, c, g, or t
  misc_feature (1424)..(1424): n is a, c, g, or t
gaccccttagccgctagaggcccgggtgccgctagaggcccgggtgccgctagaggcccgggtgccgctagaggcccggatgccgctagaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583295 - DNA, 187 bp, Homo sapiens
ttcatcttgtctacaccagaggtttccacttttgcttcttcctcatttatctcttgctgctgccatgtatgaagtgcctttcacctcctgccatgatactgaggcctcccagccacgtggaactgtaagtccaattaaacctcttttttcttcccagcagcgtgaaatgggtatgtctttatcaaca

SEQ ID NO: 583296 - DNA, 314 bp, Homo sapiens
  misc_feature (127)..(127): n is a, c, g, or t
attccgcagcgttagacggcgacaccattattcagtatatactaaacctactggaatgcaaaagcattcatcatcgttcatattggccatcagtcaatgtattcattggcgatagcagcctcacaanccagcatcacaggtcatcaataggcaatttatagttcaatacacatggcatttgaaatcagtaaatccaaggccagtttatcaatatgtggtactacaataattggccgtgtttctcgcacgcgcgagctattgtatccactatcccacaccacatactgacacgcattccatggcggtacaagctt

SEQ ID NO: 583297 - DNA, 2405 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (1813)..(1814): n is a, c, g, or t
  misc_feature (1831)..(1831): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583298 - DNA, 289 bp, Homo sapiens
tccccctttttggtccctttccccaaagccaccaattgggtgggatgatggttggacggggaaagaggaggggtaggaggatgcagggatgaggggatgaggggatcgagggatgtatggataaatagatagacccagtcatctgaagcaactaaaaaatggtagcctggactcctggagagggtaaattccgatccaggaaacttttatttagccccggccagaggccaaaaattttatccatttaaacactcagataggttcttaaaaggggggaccctcatagagt

SEQ ID NO: 583299 - DNA, 2427 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (421)..(421): n is a, c, g, or t
  misc_feature (429)..(429): n is a, c, g, or t
  misc_feature (447)..(447): n is a, c, g, or t
  misc_feature (450)..(450): n is a, c, g, or t
  misc_feature (456)..(456): n is a, c, g, or t
  misc_feature (459)..(461): n is a, c, g, or t
  misc_feature (465)..(465): n is a, c, g, or t
  misc_feature (1813)..(1814): n is a, c, g, or t
  misc_feature (1831)..(1831): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggancatccagntgcaggaaaacaagcttnacncgcccnctnnntctncattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583300 - DNA, 88 bp, Homo sapiens
gccaccctcccatccctgagccaggcagagccgcaggagctccctccttcaggaaggcctccgacacagctgcgtccctgagtcaccg

SEQ ID NO: 583301 - DNA, 1527 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (913)..(914): n is a, c, g, or t
  misc_feature (931)..(931): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583302 - DNA, 2084 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (817)..(817): n is a, c, g, or t
  misc_feature (1041)..(1041): n is a, c, g, or t
  misc_feature (1196)..(1196): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagcctcctgcctcccgaaggcctgcacaggcccagcctctgcctcacagcggactctccangcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccggcggcctctccgggcccagaacctcctcaagtcggcctctccagacccacttgcaccctccgggcgtnctctccgggcccagctcttcttcctggttgcgtctccaggcccgactcctgcctcccaacaacgtctttggactcagctcctgcccagctcccagcggccctggtaggcccacaacttccctaagccaagctccccaggcccagctcaggcctcncggtggcctctccaggctcagctcctggccctccgatgacatctgcaggccccaaatggcctccggtcggtgggctcctctaggcccagcttgggcctcccggcggcctctgcaggcccaaatcgtcccgaagtcagtctctccaggcttagctccagcctcccggcggcctctgcaggcccaagtcgtcctcaagtcggcctggaagtgggcctggaagagcagcaagtcggcctccccgggcccagctccgtcctctcggcggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583303 - DNA, 318 bp, Homo sapiens
  misc_feature (115)..(115): n is a, c, g, or t
tccttcggcgcgagcacttgcggcactttcatttacctacacacacacaaatgcacaaatcacattacattactgacacgaaaattattgtggagggagagaaagagggaggatnctttgaatcatgacacactgccaatattagaactcccttttggccaggcgcgatggttcacacctgtaatcccagcacgttgggaggctgaggagggcggatcacgaggtcaggagatggagaccatcctggctaacacggtgaaaccccgtctctactaaaaacacaaaaaaaactagccgggcgtgctcggcggccggcag

SEQ ID NO: 583304 - DNA, 782 bp, Homo sapiens
  misc_feature (17)..(17): n is a, c, g, or t
  misc_feature (72)..(72): n is a, c, g, or t
  misc_feature (233)..(234): n is a, c, g, or t
  misc_feature (236)..(239): n is a, c, g, or t
  misc_feature (256)..(256): n is a, c, g, or t
  misc_feature (270)..(270): n is a, c, g, or t
  misc_feature (276)..(276): n is a, c, g, or t
  misc_feature (317)..(317): n is a, c, g, or t
  misc_feature (349)..(349): n is a, c, g, or t
  misc_feature (392)..(392): n is a, c, g, or t
  misc_feature (398)..(398): n is a, c, g, or t
  misc_feature (440)..(440): n is a, c, g, or t
  misc_feature (446)..(446): n is a, c, g, or t
  misc_feature (452)..(452): n is a, c, g, or t
  misc_feature (501)..(501): n is a, c, g, or t
  misc_feature (507)..(507): n is a, c, g, or t
  misc_feature (530)..(530): n is a, c, g, or t
  misc_feature (534)..(534): n is a, c, g, or t
  misc_feature (571)..(571): n is a, c, g, or t
  misc_feature (586)..(586): n is a, c, g, or t
  misc_feature (589)..(589): n is a, c, g, or t
  misc_feature (619)..(619): n is a, c, g, or t
  misc_feature (687)..(687): n is a, c, g, or t
  misc_feature (771)..(771): n is a, c, g, or t
atttatttgaacctatnttttcactatgatgaaaattattcttcaacattgatccaagctcccacatttganggttagggaaaatattgcactttgcattttctagcactcctcatacacggcaaaaagttttaaaaacattctgctagttttgttttatacaatctcccaaattcatgcacacaatcattccaaaccaatgtgaggttatcccaaaaaaagggaaaaactcnngnnnncataaccttaaaattgncactaaaactctgntaaagnaaaaaaatataataaatggcgtcttatacaaattgtgcagnaacatttagaggtgtgcttggcgcaagagagngtagttttattattgcgctcatcgctcattttcattctcttgnaccagnagtcgctgtctgcagtctgctcaccctcgcaaccgggtcagnctcggnatatgnattagcgctgaagcgcaacatcctgcaagcatggaaggcagcggctggnaactgntaatgggtgttttgctagatttncttnccagacatggagttacgttttcgagtttataaacttncatgcaggcaagttnttncggtttaaaaaaattcgcttggactacttncttaatggggtgaaccagaattcttttaatgttcatgaattctaatgcccaggatggagggctaatanttgggggttcaaaacgggatgttgggctggcagggcagtttttacccacatggatttatgctgtctttccaggaaggcattctnaatggcttcag

SEQ ID NO: 583305 - DNA, 2084 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (817)..(817): n is a, c, g, or t
  misc_feature (1041)..(1041): n is a, c, g, or t
  misc_feature (1196)..(1196): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagcctcctgcctcccgaaggcctgcacaggcccagcctctgcctcacagcggactctccangcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccggcggcctctccgggcccagaacctcctcaagtcggcctctccagacccacttgcaccctccgggcgtnctctccgggcccagctcttcttcctggttgcgtctccaggcccgactcctgcctctcaacaacctctttggactcagtgcctacccatctcctggcggccctggtaggcccacaacttccctaagccaagctccccaggcccagctcaggcctcncggtggcctctccaggctcagctcctggccctccgatgacatctgcaggccccaaatggcctccggtcggtgggctcctctaggcccagcttgggcctcccggcggcctctgcaggcccaaatcgtcccgaagtcagtctctccaggcttagctccagcctcccggcggcctctgcaggcccaagtcgtcctcaagtcggcctggaagtgggcctggaagagcagcaagtcggcctccccgggcccagctccgtcctctcggcggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583306 - DNA, 2395 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (1781)..(1782): n is a, c, g, or t
  misc_feature (1799)..(1799): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583307 - DNA, 125 bp, Homo sapiens
aattcaagcttctaacgatgtacggggacatgtgtgagcctcagtttcctcatctgtaaggggggcaatgatacctacctcacaggggtgttgtgaggattaaatgtgaggaggatagtgaaaaa

SEQ ID NO: 583308 - DNA, 100 bp, Homo sapiens
gttgattgaggatcccccccgcgcgcgttctgcggtccgtgccgctctgcacccaaccttgtgcctagtgtgagcaatgggcaatggcgcgcgagggggt

SEQ ID NO: 583309 - DNA, 944 bp, Homo sapiens
tggagggggccccactttttattaaggccggccctaacccctgcctgggggaaaggccccccgaaaccaaatccggggtcccagggggtgcaggacacaaaccggtgcttggaggggttgccccaagccggcggctcgaaaatgagacctcaaccactgtgggcgccccaggggcacaggtgtctgtggcatcgccgcaggggcaagcaagaagcgccaccatttcggtccacgaaagaaagtgtggcacagatgcttttcgtgggccaaaaaagcgccacaggtgtaagacgctggcaaacaggggcgcggccatcttggcccttgttggaagtccagaagggcccaaggtgccgcacgccgaccaacactcccagaaaggcgttctccgaggctggatctgggaattgatgccgctgtcaacaaccgccaacccctctggttgggaactctcccacggggcttggaaacccatttacaatacgctgtccagaaaagaaataacttgcgggattatggtcccacagagagggcggtggttcccaccccggggcacaacgggggggataaaaacgtggggggccgtaaacgcccctctgttgccgaaacttgttgtacccgggaaaaaaagtcccttatggactgagatcttcgactctcttgggccttgtgaaaacccatcttagtggaaggagacccccccacttggaaagtcgaaaggcggggggataccaccaacaacccgttaaaaaaagggaccgaaatccgggggccccagcagttgtggggcaagtaggagatccaaagtgcttagcgagaattgagaatagcacagcctcatctacaatagggtcagacccggccaagccctggcttgaaaacgtgccgggccatggactgcccggccaacgggccgcataagtgcacacgaggcaccgacaaaa

SEQ ID NO: 583310 - DNA, 160 bp, Homo sapiens
tcgtgcagcaaggtggggcaggcaagcaggcaggcaggcaagcaagcaaggtgcattggtgcaggcaagcaggcatggcagcatgcaagcatgcaggcacagcgtgcagtccagcatcacggtgccaagctggagccaggttgcaagcatgcatgcaggc

SEQ ID NO: 583311 - DNA, 1506 bp, Homo sapiens
  misc_feature (798)..(798): n is a, c, g, or t
tttcacgaggcgtctgctgttagtgttgttgttgacagccgccgttgtttgtcttggttgtctggcatatacatacaccttgattggggcggcctccctctcctcatatagtgcgcgcccgcttcggtcggtggttgttttgtcgccctgcctcatcatcacttgtagcggctttttacggtctggtcgtatcgcgcgtctcgcattggttgttgctcatcgcccaccccgccgctggtgggtttttttgctgccccccgcacgttttaaatagctctctgccggggcctcactaattgctcccttgtgagacccggggggaaatcatcctttgggtgaaggagcgacaaagaaccttttgggagttggggggcctccccttggaaactgtccatagctgccgaaatgttaaggacacctcgccaactaaaggggcccgtccccacatacacaaaagaagtgttgtgggaagaaattttctttcttaacgggtaatttaaaaggggcccccacagaggacccctgcttttttcctgccgcgtgtgtcgcaaaacccgaactatgcaaggattcttccttttgctgggggtgggattatgtgctcaaaacccccctcctcgagtaaggtgcttttaaaatagcccgggatttcttcctggacccaattgggaggttgggagaaaaaaccggggggaattttttccctcacccaagtgggcgccctctcggggtgtacaaaaatttaagcgccacgtgtcctcttgtaacgcgaaaagggttttcacaacagagtttganttctttaacagaaagaatatttggaaagaagtgatagacccagaataatagcgtttggagatatggggataccaccctctccccacgtgttccaagggagcatatggtggacacatatttcgggagaaaaaaaagtgtttccattttacaagggggcacccggtgttatacacataccatatgccgcagaaataccatagggtggaccgagaatatgatatataccccacctcgggagcccgcttatattaggagagaacccagagattgtgtttctcgggaaacctcttcgccatatcttgggacccctcggaatatggaaaaattatactcgtgggaccactttagaataaatgggcgctaggtttctttaccaatgaaaatggttcttcttaggagattcttataaaatatggccaggtacactttacactaatggttacctggtacccccgccaggtggttgaatttttataaaatagagttttctctgccagtatagcttttagtcttaagaaaagccaccagatgggagccaatacatttccttcttttgaagagaatcccccaaagttagttctcatccttaaagtgccaataattgtttaatcttttaaactgggccaactttggaagaacttttaacagaagcctccatgatgatcactttgaattgcttgtgatttccaaaataaagccgtgaagcca

SEQ ID NO: 583312 - DNA, 1097 bp, Homo sapiens
gggacgcgggtagccgtctgaggtgccggagctgcgggaggatggagccgctgaaggtggaaaagttcgcaaccagccaacaggggaaacgggctgcgcgccagtgaccccgctgcagccccggagagctactcttaccgctacggatccctatggcgtacacggtgtgcaacggggacgtcgtggcgtcgtctgacgagcgcatgccttactcgggaacggaaacagctgactgcgatgctctcacgtgccgcgtacgccaaagtactgatagatgctaagtgtcagacagaaagcttgagccagaccacacagcgggactgcaaatgccttaaaaagctgcaaacaccagatatcctccagactccgtatcgaccttcttggcagagttgtcttacacacttctggcatggagcaccttacagaccttccgcagaacagcttacactccattatctcgatactggacgtccacatccattaaccacaactgcacctgcacagcatcggaacagcaggcctcaggccaccatcgtcattgaccatatccaacatttcatgaagaaaagaaaataaggatggcatctaagatgccaacatgcattataaacttattagaaagccttttgcaaaagatgatattcaagtctattcagcaatactgtaaatgataagatgcagaaagttagaagtaaggacatattataccaaaatcaacaaaagcagcacaaaacagaatggaatccacaaacatggtcggacacgcgtcaaagggacccacacataacggagagaacgcagaagaaaacgagggagacgaacgggaacacgacagagacatggaaaatgagaagacaaagacaagcacgaaaccacgaaggaccacaaacggatgaacgtgagaggaacaggtcaaccaaggacagaatcaactgcaacgggtaacaacacagaggagacacacacagcaaacgtgagaaaaaaacagaagacaagacaacaggcgggcaagacatagacaggacaagaagaggaagcaaaaaaagaggaaagaaagagtgaaccacagaaggaaacgggtcctccatcggaggaaa

SEQ ID NO: 583313 - DNA, 141 bp, Homo sapiens
ttcgaatttgagtctcggtcccgtaattgtgcataccctggaggtgcggggctcaggtggcgggaacagagcctcaattcactcgaaaaaagccgtcacgcgaccgtaatgtcgagctgctggttggcgcgcggtgatgca

SEQ ID NO: 583314 - DNA, 281 bp, Homo sapiens
  misc_feature (51)..(51): n is a, c, g, or t
  misc_feature (161)..(161): n is a, c, g, or t
tgagatgttctgtgaccaggagcctgtgttcagcccccacttggtcagtcngggcagctttagaaaatccactgtagaacactttagtaggtcctttaaagtgttctcctttgggtgggtgtagaacacagaggacctccagtgctctttttttcccccangaatatgagccccaaggagcagttctggggtagacaggttctcaggcggtctgcagggagagctccatatcaggaaaatgatggctattgcccagatttggagctgagtgattcagaggc

SEQ ID NO: 583315 - DNA, 317 bp, Homo sapiens
  misc_feature (53)..(53): n is a, c, g, or t
  misc_feature (71)..(71): n is a, c, g, or t
ttgggcctgtggcccccctaccccaaaatcctcatccttgaaattaataagcnccccaataatccccccanattgtgggaggggacccaagtgggaggtaaattggatcatgggggtgggtttccccccatactgtactcatggtagtgagtctcatgatatctgatggttttataaagggcatttcccctgcacatgttctcttgcctgctgccatgtaagatgtgcttttgctcttcctttgcctttcaccatgattgtgaggcctccctaaccatgtggaactatgagtccattaaacctctttttcttttcaa

SEQ ID NO: 583316 - DNA, 151 bp, Homo sapiens
  misc_feature (45)..(45): n is a, c, g, or t
  misc_feature (102)..(102): n is a, c, g, or t
tgatctacaggatcttggcgtagtgcatggctggaatggacccancttcccttgggcactagttctctctgggcagccgacgcagcctttaccagtgcactnggtggctagctgcacatggacttttggcagcttctagatagttctgctc

SEQ ID NO: 583317 - DNA, 154 bp, Homo sapiens
actgagcaaccgatctggagacaccgtgagaaattcaaggtgacgtacttacgtaaaacgtatgagctcaggccacggtgctggacgtgttaccaggcagagtgtgatgactatgtgcccgaaaccagacgaggtacctaagacagctaagaga

SEQ ID NO: 583318 - DNA, 1597 bp, Homo sapiens
  misc_feature (1393)..(1393): n is a, c, g, or t
ccatgtgggggggcgacccacatgtgtggggcggcttgtttctgctgtatgggttcgctaccagacggataagtgtggtggttgccgtgctcccaagtgggtgtgtggtgtggtctgtgtctggtggctgccttacaacagcgttttgtgctgtggggttgtcccccctacgccccttgtgtatatgttgtgtcgcctgccgccgtgcctcccctgatgtgtgggtctgcgacttcccggcaccttggggcggtgtgtgtcgcgtccttctggtgtgtctacaccggcggggtggggagaggttgatggtgccccctgggtgggatccccccgctgttgccccccgaggggcgcctcccgcatagtttgtatggggctcctccccgcggggtctatatgtggggcgcccccccctgcggtgaatatgtggtggagtctcttctcaccacccaccccgtcgcggggtcgtttgctacgcacgacgtcgtggtcccaacgatgggggcacaagggtgttgtgttgtgccgtgggaagcagcgccttcgccaacagcggcggtgtgagtagtatgggcactgcttaggcatcgtcccacacccctgtttgctgcgcgggtgatgttatataagctgttctgggagaaagattgtagggccgccctcgtcaatgagttgtctcctcctgcagaatagtcgtcttctcgcgtcgccgactcgtggtcctctcgccgccgcgtcttgtgttgttgtgtagtagtattgtggggtgtcgtcacctctggggactacataggcccccactagggtgctgtggtgtgttgtgcagagcagcgggctgttgtctgcctctacctcagtctttagtagccgccacccactcttttgggcggcgtgatcatccctctgtgcggcctctgttgtatccgctggtaattagatgatggaggttacaccacgcagcacaacagctttttgcccgcgctgcggtgggggttcaccgtcccacaggccacgcgtgggggagcctcacagagacagcgcgctcgccttcgcgcagcgcctcggtccacacgcgctgccacccccaggcgtgtctcggcgccccacagcgcacacgcgctctcacagcaagagggtgctcattataatgtagatacacatttactctcaccttatatatacaccctctctccacacccacacactctctctgtagctgcgcacagtgtggtgcgctatatatacactcaggtctctctcagatgatacgcgctcgttgcgtctctctcacaattgcgccaccactctgtgataagtttgtgagatctagagtagataaagagactcgcgcgcactagacgatccaccacacagtgcactgtcgtcacaaccnctctccacagagaaggacaacaggagaatagttttgtcgcgacaccccctctgggcttttcttttttgcgccctcgcgcaccgcccaaaggtaattaagcctcttcttaacactccactactcttttccactcggaacacccccttgtaccccaaaacttgtccccagaaattttgacaaccccctttaaaaaagtttaatgta

SEQ ID NO: 583319 - DNA, 163 bp, Homo sapiens
taggctgccctgaggatcccaggcaaagctctaccatcagatttcgtgagaccattcactattacaagaacatcacggaaagaccgcccccatgattcagtcatctcctaccaggtcctttccacaaacacatggggaattacggggagctaacaaagaatga

SEQ ID NO: 583320 - DNA, 269 bp, Homo sapiens
  misc_feature (26)..(26): n is a, c, g, or t
  misc_feature (30)..(30): n is a, c, g, or t
  misc_feature (35)..(35): n is a, c, g, or t
  misc_feature (44)..(44): n is a, c, g, or t
  misc_feature (51)..(51): n is a, c, g, or t
  misc_feature (58)..(58): n is a, c, g, or t
  misc_feature (74)..(74): n is a, c, g, or t
  misc_feature (123)..(123): n is a, c, g, or t
  misc_feature (176)..(176): n is a, c, g, or t
  misc_feature (230)..(230): n is a, c, g, or t
ccttctacgtctcatctctggtaggnccanaatgnaggtgccancttagcntcatagngtagtgacttgactcntgaattttatatattgattactttgtatttgttttatttttaaagtctntaagataatagatttgtgtgtgtgtgtgtgtgtgtgtgtgtgtgtgtgtgcanccggagttcccattgtggtgcagcggaaatgaatttgtctaggaaccatgaggntgtgggttcagtgatagacgtaaataggggtacagctcg

SEQ ID NO: 583321 - DNA, 1626 bp, Homo sapiens
ggaggcggtacacaaaactgccaccgtcccattacccaacagcctgcctctgttgaggggctttcctgggacttcagactggcaccctcattgtgcttgcagctgtcatgtttccttgcccagattgcccatagctgcttccctggcctcggccttgaacccctctagccagcaactgcccaggtaacactttataaaactgagccgctgtccctgcttggagccttcagagtagacttcagacctaggcagagtatccactcagctctgccgtttctcctgctccccacttcgggcctgcacgcttcccgccgctcggcatgctccttccccttctccgagaatgacgtgctccccgcactccccacactgccgccttgggaccaagaaggtgcctctcacaccttactgctctcctccaggcttcgtggttgcttttcagcctttttccctggatttgaactttaacaaaggtaagatggaggtttatttttcaccacttggctgtgagttccttgaggataggaacttgtgttttactcagatctgaatctccattgctttagtggtgtgctcaatacatggtaggggtgaatatttaatgaatgaatgagtgaaaatatctaaattttgcacaggagagcaattagagaggcttaaacaggaaggaagtcttctaattccttaaaagcattatctcatatttgaagagttcaagtttgatgcaacataaactgataaagtttgaaataaaaagagacaggttggtaggaaagaccattcatatcctatccccaaactggcttaagtccactcccactgcccccagctaccacctttttactttattctacctgctatttctttggccaccggaataataagcctgatgtaaattctgtttcatactcccacaggtcaactttttttggagtttgacaataattattccaagtcaagtaattcattgattttagtggaagattgttttccaggtgttattcttccatgcgcctcacccccatctcataaagtagaaaagagatgatttaatttatgggtctagaaaataaaaatgtaaatacttgcttgttaaattaatttttttctaccttcatttttacctttaatatttcaagataatattggacttaattctctgagacacacaaacatcctgcataagtatattgacaacatacattttatatgtaagtgaaccatatgggtgagcctctgctttctccctgacagcgctgttctttaagaaattaaggctaaccaggtctataggttttaatgggagatgtctcctaacttttcaaagaccagatgttcttgttatactgataaaaacttattaaaaaaaaaaagaaatagggattgatgatgttcaacattattctctttgaacaaatacatcatttgttcatacttggtttctcagtatttcaacaataaagcatgttttaatgatttgtctttagaggagtgagcactcctctgggggtatattacaactgggaaaaaaaatatagtttgaaaataaaataactgtttacccttaaagaaattaactctatggtgccttaaggttacatttgcaataaacttttttacatcaaa

SEQ ID NO: 583322 - DNA, 270 bp, Homo sapiens
actctaaggatccacttcgctcgccggcaggtctcatagatttggtgttactccacttgaagggattccaagccaggaaccaagctgtgaaggtggggggctcgtgtcctagttaacaaaatgatgggggtctcaaggtcacgcccggtggaatgggtcttgaggtattcctggtgcagtggttgctgggggcttcttcttcttcttcgttgggattgttccccaatcaagaagaagaactggtcccagaaattctggaaggaacccacg

SEQ ID NO: 583323 - DNA, 321 bp, Homo sapiens
gtcgaccccgaggatctgcgcggcacctacgtcggccatgcgcaccccgcgacgatcggcacctcaagcgactcggcatcaccaccgtggagttgctcccggtgcaggcctcggcatccgagccgtacgtcgtccagcggggcatgacgaactactggggttacaacacgctcggattcttcgcccctcaccttccatatgcagctgcgaccgacccggtcacgccgtggcgagttcaaaggcatggtcaaactgctgcacgccgagggcatcgaggtggtgctcgatgtggtctacaaccacacctgcgagcagtcgacg

SEQ ID NO: 583324 - DNA, 1091 bp, Homo sapiens
  misc_feature (230)..(230): n is a, c, g, or t
  misc_feature (500)..(500): n is a, c, g, or t
  misc_feature (568)..(568): n is a, c, g, or t
ctgccgcccttttttgttgtttttttggtggattatacgttttataaaactcgggaggggtagtggcagggctttcactcaggtgttcccttctcaaatttaaaaaaaaaaatacaaaagctacgttagaaacaacgtctcagactcagacgacttaacatttctcccgacctcgagggcccaagtttcttctggagccgtgcgcctcctcggagaaccgcctggcggangttcgggctcctccgagaggatacgggggggcgcgggcgcgcgggcgcgggggatagataggcgcctctctttcctctcctctcctttcctgtggggggggggtcctcctctccttcttcctttccggagccccttttcttctccttcaacaaggcctctcctcacagagttagcgccgcgcgccatctctatataggggggaggtgtccccgcggagaccttggagagcgccgtgttgtgtcccgagaggggtgtcccccgggggatancgcggtggtgtgtgtgtgcggcgaccctgtgggggtgttcggcgccagcgagagcggcgcgtgcctcncccgagagagcaccttgagaaagtgctccctgtccgagataccgtgcgggggggggctccccccgggaggatcgcgtgttgggggagaaagtgtcccctctacgagaagctgttcggtcttcttgtggcggtccaattagagagtgtggtcgttgtaccccaggtgatatgagcaggggactccgcgcgggggcggcgcatttgtgtagtgcgccccgggggattcttcccgttcacccacacacaaataataatcctgcgggctgggcgacaagccaccctgtggacatccatccaatctcgcggtgagcgggggcaccacaccggggtgggggcgccttctacaatggtggctccacacaacacatgggtgttgctttctctcgcctcccaaaagagagattggtcccccgctgcggtgtggggaccacaagacgtttatgtctgtgggttcttgaaaaccagcacaacaaaacattgtgacaccccacacaccacaattgtggtgaaacgaccaacagcg

SEQ ID NO: 583325 - DNA, 1971 bp, Homo sapiens
  misc_feature (1357)..(1358): n is a, c, g, or t
  misc_feature (1375)..(1375): n is a, c, g, or t
tacagctacgggtgaggtacagctacgggtgaggtacagctacgggtgaggtacagctacgggtgaggtacagctacgggtgaggtacagctacgggtgaggtacagctacgggtgaggtacagctacgggtgaggtacagctacgggtgaggtacagctacgggtgaggtacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583326 - DNA, 1339 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttgtttgagtctgtataactgcgtg

SEQ ID NO: 583327 - DNA, 2167 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (1553)..(1554): n is a, c, g, or t
  misc_feature (1571)..(1571): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagaccccctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583328 - DNA, 1146 bp, Homo sapiens
ggcttagaagttctcgtccgtttcatgactatgaatgagttgctggaagtgaacctcggtgggtctcgtactaccaccctctgagtgcgagcacgttcgtagtacccagaggcatcgcgatcgacatcttatcatccgtgacacgctccgtgaacatgaggccacaagcggtacacctcgaacggcccagttgcgcagccagcacggggcgactatgagcaaccacggaacaggcctggcgcagaagctgtcgcatcatcgcgttgagatctgccagaccttgtgatgacacgccagtctctacacttgcgtctcgtggtgtcgctgagtaaactgatcattcatcgcacttgcgaatagagcttgccttgcggtcggggacatcaaccatggagctttgtcgatatcttaactgaaagagctcatggtgccgatggtcgtgtatctgactttatcgaactcggaggtatggaagtcgataggtcttagaagaaagctataaaggcaatcctgaattttctttgatctgatctacaattgacgggcagaggaagttattgtaaaattggaggtaaagctggtcgaacaccacaaacgaaggctagagcccttgacttgcttttccttgcgtgtgataatgcgggtctatgcccatcaatgccgaatgcaactgaggtgacaagcgggggccttgtagatgagcctatggacttaattgattgcttttaaaacctttcgtgggagccttcaaaggtggtaatcctttaaggtcactctacctaggtagagtctgttagataagacctgggccttgtgtgcgaagattctttaatgcgcccaaatcgaagttgattacttaacatgtggatcatcccaagttacccaatttaaattgatgccagggaagatcccagcaatcaaagagaatttaggatgacccaaggttgaacccaaagtttgggcgcaacggattaggagagggcggccgaagatctgggcctatagggcgcgaacataatcttgctttgaaccaaggcaaacctctgggtgacggaaccagtgattatttgaaaagggctaaggcttcgccgaataaattgtcccattagaccgtgcgcgtgacttccccgggatccccgatgatgg

SEQ ID NO: 583329 - DNA, 1099 bp, Homo sapiens
  misc_feature (20)..(20): n is a, c, g, or t
  misc_feature (103)..(104): n is a, c, g, or t
  misc_feature (211)..(211): n is a, c, g, or t
ggcaagcgccctaggtaccngccgctccggatagtttcccagcgtgactccctgaggctaggcactcataccacggcccgggaacctctgcgccccggacctnnccaggtcccaacaacgtctttggactcagctcctgcccagctcccagcggccctggtaggcccacaacttccctaagccaagctccccaggcccagctcaggcctcncggtggcctctccaggctcagctcctggccctccgatgacatctgcaggccccaaatggcctccggtcggtgggctcctctaggcccagcttgggcctcccggcggcctctgcaggcccaaatcgtcccgaagtcagtctctccaggcttagctccagcctcccggcggcctctgcaggcccaagtcgtcctcaagtcggcctggaagtgggcctggaagagcagcaagtcggcctccccgggcccagctccgtcctctcggcggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583330 - DNA, 101 bp, Homo sapiens
  misc_feature (77)..(77): n is a, c, g, or t
tgacatccaacatgtgcgtctgctgccggtcgttcttcaacagggagtcgatgccggcaccattcattcagaagtanaaagggcgagctcttggttcaaga

SEQ ID NO: 583331 - DNA, 1505 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (913)..(914): n is a, c, g, or t
  misc_feature (931)..(931): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583332 - DNA, 1939 bp, Homo sapiens
  misc_feature (1325)..(1326): n is a, c, g, or t
  misc_feature (1343)..(1343): n is a, c, g, or t
tacagctacgggtgaggtacagctacgggtgaggtacagctacgggtgaggtacagctacgggtgaggtacagctacgggtgaggtacagctacgggtgaggtacagctacgggtgaggtacagctacgggtgaggtacagctacgggtgaggtacagctacgggtgaggtacagctccatcgttacaatggcctctttagacccagctcctgcctcccagccttctctccaggccctgaactttctcaagtcgacctcaccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583333 - DNA, 1971 bp, Homo sapiens
  misc_feature (1357)..(1358): n is a, c, g, or t
  misc_feature (1375)..(1375): n is a, c, g, or t
tacagctacgggtgaggtacagctacgggtgaggtacagctacgggtgaggtacagctacgggtgaggtacagctacgggtgaggtacagctacgggtgaggtacagctacgggtgaggtacagctacgggtgaggtacagctacgggtgaggtacagctacgggtgaggtacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctgcctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583334 - DNA, 276 bp, Homo sapiens
  misc_feature (43)..(43): n is a, c, g, or t
tcgttatgtggtcgtctcacaacaggcatttttaccgaaatanaggaattttttcaatacaatcagttagaaatacacacaaattacttgaaaaaaaaaaaaagaggaggccagaataggagctcagccacttgtccaagaagcagctgggtccccccaaccaggctccaccgcttgagggtcctgaactttagctggtcagccccgtggcctgctcaaaactgcaaacggttcatacaaagggtggtctaggggacccagcacaaaattaattaa

SEQ ID NO: 583335 - DNA, 556 bp, Homo sapiens
gtctcattctgtcacccagactagagggcagtggtgcaatcacggttcagcacagtcgctcaacctccgtgggcctcccaggtagctgcgatcagaggtgtgcaccagactatgtcccgagctaattttctatttattaattattctgagattgtgtacagacagggtctggctggtgttggccaggtctgggtctcgaagctcctgggctcaagtgtgtccgtcctcgacctagagcttccgccgaaatactgggattataggtgtgagccacgtgtgcccaaggctttgccatcaatcgatcattccgcacaggcctgcggacaggcagttttgccaaaagctgggcaaaaggaccaaaggcagttcccgagcaggagggcgatagcgaggtggaaatacatgtaagacaaagacaaaacagacagacaacgtcgcagggcggtagcttctaatggtccgtcgcgcagcgcgagatcgaacatgagcgagtagactagcaacacaggcgcagcacatgcgggcaaaacgaccggtgggtctaccccgtgagacc

SEQ ID NO: 583336 - DNA, 239 bp, Homo sapiens
acaactaccaaagaggcctgtaggagacaccaggggggcggccaccacacagtacctgaccaatactgctgagaaaggcgcagtctgctgagtatgcaatctcagatctacttgactgcttgccaaatggctctaacagagcatatagtgagcgagaggtagagccgcaggtctaatagctgatgcctcaagtctctcgttcacacccagatctacacagaaccatgtgctccctctgc

SEQ ID NO: 583337 - DNA, 1931 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (1317)..(1318): n is a, c, g, or t
  misc_feature (1335)..(1335): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttcaggcccagctcatgcttctttgcagcctctccaggcccagctcctgcatcttggtggcccctccaggcccagcctctgcctcccgtcagcctctacagtcccaacgtctgcctcacagcagattcttcacgcccagcatatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 583338 - DNA, 993 bp, Homo sapiens
  misc_feature (217)..(217): n is a, c, g, or t
agcggatgtcgagaatgacccaactagatggcccatctcagatgacccagtagaagctgggtggacaagatagttctcatgtcatggaatcagaacttcgctaattaagggtgcttatagatagcctcacttccgtaacacttggaagtagacttacgcgaaaggattgatcatgacatcataaaggggaacttaccgagctatgaagacggtagangacgcaatagagcaagacaaactgaacaatagaaagatagatttggaactgaaacccaaaagtagcataatagcctaggcgtgcatagcaaaaaacctattctacttaagtatttccaacacgtatgcggtacgatacgaagacacaacctaatgtggtagaatcacgtgacttggacgggcttctcctcttagaggtaactaaaggaaactatggagatcgcgactcactatttaactctcgaaatcaaataccctacctggcgttagatcaatcattacgccgcgaatacgtaaatagcgcacatatccagatgatggtatggaacaaagcatcatcatgcacactgcttctaatgatgcctaacgtgggttagactacttaatcctattcacattgagtcccaagggatttaatggtgaagcgaacgtttacaagtttgttccaaatcccaaatcgagtatcggaatgcatgcataatatggttgttaaaaactgttgggttagcgagttaattgagcaacgatagtggggaaggtaactttgttttgccagttccaatagaaaaacaccgatattgaaggaaaactggttcctatttataggctaaagcaaaagcagtagggtttggggtacaccttggtggaaggggaaccctatgaattgctaaacgaccgttgcacgacttaaaggccctgagggcctcaaaattagcagccaaagatttaacaacaattggttacatccaccttccaataaagttgggaggaagccga

SEQ ID NO: 583339 - DNA, 953 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaacgcgcaaggctctttccaattcagaaccggccaagtgcacgggcttttacatctggaatcagctatgacatga

SEQ ID NO: 583340 - DNA, 1379 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctgcctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcacagcagattcttcacgcccagtatctacctcactgtggaccccccaagccaagctcccaacctttcagcagcttctacacacctagctcctgccacccagtggcctctttaggccaagctcatgcttcacaagggcctttccaggcccaacttttgtctcatggcaaccttcctggccagattcctgcct

SEQ ID NO: 583341 - DNA, 243 bp, Homo sapiens
acccgtagggccctataaactggatgaccactgtcaaatgaaattaaggctgttgaggcagaaatgatttgataaaagtttattggaagccaaatgtgaggatgaacccagggaaacacaccaacaaagttgagagtgttctggagtctgttacaagttgggaagttagaagacaggagggggactcttcatacaggagttgtcctttttcactggagggtacaatacaaaggttacatatta

SEQ ID NO: 583342 - DNA, 808 bp, Homo sapiens
  misc_feature (808)..(808): n is a, c, g, or t
catggtcggtgtcgagttcctgctcctaatctgttagactgctacttcgtgatgttgccatctgccatcgcatcgtaggccctgctggtgtccatgattgcgtgagtagccttgccttgggtagcatctatctcgtcatggtcgaccttgcgcatcccatgcctcgcatgcgacacgagtagtcggtcctcgtacgtggcaccatccgtggcacgcgattatgattcgcttccatgccattctgccctgcatcgagttggtcctttaccgtcgttgctgcctccgcggcactgtgccttgaggtttgtctctgtgagagcctcgcatgaggtgctcttccgtgtagcataggtctcgcctgcgatggcctcccctacgcgggccacgcctcattacacaactccctggcagcctaggtctcgactgcacatggcccggaggtatgacttggcgtggcattgacgcctatggcctccgattcggcccttggcaccactttgcccaggggcattgtctgttggaccctttgttgtccgagacctgtaggttccgctagggcctgaggttgcgctctcgttggctcctgggtcccctcggtgcgctccttctggtctatctccactactctcttgcttcggcggaacgtggctgcgtggaatccctacccttgctgttgttccactgctaactgtgctagtccactggtgaccccgtgcggaagcatagctcctcgcctttggtagtttcctcccatgtcccccactagctccgggggttttctcgaagctgttctttggagccccttagn

SEQ ID NO: 583343 - DNA, 204 bp, Homo sapiens
gcacgaggcgagagcatgaccgatggattccagttcgagtatggcggtcagggctccgaccctgtcgatgtggccattcagctgaccttcctgcgcctgatgtccaccgaggccttccagaacatcacctaccactgtaagaacagtgtggcctacatggaccaccagactggcaaccttaagaaggccctgctcctccagggc

SEQ ID NO: 583344 - DNA, 276 bp, Homo sapiens
atagattagtgtctgctcaaacaactgggtacctgcctagccacactgacataaaactcaccatcaccgtccatccttggtcagctggacatctccctaaactatacttcgtttccacataaagacagaagcaaagtcatacttctgcctaatatgatacaacaagcctgactacaccaagcagtgcatgcgcccttccccagaacaggcatcagagtcttggcaggggtgcttcgtcttcgtctagatctcttgtaacttcaaatactatcatca

SEQ ID NO: 583345 - DNA, 264 bp, Homo sapiens
gctggcttcttgatggcagactgagctggaactggcttggtccatcaccccaggagtaatggctggcttaacagcccacagcaaattctgtggttcactggaccgagcagcatgttccaggacagctgtggggtcagttggggccatctttggactcagcctgagtgtcagctgtctcatgcccacatcctggcactcacaggagccagtaaaactctctccaggccagtggctgcgaccctgtctcctaaactcagaaagcca

SEQ ID NO: 583346 - DNA, 996 bp, Homo sapiens
aactcttgacctgcttatctgattctcggagatccatgtgcccagttccccctagacgagatcataggctacctaatccctaatacctcatgtatgcaccgcattgtggttacttcttggagaggtttggacgtttatagcgtatgtgatgctttaagacagagattataacgacgacatggcatagggggcaagacactgttgggatgttcttgaaagctactacgatggcttacggtcaattagagacatgcaaagatgtttgtcgaagtcgactctgtatggattgtggtgtgaagagatctggaaggaagaccaatatagcaagagtattccaggaaataagtagaaccttgaaataacgcgtattgaggggattggatgagaagtttaggtgagctgaacttgagggtggatatacgtgagtgtgatgggaaactgtgtagatggtacatgcatcagtggtgtatgggcaatattctatcggacaagtccaggattcgagagatcttgagattttcttccgagcaataccagaacagcaatccaagtgaagactgtgttatgacacggaagatgaacacttggaggaagaagacaagaagagagtgtgagacgtggaaatgcaaatgaaaacatgatcatcatgctacacgcagtggtgtgcataacccgtgggcgaacgcatgatttcaggtgcgcttagcaccagtcttatagtacaccacaccggggtcacaactggagcgaaccagttgcagactggggcagcagcaggatgttgcacattcgtttgaggcggggcaagagaactagaaatgaccctcccaaatgcaaaagcggggggaaaacggggtcacaccccagaaacgggaacccagtgctagccacgcagacacaggcttcggcaagaagggcacgggcaacaacccgccgcgaggacaccacaacaacgactagtgcataacgataaacaagaaaggaacaatacagaaa

SEQ ID NO: 583347 - DNA, 864 bp, Homo sapiens
gctatatcatgcgttgggtcgcgcggccccagatgcgtcgatgaccttgggcgtcgctgtgggcctaggactagtcctggtcctgactcaggtgctggcgcatagcttcgatcaatataggaataccgacccggcggaaaaacgacgaccgttactgcacgctagaatgcgcatgatgagtacgcgggctgactgtctcgacggggatcgatctactggaggccgagccactgtcgatatggatctcacggccccgatcggtatttgcatggagtacttgccaataatttgactggctggagaactgtcttggcatgtagaggacgatatatccttttttgatgtccagtttatttctggcatctgtggcagccctgagtgccatgatctctctagaaattccgcaagtcaaccatcatgaccaaaaatggatctgctgagtaaaaaacgcaaccccagggaactggagaaattcttagatccagaccatgtattctttattacgaagattctacaagtgacttacgaagcaaaacaattcacgacaactgactaaaagttattatgtgggactgatgtgatgactacagcaatggttcgaatttgtaccttacgatcagtcagatgaacggaaagcatgaagcatggtattggcagcattatgcattggccattcactatgggggagacctagaatttaacgaacccaagggacgtgcaagcagcagtcttccctcatatggttggcgaactctttcaacatgccgggtgcatggagcggttcctaaaggaaccctttaagaagtggggcaaaccagaggaatcttctcctcagggggcaggcaacgctttttcgcgcacacg

SEQ ID NO: 583348 - DNA, 141 bp, Homo sapiens
agagtatagtctgagaagcagaatgaggtctgagagctcatgcaggaatgaataacttctggatcctttgggatatagtgattcttcaaactcctggtaggtgtcaatggccagctaggtgcccccgtcatgatctctgga

SEQ ID NO: 583349 - DNA, 603 bp, Homo sapiens
agcccagcacgtgtttgagtaacttagtcatctcggggctatatccatttggacaagcacataccatccaggaagagacagcggagtgggggcttgggagtgaactggagctgtggaaagggctgccatgggcatcggagctactaattcaccagcaacactgccactcagggacaaggtttaacctgtagattgctctacaagtttgtagttcttgcattcaacagatatttgtagagtatcctcagagtgctgggcattttgtctcaggctggggacaccaggttaaacagaacagatcccgaacccaagagagagagagctcgtcaagtccataggcagttaaaatgtggcatggcgcaggggagggagtgctgggggagatggagcacaggggagtttgcagacagtgaaacgattccgtatgacactgtgatggtgggcgtgtgatgaagaacttgacagcacaaagaattgacctaatgtatgcaaattgagaaaaaaatttaggaggtcaagtgatcctagcaggaaatgcagaatgtgacagtaatcgaaatgtattacaggtcctccctgaagtgggtaggggaatacaaaata

SEQ ID NO: 583350 - DNA, 886 bp, Homo sapiens
  misc_feature (886)..(886): n is a, c, g, or t
taatgcttgatgataaaagaatcaaactttttttttttggaaagtggagtctcgctctgtcacccaaaactggagtgcagtggtgtgatcactgctcaggtgcaacctctgcctcccaggatcaagcaattctgactcagcctcccaagtagctgggattacaggtgcaggccaccatgcccggctaattttttggtattttagtagagacggggtttcaccatgctggccaggctggtctcaaacacctgaccttgtgatccgtccgcctgggcctcccaaagtgctgggattacaggcgtgagccaccggcttggccaaaacaacattttacgtagaagatccaggtttcagtgcagcttctgccgttaactaggttaataattcacaaccttggggccacagtggccttatatgtaacatgaaagtgttaccacataacaatagttaactttccttatttttccctgtggtggctgccctgtggaaacagtttagaatattgtccgtgtgtaggaccctagtgtgttcagtttcctggtgtccccagtgatagtgatgcctgataaattcaggggcacttactcattctacaggagattgactttacagcatcagattttctgtccattccggcttgctggtagaggagtttgcgaaaaaactgatcttagacgtaattttagttccgaaggcataaccaaatacgatgttcttctacacaagcgtacctgtgactccttggggcaccccggtaaactctcgtgagaccgttgtaatgcgtgacagaaactctgcagggctacaacacgagagtatatgatgaggtgctgaaacaaaaaacgtcttttcgcgagcggttatgcatttatctcctgtctgtggn

SEQ ID NO: 583351 - DNA, 490 bp, Homo sapiens
ggttttaaaaaagggggaaaaaaaagggggggatgggggggccacccaaataaaaagagtttttttttttgggaaaaaaaattttttttaaaggtttgtcccaaaaaaaaaaaaggggggccccggttttttgtgttttttaaaagggccaggggggggggttttttttttgggaaattttttttggggggggaaaaagggaaaacccccctgggtttgggccccccttttttaaaccaaggggcccctttaaaaaaatttttaaaaaatcccccctttcaaaaccaaaaaaaaggccccggggctttggggcctttaaaaaaaaccccggcccccctttttttcccccccccaaggggggttttggggggcccccccccgggggggggccccgggcccccccccttttttcccctggttttaggggcccttccccccccttttttttttcccaaaaaaaaaaaaaaagggggggtttttcccccgggga

SEQ ID NO: 583352 - DNA, 260 bp, Homo sapiens
agtcatcgctcaaaaagtcaaggccggtgtggtgaacggcacgggggcgccgggccagagccctggggctggccgggcctgcgagagctgttacaccacacagtcttaccagtggtattcttggggtccccgctgctccgggctgggaggccgtggggactcatgttactgcggtttggtcctggcctctctccatctaaccgggttggcattttcaagccaccatatttcttccaatatgtccaacaagatgcgcagag

SEQ ID NO: 583353 - DNA, 309 bp, Homo sapiens
tagaggatccccgttaacaggctgatgcaggagaatcacttgaactgagaggcagaggttgcagttagctgagaccatgccattgcactccagcctgggcggcagagcgagactctgtctcaaaaaaaaaaaaaaaagaaaagtaccagtcctacggaaatattaagaaaccaaaaaatccaccttttggaggtgtacaatggagtgattttcgggtatagttcacatattctgtgcagactatccacacccttctaactcgcaggaacattttccttcaccccgcgaggagaaacctcgcttaaccaa

SEQ ID NO: 583354 - DNA, 1528 bp, Homo sapiens
  misc_feature (1)..(1): n is a, c, g, or t
  misc_feature (134)..(134): n is a, c, g, or t
  misc_feature (170)..(170): n is a, c, g, or t
nggcccggcgggtattgtatgccgtcggagtgatgtgttcgcgccccgccactccttcgtgtatggagccacccagcctctgtgtttttgatgcaccccccccgcgcgtgtggtggtggtttggttgttaatanaagggcgaggttctctcctcccatcttcacaggggnggggtatgtatagaatgagtggcttgcccccccctcctttctttttggggggggccacccccacttgtttttatgaagtgctgccgccgctgcatgttagggggtggggccacactcatatatcaccccccttcgtattggtggttggcgctcggcgtgggaatcaagcattgtgtttgtccgccaccgcgaaggcttgtttttctctacgtcggagggaggccgccctctctttgttgtgtgggcggctgcctctcttctccgcgcccgccacgattttgtttgttgttgctcgccgccgccccgcctggggttgcgggcgcgatatatgatatatatgttggttcccgccgtccgttctttcttcttctcccccctctgtgaaggtgtgttccccccccccgtctggtgggtggtgttctgacgaacgaacaccactgccgttgtgatatcccgtccccctctctgatatgaggggaagtctcttctcccccccctctctagggggagatataaagagagagaataaaaagtttttatgagagatatttatattgaccccactctcgcggagtgtctccacacaaagtgtgatgtctgtcgcgacaccacacaacatttgggggggagacacccccgccccctctcgggtgacaccaccgcgcgtatatatgtctcttcgcgggggtgatccccccctccccgcgcgtgttgtgtctccccccctctccaatatctgtatatgtgttcctctccacacatatatgtgtgtctctctccacgcctcttgtgttatatgtgatgcgaaagagtgtgagagagacttctttgtctcacgcgctgtgtctccacgcgcggtatattcttgtgagtgtgtatacaacaatgagagagagatagtccccccctcacacactctatagagagagtggttttttatagacaccctcacacacacacacatctgtggggtgtttgttgtgtacaccccccagagagagttgttacacacactctctcttgtgaccgcagtggaggagagccgacaagaaatacactgtgtgcacacactgtgtgtgtgctgtgcgagagagagagtctgtgtacacacactctgtgtgtcccccacacactgtgtgtattttccctcttccccgtgtgggccacaagtgagagtgtgaaaaagtagtttaaaacaccctttgtgtgtatttttatttcctctcttttgtgtggttccgcgcttaaaacccgcgggtgtgtaaacccccacatttgtagtgtttctcccccccgcgggggtttttttataaaggtgtccctttttttttaaaaacatgtgtgtgagaaaatttata

SEQ ID NO: 583355 - DNA, 838 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctagcggcacccgggcgagctcgattta

SEQ ID NO: 583356 - DNA, 147 bp, Homo sapiens
gaagaggtcatctggggtcccttatctggtctctgacttgagtcctctacatcaggtatggtgaaagtaaagtcctcactagtaccactccttatctgtgctctgagctgagcgggggagccagacggccccctgacgagcaggacc

SEQ ID NO: 583357 - DNA, 147 bp, Homo sapiens
  misc_feature (112)..(112): n is a, c, g, or t
  misc_feature (138)..(138): n is a, c, g, or t
attgtgggttgctgggcggcccggtctcggagaagaggggagagtggcgggccgctgtataagcttccaaaaagaagacccgtcggttagccttttttaagaggggactganagctcccaaggcatccccccccttgngagtaacat

SEQ ID NO: 583358 - DNA, 946 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctgcctcactgtggaccccccaagccaagctcccaactttcagcagcttctacacacccagctccaaagcctgatagggtaccgagctc

SEQ ID NO: 583359 - DNA, 397 bp, Homo sapiens
taaaggggtgcccacacaaaaaaaaaaagggtttggggggggaaaaggacaaactcccatccgtggccgggacgggaggggccttcaaagggggcctaaaaaaagggtggggaaaaacgggcccaaaaaaggggaggggggggatgtgaaaaccctttttttaaagtccgggcgtgttttgggaaaccctaaggtttcttttttttcccctgggcgggcgggggatttctttaaggggggggttaactcaccacctttgggaggggggtttatttaaaaaggccctgggcttttaagccccaaaggggtgggaaaaaaccagcgccggtgtacaattaaactgggagggcccttttggccttatgacttttctaaccggaccccggggggggccccg

SEQ ID NO: 583360 - DNA, 484 bp, Homo sapiens
cccgggccaagtcttcctccaaattgggtttctaaggtccgccccgccatggagtaggggggcccttctgctaccccactttcacctgcgcttggggaccctgagaacacccccggggtgttcacggactcccgtgacatcattcagcgcatgcccctttgtcagtcggagttgctctaagaaggggacccccaaatttaattaaagccttaagcccaattaattaaaagggaaagggaattggccaagcggttaatccccccccatagggcatgattaacaaagcaacctttcccttcccccggggggttttgggaaacccccttttcccttcagctgggttagatgttccaaatttagaaagcttaagggggcctccagaaaaaggaaaaaaggccccaaaagttccctctccctttcgggaaaaataaataaacccgccgccgccacccaataaaatgaaataaaaggacccaatggaata

SEQ ID NO: 583361 - DNA, 2502 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (817)..(817): n is a, c, g, or t
  misc_feature (1041)..(1041): n is a, c, g, or t
  misc_feature (1196)..(1196): n is a, c, g, or t
  misc_feature (2358)..(2358): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagcctcctgcctcccgaaggcctgcacaggcccagcctctgcctcacagcggactctccangcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccggcggcctctccgggcccagaacctcctcaagtcggcctctccagacccacttgcaccctccgggcgtnctctccgggcccagctcttcttcctggttgcgtctccaggcccgactcctgcctcccaacaacgtctttggactcagctcctgcccagctcccagcggccctggtaggcccacaacttccctaagccaagctccccaggcccagctcaggcctcncggtggcctctccaggctcagctcctggccctccgatgacatctgcaggccccaaatggcctccggtcggtgggctcctctaggcccagcttgggcctcccggcggcctctgcaggcccaaatcgtcccgaagtcagtctctccaggcttagctccagcctcccggcggcctctgcaggcccaagtcgtcctcaagtcggcctggaagtgggcctggaagagcagcaagtcggcctccccgggcccagctccgtcctctcggcggcctctccaggtgcaaaacttcctcgagtcagcctctccaggcccagctcctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgcccatgatcaacgtgttctcttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtngcgtgcacctgtaatcctagctacccggaaggctgaggcaggagaatggcgtgaacccggtgggaagagtttgcagtgagccaagatcgcaccactgcactccagcctgggcgacagagcaagactcggtctcaaaaaaaaaaa

SEQ ID NO: 583362 - DNA, 1487 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (817)..(817): n is a, c, g, or t
  misc_feature (1041)..(1041): n is a, c, g, or t
  misc_feature (1196)..(1196): n is a, c, g, or t
  misc_feature (1450)..(1450): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagcctcctgcctcccgaaggcctgcacaggcccagcctctgcctcacagcggactctccangcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccggcggcctctccgggcccagaacctcctcaagtcggcctctccagacccacttgcaccctccgggcgtnctctccgggcccagctcttcttcctggttgcgtctccaggcccgactcctgcctcccaacaacgtctttggactcagctcctgcccagctcccagcggccctggtaggcccacaacttccctaagccaagctccccaggcccagctcaggcctcncggtggcctctccaggctcagctcctggccctccgatgacatctgcaggccccaaatggcctccggtcggtgggctcctctaggcccagcttgggcctcccggcggcctctgcaggcccaaatcgtcccgaagtcagtctctccaggcttagctccagcctcccggcggcctctgcaggcccaagtcgtcctcaagtcggcctggaagtgggcctggaagagcagcaagtcggcctccccgggcccagctccanctctcgcgcccctccttgtcctcatacatccgtaata

SEQ ID NO: 583363 - DNA, 1493 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (817)..(817): n is a, c, g, or t
  misc_feature (1041)..(1041): n is a, c, g, or t
  misc_feature (1196)..(1196): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagcctcctgcctcccgaaggcctgcacaggcccagcctctgcctcacagcggactctccangcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccggcggcctctccgggcccagaacctcctcaagtcggcctctccagacccacttgcaccctccgggcgtnctctccgggcccagctcttcttcctggttgcgtctccaggcccgactcctgcctctcaacaacctctttggactcagtgcctacccatctcctggcggccctggtaggcccacaacttccctaagccaagctccccaggcccagctcaggcctcncggtggcctctccaggctcagctcctggccctccgatgacatctgcaggccccaaatggcctccggtcggtgggctcctctaggcccagcttgggcctcccggcggcctctgcaggcccaaatcgtcccgaagtcagtctctccaggccctgcctcccagcaagtaagcaagctcttttggctcaactcctgcccagctcccaaccgcctttgtaggccccgaactttctccagccaagctctgagggcccacctcctgccttctggtggcctgtacagttctagcactggttggag

SEQ ID NO: 583364 - DNA, 425 bp, Homo sapiens
acagagtgacaccctgtctcaagagatagtaataatttttatatttgggggataattttagatttatggaaaagtgcaaagatagtccagagaattcccatataccccttccccagcttcccctaatgttaacatctcacaataccatggcacatttgtcaaaactaagaaaccagcatcagtagatcattattaactaaaccctgggctttatttggatttcattggtctgtctactaatgtagtttttctgttttaggatctcgttcaggatgccatatggtattttgtcattagttattatgtctccttagtctcccctggtcaatgacagtttctcaatctgtttctgtttttcatgaccttgacagtttcaaggagtagcggtcagatatttcgtagaatatccctcaatttggatttgt

SEQ ID NO: 583365 - DNA, 783 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcacggtctccctctgttgccaaggctggagtgtagtagtgctatgctttatgctcatctgtgtggctgg

SEQ ID NO: 583366 - DNA, 837 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (787)..(787): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcacaacgtcggtggggtttgttctttgggaatgagggaataaaaactttcatgggggtgcaagctcgggaatnagggtgggttcccctctttgcaaagttcaataagctgttatgcccagggg

SEQ ID NO: 583367 - DNA, 895 bp, Homo sapiens
gggtgcgcatgcccgtgaggctgccgcgggcccagacatgtccgtccttgtagagttaaaagcttccattggaagccttgcttcctaatcaaagatgcaaattaatacggattccggaactgagagactgaaaaacagcgtctctatctcaaaagatacccaagtgctggtcattgacgagctatgagaaaattcagatcgcatggggaactcacacggtctgagtgcagttgatacgcctttccaagccaggcagtgaatctctttgggaacccattaacctttgctattcctccatcaagattggatcaaccttcccaccctgaggctccccaaaggctttgaacagttcttcagtgatccttacagaaagacacccctctccaaacaaaacgcagcatttatatacagtccatttggctctctaggaaacaccagaattatcagtgaagaatatattaaatggctcacgggctacctgtaaaggcatatttctatggctgtgagagtaaactcctagaaccagttcctgttctgtaacaagatgttcctttagagtcaatgagaaacacaacacaagctacaaagttcatgcgggggaacatcctggaagttctctgagaaaacgaagaaacctgaagatgccttctgtgtgtgggaataccaatgattgatctttacccaagagactcgtggaactttgtctttgaacaggcctccttgacagatgggtgtggggattatccggcttggccaggattgcgcgattataggcaggaactattagggaaggtaaaaactcagaaactctccgtgcatattcatttcgcacctttttccaaaacgtgttcaactcaccggtattacctgaggcctttgggaacccggggtccaa

SEQ ID NO: 583368 - DNA, 155 bp, Homo sapiens
gggcaggcacaagtgcgaggcgtaatgtggcggacagttgagagcctacctggaggggcacgtgcgtggagtggctccgcagatacctggaggacgggaaggagacgctgcagcgcagggacgccccccaaaaacgcatatgactacaccacgct

SEQ ID NO: 583369 - DNA, 1193 bp, Homo sapiens
gctggactgtagtggcatgatcatgcctcactgcagccttgacctcccaggctcaaacttccgcattccgaatagctgggactacaagtgtgcaccaccacccccagctaacttttttcttcttttggatggagacagggtctcactgtgttgtccagaccggtctctagctcctggccttaagcaatcctcctgcattagcttctcaaattgctggaatttcaggcatgagccaccatgcctggcctgggctagtcctatattctctagagttctctttactttgtgctagccaatctctcattatgctgttcacctgttataatgaataattctctgtattaaattttaccactttaaacttttgagtggtttatgcttcctgattggactctgactaatatgttaggaagggtcccaggagataaacccacacagatgggatttgggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatctaggttgcgctgtccttatgagagtctaatacctattgatctgtcactttctcccatcacgctcaggtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatgccccttttccagagcttgagatcctctagagtaa

SEQ ID NO: 583370 - DNA, 94 bp, Homo sapiens
aattcaagcttctaacgatgtacggggacatgtgaagaggcatcgtggacttttttctactcaattccagccaatgttgaaaagaaaaaaaaaa

SEQ ID NO: 583371 - DNA, 281 bp, Homo sapiens
gtcaccgatgctcgagtgcaggagtatgatcacggctcagggcagattcaacctctcaggctcaagtgatcttcccaactcagggctctcaagtagttgggagcgcaggtgcacaccatcatgcgtggctgtttgaagaatacttggtcgagttggggtctatgttgcctaggctgttctcatactcttgaactcaaacaatcgttccatctcagcctcccaaagtgctgagattacagatgtgagccaccacaccatgattgtattcctgggtaagcctt

SEQ ID NO: 583372 - DNA, 664 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (425)..(425): n is a, c, g, or t
  misc_feature (459)..(459): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatncagttgcaggaaaacaagcttaacacgcccactnattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcactcgcgagtagagggatcctctataacaccgcacac

SEQ ID NO: 583373 - DNA, 859 bp, Homo sapiens
  misc_feature (47)..(47): n is a, c, g, or t
  misc_feature (107)..(108): n is a, c, g, or t
  misc_feature (125)..(125): n is a, c, g, or t
  misc_feature (133)..(133): n is a, c, g, or t
  misc_feature (137)..(137): n is a, c, g, or t
  misc_feature (154)..(154): n is a, c, g, or t
  misc_feature (284)..(285): n is a, c, g, or t
  misc_feature (290)..(290): n is a, c, g, or t
  misc_feature (293)..(293): n is a, c, g, or t
  misc_feature (299)..(299): n is a, c, g, or t
  misc_feature (311)..(311): n is a, c, g, or t
  misc_feature (331)..(331): n is a, c, g, or t
  misc_feature (339)..(339): n is a, c, g, or t
  misc_feature (342)..(342): n is a, c, g, or t
  misc_feature (352)..(352): n is a, c, g, or t
  misc_feature (354)..(354): n is a, c, g, or t
  misc_feature (358)..(358): n is a, c, g, or t
  misc_feature (364)..(364): n is a, c, g, or t
  misc_feature (477)..(477): n is a, c, g, or t
  misc_feature (525)..(525): n is a, c, g, or t
  misc_feature (555)..(555): n is a, c, g, or t
  misc_feature (643)..(643): n is a, c, g, or t
  misc_feature (651)..(651): n is a, c, g, or t
  misc_feature (683)..(683): n is a, c, g, or t
  misc_feature (688)..(688): n is a, c, g, or t
  misc_feature (690)..(690): n is a, c, g, or t
  misc_feature (704)..(704): n is a, c, g, or t
  misc_feature (706)..(706): n is a, c, g, or t
  misc_feature (713)..(714): n is a, c, g, or t
  misc_feature (718)..(718): n is a, c, g, or t
  misc_feature (720)..(720): n is a, c, g, or t
  misc_feature (723)..(723): n is a, c, g, or t
  misc_feature (745)..(745): n is a, c, g, or t
  misc_feature (749)..(749): n is a, c, g, or t
  misc_feature (758)..(758): n is a, c, g, or t
  misc_feature (773)..(774): n is a, c, g, or t
  misc_feature (777)..(777): n is a, c, g, or t
  misc_feature (782)..(783): n is a, c, g, or t
  misc_feature (788)..(788): n is a, c, g, or t
  misc_feature (791)..(791): n is a, c, g, or t
  misc_feature (818)..(818): n is a, c, g, or t
aaagtgcatgatttttaaatctttttaaacaaataactatgaaaaangtattcaagaaaataaaatacaaatgggaaatttaactagattgcttcttctaattaatnntaagcttttattaagtntagaaaanaaanaaaaaaaaacctttgangtgttactaaaatgctaactgagaatcattttagcataaatctagccacatgcatttcaaggttccactgctacgaattttgttaagatcagctgaatcatgaataacactatataatagagtataaggnncacangcnttagangtgatccttgcnccatacccttagattatgtnagactaangcnggcaattctncnaggntctgancccctagtgcccccaacccaaatcttggaagcaaagaatatgccctgtcatacaactttgtacaagttgtagtaaaacaaagcttaagttttctcatctttctacagcaaatngtcagttatttaataaacactaaaatgctcctaagaatccattttgantttgtttaccaaacacattgtgccaagcanctgcactacacaaaaagcttcctttgcaaatttgcgctccacaaattcacttaaggctggcaaatttaaaacttgcaagcacaaagcnccagcgcnctatccctaaatcctaaaatgctgcgcattantagcncncatatataagcgcnantaaaaanntttncntanagcaggcacaaaatataaaagngctnttatttttncaattaaaaaaaaannctncatanncttgnttngctcgcacaataaataaggcgcagctnaaaatgcaattaaatgctataataatgcgcaaaaaaaaaag

SEQ ID NO: 583374 - DNA, 638 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacctgcaggacaagttcgagcatcttaaaatgattcaacaggaggagataaggaagctcgaggaagagaaaaaacaactggaaggagaaatcatagatttttataaaatgaaagctgcctctgaagccctgcagactcagctgagccccgatacaaagaaagacaaacatcctgatccatatgaattcctcttattaagaaaaataaagcatccaggattcaatga

SEQ ID NO: 583375 - DNA, 221 bp, Homo sapiens
ttcaacttttttttggattttcggtcttgcaagcctcccccggcctttttcccctgccagttccctgggggcaggtaccagctttcctgaatggatttccggccccacccccccccccccccccccctttcaatccgtttgaaaccctttgggtccttttttggcagaacagtccctggccctgtaaagttttttagatcaataaaggcaggggctttcca

SEQ ID NO: 583376 - DNA, 93 bp, Homo sapiens
tggggcaatttttttaacctgctttttttcccccctttaacagggtaggggatccatgtttccctttcaataaatatttttttcccccctcca

SEQ ID NO: 583377 - DNA, 441 bp, Homo sapiens
ccttagtgtttgggtatattcatttcaaagggagagagagaggtttttttctgttctgtctcatatgattgtgcacatacttgagactgttttgaatttgggggagggctaaaaccatcatagtacaggtaaggtgaggcaatagtaagtggtgagaactcctcaggaaatgagggtttcagaataataagaggtgttcgtgcttatctcaccctttgaatatgagcggtgagcattggggctggcaccaggaaccaacaaaggaaaatgtctttcctttggctcttaagttgtggagagtgcaacagtagcataggaccctaccctttgggccaagtcaaagacattctgacatcttagtatttgcatattgttatgtatgtgaaagttacaaattgcctgaaagaaaatatgcatataataagtatcaacttctaaaat

SEQ ID NO: 583378 - DNA, 515 bp, Homo sapiens
  misc_feature (435)..(435): n is a, c, g, or t
  misc_feature (446)..(446): n is a, c, g, or t
  misc_feature (448)..(448): n is a, c, g, or t
  misc_feature (456)..(456): n is a, c, g, or t
cagggctgtgctctggctggtgggaaggagggagtgaaccgattccagttagagggccagcctccctgccaagtgggccacggtgactcatcaatatctggaggaacatctatcaaagaagagacatcatcaacggtgaagcaagcgttagatgtggttctggtttcagggctctcacctgagactttgtgaaaccagccagctgggtgattgctcacagagagtgaaggaggcgttaccaggtccctgcagacgtgtgaggcctgggacttccactctggctcagttgtctggggctgggagaagttcccctgcagcccagtgtggatccatctgtgagtggacagcctctgccacactagctctcttggggcaacccattcttggcacccccttcctcagtgccctagtggccactttcagggacactacaanttgtattgagncngttatggngtgtggagttttcggaaatcaactaaataaatatttggggagtctcctatgttaaaaaa

SEQ ID NO: 583379 - DNA, 388 bp, Homo sapiens
ggaacggaggtaagggacactcgccttcccatcggctgggggagagggctccacacacagcccggggatggggaatgggggatcccacacttctaacgcatccacaaagccggcagccctatcaggtgttgcggtgagactcccactcggaaggtgagacctcaggccggctcccctctccttacacctcccacagccccttcggccggggctcttagccgggggccttacctcattcttcagagaaaaaggaaggccttcaggatctttctcctctcccagtacccaaacagacaaatttcccggtcggggtactcaggtcctccttcaggcctaggaccccgatcccggttggccctccccttcgaggcttttctggtggccatca

SEQ ID NO: 583380 - DNA, 130 bp, Homo sapiens
atcatagcaggatcctatattgagacatcctggctatcacggtgataccccgtattaactaaaaatacaaaaaagttagccagtgcatggtggccaggcccctgttagtcccagctgactcgaggcaggt

SEQ ID NO: 583381 - DNA, 161 bp, Homo sapiens
tcccccccttttttaaaaaaaaaaaacccccgggggttgggttttcgggtttccccggccttttcccaaaaaaaccccccgctttttgggggcccaaactggggggaaccccctttggggtttttaaaaagggctttttaatttttttgggccccccccca

SEQ ID NO: 583382 - DNA, 998 bp, Homo sapiens
  misc_feature (29)..(29): n is a, c, g, or t
  misc_feature (70)..(71): n is a, c, g, or t
  misc_feature (90)..(90): n is a, c, g, or t
  misc_feature (117)..(117): n is a, c, g, or t
  misc_feature (181)..(181): n is a, c, g, or t
  misc_feature (183)..(183): n is a, c, g, or t
  misc_feature (232)..(232): n is a, c, g, or t
  misc_feature (509)..(509): n is a, c, g, or t
  misc_feature (513)..(513): n is a, c, g, or t
  misc_feature (541)..(541): n is a, c, g, or t
  misc_feature (554)..(554): n is a, c, g, or t
  misc_feature (571)..(577): n is a, c, g, or t
  misc_feature (599)..(599): n is a, c, g, or t
  misc_feature (621)..(621): n is a, c, g, or t
  misc_feature (636)..(636): n is a, c, g, or t
  misc_feature (641)..(641): n is a, c, g, or t
  misc_feature (643)..(644): n is a, c, g, or t
  misc_feature (659)..(660): n is a, c, g, or t
  misc_feature (662)..(663): n is a, c, g, or t
  misc_feature (677)..(677): n is a, c, g, or t
  misc_feature (769)..(769): n is a, c, g, or t
  misc_feature (781)..(781): n is a, c, g, or t
  misc_feature (790)..(790): n is a, c, g, or t
  misc_feature (795)..(795): n is a, c, g, or t
  misc_feature (986)..(986): n is a, c, g, or t
gtggatagacttaaagtttggatactcgncgtcaatctatgatgtttgcactcctgaaagtttactgtgnnacgtatataccccatgctntgttgcaactgcagagagggcctgatntctatcagctagagatcaaccttcgaattcaggagatagatctccactaaacatcagcatcgtntntgctattttaaagacaaacagaacaagcctactggtttgccctggaagnatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaaccaaaaacttcggaacagtcagaccagcccacctcagcttgctgtctcaatcacaatgganacanattcgcatacgctcccagctacgactgntcaaaggaacatnaaactaacaaaccccannnnnnnaatcacactcccctgcccaacncacccgaagagcaaaagcccangaaaaagaagtagtngctgnanncccccccccacccanncnnccccccccccactntgcctcatctctgtacgaatttgggtcccagccctgttgggttgccacccatggacatggatttcaacccctggagaaaacgatgtcattgntcagcagctganaccccaggngtcgncgggggacttgccgtttctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcngattgcaaagag

SEQ ID NO: 583383 - DNA, 506 bp, Homo sapiens
  misc_feature (8)..(8): n is a, c, g, or t
cattttcngtggtcccccaaaaaatataattggcttcgcccccggaggttgtttttttacccccgggggtaaacccctttttgttttttttttccgcgggggggccctattagcgccgcccctcttttttttccttgtttctgtgggggtggggaccaaacccggtgggtaaaatttttgggggggcgggggtgtgtccccccttttttttccccctttttttgggtagtttgtgcgggtctcccggggttgggggtatgggtcgaggttggggtgaaacggccaagactggccattttcttttaaataaaaaaacgccatttgggggggggggggtcgctttttcgcttcccggggggggttaggcgggttttttttttttattccccgagatgatgtttctgcaggggcgtttgccgcctgggtccatcccgtggggggtaaaaggggagcccctcccctcggaaagaaaaggattaaaaaagaaaaaaaaagtggagacaaag

SEQ ID NO: 583384 - DNA, 692 bp, Homo sapiens
  misc_feature (111)..(111): n is a, c, g, or t
  misc_feature (621)..(621): n is a, c, g, or t
caaaaaccgagtacgtggggcatttggggttccacaaagtggtttcacccaaaagaaaataggggtgtgattggggaaaatttttttcttttcttttctctcctctttttnttttttttgacaagggccagtgggggttttctgttcttttcggctatgcacatgaaaaatttaatgttttaaggaagcttgtacataaagcgtgcacaccacttttgttcttggtgtgtaaattaacttttataaactttaccttttttatacataaacaagaccacgtgtttaaaggcgacctttgtattctttcctggaccttttgaaccctgaactttgacctttgcagcaattaaacaacggttttaagaaacaatccaaggccattttttttaagaaaaaggaagcccaaagttggtacatttttaagggctgcaattaaaaaaaacaggtactcaagattttttaggttgaattaaattctggcaaggaaccccaccggtaattggtaatccaatgcgggcccctaaagggaattttttactaaaagaccatttattatggcacatcagcacgatttctgtttagataatacaccactacattctgttaatcattagggtgtgnctgaatttcttttgccgttattaaaaatctcaaatttctaaatctccaaaataaaactttttaaaataaaa

SEQ ID NO: 583385 - DNA, 184 bp, Homo sapiens
  misc_feature (113)..(113): n is a, c, g, or t
cgtgggcggacgcgtgggtttctgtttagataatacaccactaaattcagtcacacctaatgattaacagaatgtagtggtgtattatctaaacagaaatcgtgctgatgtgnctgaatttcttttgccgttattaaaaatctcaaatttctaaatctccaaaataaaactttttaaaataaaa

SEQ ID NO: 583386 - DNA, 560 bp, Homo sapiens
  misc_feature (84)..(84): n is a, c, g, or t
  misc_feature (136)..(136): n is a, c, g, or t
  misc_feature (161)..(162): n is a, c, g, or t
agacattttctgtcaggcaaattttcagaaagtctcctttgcacccttactgaggaagtatcttgaggaacattctccaaggcnaaaatgaggatgacaaacccaggcaacagcaagcacagcaaatgggatcccnataaagacagtggggaacctttacnnttaggataggtctcattcctagaagggtgaaacaagcgccaagaaaaaggggggtacatcgtcccaacgcgccataggaaagggtggacccaaggcgttaaattcccaggagccaaggtagccgtaacagtatttgccaaggggaacttgcaagggcaaggcccaaattaaacctctgtgctggcaatataccttgggtggggcggccattcattagttacccactttagggggggtaggcaacaagcggacacaaaactttgggttatggccgcaaaatttatctcccgataaatagggttgagtggccaccacaaaaattccaacgaccaattttcaccgggtctccaaatttccgcaagttagtcggggggaacgaacgggcaacggacctctgg

SEQ ID NO: 583387 - DNA, 201 bp, Homo sapiens
tgtgtatcatcatgatcatttgggtaggaatgccgaacataggatctagccgcttagtaaagtgtaggtatatgatacagcatggtgagccataggtactatgtagtatagtaatctccaaacttattgcataactgaaattttgtacgctctgaccatcccttccccatttccccccactcccgggatcttggcctcgtg

SEQ ID NO: 583388 - DNA, 348 bp, Homo sapiens
aatggctcaaagtgcagataatagtctaccagctgattaaacaaggtaaaacaagaagtaattagagctttatacaagtccaagtagtctactcttatatctacctcaaaattcaaataggcaccaactatttcatgcaagtaggtatcatatacgttaccctgggtttagaacaatataaatgcttgatctcacccctatttaagatgaggtgctgacttacggtgcctctgccaggtgagttttatgtttgcacaactccatcatcttgcatcatgatgcttctcaggccacatggatgaggtcaattgactttgaaaaacttgagtctccactctgggtcaacag

SEQ ID NO: 583389 - DNA, 1095 bp, Homo sapiens
agaaaaggaagaaaacacacaatagaaattccggaagcgagagagagaaggctgctgagcacaaggcgcaagtccttgggggtagtaaatctccagcagcctcatggggccaggaggccttgaggcagccaaagaggaagcagcattgggcttcctagctcagacagggaaccctgtcagtatggcactggcgcactgaggcctgagtctgtcttatgcatctggactgttctgcgagcagcgactgcatgagaagatccgaggaggcccaggggccagggacagtgccaaggagctgtcccctgccgccttggagaaaaggcggcggagaaagcaggaacgggaccggaagaagaggaagcgaacaggagctgtgggcgaacgacaaggccacggaacggctgaggaggccaatggaggcccaggaggctggtggcaggcaatcccagacgggggcctgcacggagccgcgggagccagcccgggctgatcttccataaggcggaggcgagcgtacgacgagtccggtctagcaaggcgcagcgcagaaaagagaagaggcagagggtgaaggggaacctcacgccgctagaccgcgaggaactaccggcagctgctggagcgcctgcacgcacggccagagcggctggacgagctgcgcggccccgatgacgcgcacggcgccagctaacccaaccacaccaccaccgggaaccgaacgacagcacagcgacagaagccgactcgacaccgagacgccaacaccgaccacacaccacacgcccaaagaaataacccaacccacagacgacagaacgacacacgcaaccccgcggtcgacaaccacgccggagagtccaacacgagacaccaacaaacgccacactcacaaacgactccctggccacagcaccacacgcgcgaccacacgacccaacaccatgcgcacaacctactgaccacgcggcgatcagcaacaagagcgaaacgccgacctctagcctcctcagtgacagccagcacgagacaatgacaacccgcgagagccgatacacaccgccctcccacacagcgaccgcaggagacgaccaccac

SEQ ID NO: 583390 - DNA, 826 bp, Homo sapiens
gctccaacacacaaacatagatggattgtctcaaaattaaaagtatctacctgggtataaagtgaaaggtacccttggcatttttgtcccagtgggcgaaagacaacatcttcgttgttatgttgttaaaaattgagctactttgtgttgtgccgggggtgttgggtcggcatcactgcctgtaatccacctgcctttagaactcccagaagtgctgggattaacatgtgccgtgaggccgacctgtgccttggcccaagaagctacgcatagtataatcaaggaaagcctatgggaaaaactaaacaggacattgagtggccaaaaatttgttacaattttctgagtatagatttactcatccaccatatgaagttcaagtcatgttataatttgcacttacagtgttataacaccataaatatcttacctgtaatcaaaataacctgggtggctaatatgattcggagaaagtaaacataggtgcctcttccggactgcacatctaagtaagagggaataccaagttagaaacagggctcttggacatctttgacctggacaggtacccaataaggtttgcatgttgataaataagaatggtgaagtaggtgtagagaatcacaacgaccttggccactatgggcagggttaatattaccctactcgtatgcttacatcttttccataacaagtaactacgtggaaggtaaatatataaggtaccaaagccaggtggactcaaacagggtgtacctaaccacaaagttaccacgataatgtgggatctaactcaaaccattgggtaacctcatgtttacaatac

SEQ ID NO: 583391 - DNA, 774 bp, Homo sapiens
  misc_feature (774)..(774): n is a, c, g, or t
ctccaggcatccagttggctccatcctcctggttgtgctctgcaccccgctgctcccttgggtctggccctggcgtgggggcctgagagacagagccaggaacccacaatcaggaggccaagcctggtctgcaggaggatagacagaggctcccagggccggtgccctgtgtgcccactgcatcaaaggaccgctgaataagcctggccttcagccccctaaagggctccattgcccaagtgccaacgtgctggggatttctgtcatgaagccctgtggcatccatgtgacagggtatttctagatggccaaacttagttagcctagaattagcgccatgttggaaacactgtctcagccagtcctgggctgcacagctgtgtagcccagtcctccaggtccacggagtggtgtggacctcaccacactcacaggcgtgcctctggtcaagccaagacctcttttcgcccggaccccagacccctctggttgataaaccggtgtggagcctcctcaggcagcggtggatgcctttccaccttgaatttccccagggctctcggcaacatcgataaaccagctcgcccaccagctgaggccctcccccaaccagtctggcaggcttgggagcttggagcttgcttgagtcttgaattgccttctagatggcttctctagaggctctcctggcaagagagggtccaaggggagccctgccaagcaaaggctcccttgtctggggcgggatagagaatctcgctctgtctggtgtgn

SEQ ID NO: 583392 - DNA, 397 bp, Homo sapiens
tctttccttcaagtagcggcgctcctgtggaggatcacagtcctgaggttcaggtggtaaaaaattggctccaggtcctcgtccatgcttccccccaaaaccccacacaacaccacccagtcaaaacgaagagacacgcgaaaagacaggcgagcacaaagcaaaggatacaatacaaacaacagctggggcgccggacagagcacaacgccgctccaccgagagcgcacaaagacaggaagccgggagctagaacacaggcgccgccatgtagtcaggcccatcggaaccacgaccgaccccccagcagaaacggcgtcgagcggctcgcctcagccgacgccgaccacgcacatccgccaggcaaaacacacgcgtgaacctgcaccgacgcgag

SEQ ID NO: 583393 - DNA, 147 bp, Homo sapiens
cttcgcacggtagatgcccagtgcccagcacttcagtgtgtctcgtggtcatagctgtgctggtgggtcgtatgtgtcttgggggcgtcgtgcgctgcggcgtctccttcccgttctccaggtatctgcggaggcgtaccaccagat

SEQ ID NO: 583394 - DNA, 397 bp, Homo sapiens
cacactatgatctcccagcacttagtgaaggcaaagcgtgtggagatcacgaggtcactgaagttcgagaccaggcaggccaccatggtgaaaccccatctccactaaaaatacaaaaatttagccgggcaaggtggcgcacacctgtagtcccagctactccggaggctgaggcaggagaattgcttgaagccgggaggcagaggttgcagtgagctgagatcacgctgctgcactccagcctggggacagagcgagactctgtctcaaaaaaaaaagtgttcagtgtactagtcctttttttcattcattgtatttacaacattttggtaggtttgaaaactttcaaaatcaaccattggaaaaatacatatttaaaatagaaaatgtgcgtgac

SEQ ID NO: 583395 - DNA, 465 bp, Homo sapiens
tggacagcagaagagagggtgagggtggaactgccaacctttgtaaagcagatctctatgaatacactccctcactatcatgagaacagcactgggggacaccgcccccatgtactactcacatcccattaggtccctccctcaacatgttggggattataattccaatgagatgtcggtggggacacacagccaaagcagtatcgaaagggtctcaaaaacttgtagaaaggcatcagggagagggagatcacctgaggggaagacagtagttataatagtgcaggatgtcgctggtggcttgtagcgaggggtatgcatctaaatcatgttcggtagagtctgaagaaacatttggttggctcgtcccatccaagtcctttgatatggacttatgaactgaggaatcatgacgcaatgaagatggctgggggtctacatctagcccaacatctaggggctagg

SEQ ID NO: 583396 - DNA, 235 bp, Homo sapiens
gtaagagctcactgtcagcctctgcctcccaggttcaaatgattttcctgcctcagcctctcgagtagctgggactacattgcatgtgccgagttatgcccagctaatttttctattttgagtagaaatggggtctcaccactggttctgacctcagagtgatccaccacctcgcgcctcccaacagtgctgaggattatagcacgttagcctcttattgcccaaggctggaagt

SEQ ID NO: 583397 - DNA, 851 bp, Homo sapiens
  misc_feature (236)..(236): n is a, c, g, or t
  misc_feature (251)..(251): n is a, c, g, or t
  misc_feature (768)..(768): n is a, c, g, or t
  misc_feature (823)..(823): n is a, c, g, or t
ctccgcgaatcggcggtgggtccggcagccgaatgcagccccgcagcgagcgcccggccggcaggacgcagagcccggagcacggcagcccggggcccgggcccgaggcgccgccgcctccaccgccgcagccgccggcccccgaggcagagcgcacgcggccccggcaggctcggcccgcagcccccatggagggagccgtgcagctgctgagccgcgagggccacagcgtggcnacaactccaagcggnactaccacgatgccttcgtggccatgagccgcatgcgccagcgcggcctcctgtgcgacatcgtcctgcacgtggctgccaaggagatccgtgcgcacaaagtggtgctggcctcctgcagcccctacttccacgccatgttcacaaatgagatgagcgagagccgccagacccacgtgacgctgcacgacatcgaccctcaggccttggaccagctggtgcagtttgcctacacggctgagattgtggtgggcgagggcaatgtgcagactctgctcccagccgccagtctcctgcagctgaatggcgtccgagacgcttgctgcaagtttctactgagtcagctcgacccctccaactgcctgggtatccggggctttgccgatgcccactcctgcagcgacctgctcaaggccgcccacaggtacgtgctgcagcacttcgtggacgtggccaagaccgaggagtttatgctgctgcccctgaaacaggttctggaactggtctctagcgacancttgaacgtgccttcagaggaggaggtctaccgagccgtcctgagctgggtgaanacgacgtggacgcccgcagcagcatgtc

SEQ ID NO: 583398 - DNA, 1005 bp, Homo sapiens
  misc_feature (236)..(236): n is a, c, g, or t
  misc_feature (251)..(251): n is a, c, g, or t
  misc_feature (922)..(922): n is a, c, g, or t
  misc_feature (977)..(977): n is a, c, g, or t
ctccgcgaatcggcggtgggtccggcagccgaatgcagccccgcagcgagcgcccggccggcaggacgcagagcccggagcacggcagcccggggcccgggcccgaggcgccgccgcctccaccgccgcagccgccggcccccgaggcagagcgcacgcggccccggcaggctcggcccgcagcccccatggagggagccgtgcagctgctgagccgcgagggccacagcgtggcnacaactccaagcggnactaccacgatgccttcgtggccatgagccgcatgcgccagcgcggcctcctgtgcgacatcgtcctgcacgtggctgccaaggagatccgtgcgcacaaagtggtgctggcctcctgcagcccctacttccacgccatgttcacaagcaagtacccgcctgggcggcgctgggggctccgtgggtccctcgggtcagctcgtgtaacccagctgtcccccgcagcatgagatgagcgagagccgccagacccacgtgacgctgcacgacatcgaccctcaggccttggaccagctggtgcagtttgcctacacggctgagattgtggtgggcgagggcaatgtgcaggtgagggctccctcacccggatcccggtgtcccccgaccctgtgcctccctcacctgcctctcggtgccccgtagactctgctcccagccgccagtctcctgcagctgaatggcgtccgagacgcttgctgcaagtttctactgagtcagctcgacccctccaactgcctgggtatccggggctttgccgatgcccactcctgcagcgacctgctcaaggccgcccacaggtacgtgctgcagcacttcgtggacgtggccaagaccgaggagtttatgctgctgcccctgaaacaggttctggaactggtctctagcgacancttgaacgtgccttcagaggaggaggtctaccgagccgtcctgagctgggtgaanacgacgtggacgcccgcagcagcatgtc

SEQ ID NO: 583399 - DNA, 390 bp, Homo sapiens
gggagaggttgatttgagctgagatgacactgcgactccagcctgggtgatagagtgagactcgtgtctcaaaaaacaaaagtaaaagagaaaaatagacaattaaaaatagaattaggcgggcatggtggggggcccctgtaatcccagctattcgggagggtgaggtgggaggatcgtttgagcccaggatttctgggcggttagtgcgctatggcgatcgggtgtcctgtagtaagttcgggatcagtatggtgacctcccggagagcgggggaccgccaggtagcctactattcgtaggcagtggtaatttcgcagacaggcctaagtgagggtctggcgaaatgtggagaacgacagaatctcacctaagttcagagccaggggg

SEQ ID NO: 583400 - DNA, 571 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (505)..(505): n is a, c, g, or t
  misc_feature (507)..(507): n is a, c, g, or t
  misc_feature (509)..(510): n is a, c, g, or t
  misc_feature (521)..(522): n is a, c, g, or t
  misc_feature (526)..(526): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaagacgcccactgattctacattatggctcctacctcccggcagcctctccaggcccanancnntctccagtcannctcnacagaccatgctcatgaggcggatatgctcatacgcgatgcatat

SEQ ID NO: 583401 - DNA, 168 bp, Homo sapiens
agtaagggatacgaggcaggtggaagggcttcaaccaggaacgcccgaaggtagaagaactggctgagcctccaaggatgagtctttttccagcaatggccagagcgggtgctggggggtgacctcgctcctctgtggcactgaccagagttcctcccaggcaggggg

SEQ ID NO: 583402 - DNA, 174 bp, Homo sapiens
gacgctgggacgacaagggattacaggtgtagcacgcgcctgggccatagcttgtcatctttatccctcaagtccctcaccaaacaagctaaagcagaaagataaaataatttgacaaaaaatgggttcgagaatatcacgttgctattcaacgattggtgcatgtcacaacgc

SEQ ID NO: 583403 - DNA, 135 bp, Homo sapiens
taccccattaacatttgcttgcctactagatacctttaaacaactgaatccaaagctctggaatactactggtagcacaaacaacttcgtatgtctgatacttacctttgctttctgttctgttcacactgttta

SEQ ID NO: 583404 - DNA, 384 bp, Homo sapiens
ttcctctttgaccttacagttacatgaactagtcagtttatagggctctgtgtctaaatttaaagttgaactaagcttctatcttggacactcagctggtacatagtcgggtgtgctcttatagctgtgcttaggtagctcgtctggtaactagggtcgtagcattggctctccgtgcacagttaggtctagagcatacagtatacacaaggtatacgggttagaccttgctatcctatgatgtgtaagaattattcatctttccccccggagcgtacatctatggcatcaggttgcaactacaatcgcttatacgtcatgtccgtacatggtgtctctaaggacgtctggtactaaggtggagtgggtcccgttccgaattcc

SEQ ID NO: 583405 - DNA, 175 bp, Homo sapiens
ggcaggttatcgcagagctgcggatgtagagagaaggcgtgctcgtttggccacaccgcggctccagtgtccagcagctccgtcaaggtccactgcatgaaactagatgaacggggagggcaccagagcgatggtgaacttcgcagttccttcacactacagttatcgtacaatt

SEQ ID NO: 583406 - DNA, 435 bp, Homo sapiens
  misc_feature (168)..(168): n is a, c, g, or t
  misc_feature (288)..(288): n is a, c, g, or t
tgagacggagcttagctctgtcaccaggctggagtgcagtggcgggatctcggctcactgcaacctctgcctcccaggttcaaatgattctcctgccacagcctcccgagtagctgggactataggcacgtgccactgcgcctagctaatttttgtatttttagtagncatggggtttcattatgttggccaggatggtctcgatctactgacctcgtgatccacctgcctccacctccgaaagtgttgggatcacaggcatgagcaccgcgcttggccagaagtggnattcttaaattcaagaaattgggatggggagtattcacacattttataacccagaaattcaagcaattctgggtgactacaaatgcattgttttggagaatagttgtaaggtggaaaaagaattaggaactcgacagatagtgagtt

SEQ ID NO: 583407 - DNA, 439 bp, Homo sapiens
  misc_feature (178)..(178): n is a, c, g, or t
aattcaccagccatttggtcttagtaaggtcattaccgcgctctaggtttgagtctcatttgtaaaatgaagggagtggaggggcttatagagctcgaaccctctgagtctaagaggctagaacacgtgcgatctatactccgcctaggaaaggaacatctaggtatgctcaaaaacnagtgagaagtattgcttagataacctctgggctacccaggcatcggcagcttgaccaccaatggagacaccaattcaggcatccctttcccttggttcaggccggaattgggggcaatctccgcattgattttaaccaagtccttcttccaagcaagacacttggcacattttacaagcccggggttggaactcaagccttgagccagccaacttggttaaccttactggaatccccccggtacagaccaattttcaaggt

SEQ ID NO: 583408 - DNA, 123 bp, Homo sapiens
tgagatcccctatcaggctgtgctatcctgtatcgcctcttgccgtaccactggcatcgtgatggactccggtaacggggtcacccacattgtgcccatctagcgaggggtatagccctcccc

SEQ ID NO: 583409 - DNA, 144 bp, Homo sapiens
ccttatgcgcctttgatgctcttgggctccccaactgcagcccccttctgcagccggtgctgcggctgtccccatcagtggagccctccagtactgtggtctccttggcagtggtgtggatgttcagccatgctattggtgacc

SEQ ID NO: 583410 - DNA, 434 bp, Homo sapiens
gggccaacagaactggcatacttaagaggtgagcaagaagcctgtaatcccagcacgttgggaggccgatacaggaggatctcccaaggccaggagttggagaccagcctgggcaacagagagacctggtctccacaaaaaatacaaaaattacccaggagtgtttgcatgcgcctgtggtcccagctactcgggaggccaaggtgggaggatcacttgaggcctggaatttgagactagcctgggcaacatggtgaaaccccatctctaaaaaaaagtttttaattagatgggcatggtagcatgcctgtagtcccagatactcaggaggctgaggtgggaggattacttgagcccaggatttgtaggctgcagtgagctggttgtgatgctgcactccagcctgggtgacatagcaagaatctgttcctcta

SEQ ID NO: 583411 - DNA, 200 bp, Homo sapiens
  misc_feature (145)..(145): n is a, c, g, or t
cagagactatcaggggccaggaggaatggacatggaaaggcgggaaacagcgctcatctgactgcctgcaggaccttcctttttcacatcctctctttacagatctcaagagaacagccagtctttcctgaaaccagaacctctntgctatgccagactccataacgcctgtagggaacaggattggaaactaggaaaac

SEQ ID NO: 583412 - DNA, 1065 bp, Homo sapiens
ggtccaggcccccaactgggttcccagggattagagaccatgctagccacatactcctgacggctgtaagcgaggtgcctggctcagcctggacgacctgctgcagctgattgcaccacaatcctcggcgcatctttcacctgcctccgcaggaggacacctatgtggaggtggatctggagcatgcgtggacaattacccagaccacatgcccttctccaatggcccactggacaccttttgaagggcagaaagtgaagggcaccgatccgcacgtgtggtcctgcgaggggaggttgcctatatcagatgggcaggttctggtaccccctgggctatggacaggatgtacgcgaagtggacacagagggtgctgtacctacaggctcccacacctcagcaccctgccactcgtgagatgaccacgacacctgaaagaccacagacgatggcatcacagggcttcctgatggccgcttccatctgccgacccgaatccatcgagccatccgacccaggtttgccagctgaggagccacaggagaagtcctactcggaagcgtaaccgagccagagctgatgggacaccatgcatggcacatgctaacctccaccaacagtaccgagcaaggcatctcccagaacctgcggacccatggcttgctgaaccgcaggaactcaaccctggtagaaagctatagatgggcaaattttcttgtcgtcagcagattaccaagggctcaaagcgacagcatgtcactgtggcacaacacactggtctatggtgcacgacgaacggagcacgaccatcctacagggcagggcagggcccagagaaagaagagaaacggcacagacgtcgctgcgagcccagaccgggggacgagccgcgccacgaccggacacaagacggcgagggcagcccgcgaaccgagacggaagaccgcaccccgccagccacagcccaacacaacgacaacgcagccgaagaggggagacacggcagcaaagaggaacccacgaagcacagcgaggacaagcagcccgaaggcacgaaccacccac

SEQ ID NO: 583413 - DNA, 259 bp, Homo sapiens
tctgcagaatcgctgtcaaccaccttaatgaccagtcttcagcttctcatagtttgacatcgattgggagtccttgctgctatcatcagaccctcccctgagcagactgtaggccacctcgatgttccagcaggttgtcaagcatttaccgccttggcctgcacactgtctgcattgttcaggagcggagcttcttcatcccaaagtcgtgggggatcaggtgtaaagcgatttgagagatcaggatctgagagtcgct

SEQ ID NO: 583414 - DNA, 921 bp, Homo sapiens
cataacaaggggctatccggctgaaaatcaggaatcttagtggatggtgatcagtgcaggataagttcgtgaaaatctacattaccttaacgtggagttcatcaagttcccacgtgagaatgtgctagaggtgcatatctacaggagaggtcattggatcttcggtaaagaatctcaatgggaagagttactccatgatggtgaacaatctcttgaaacccatctctgctggaaggcaacgctcaaactcagtcagagactgatacagtggcttatactgtgtcgaagaagacgagtggaaatacacaacggtgggattgaccgggaaccaggttgaataacgcgagtgccaagaaaatgagaagccctcctatgacactgaaacggattcctagtgagggatatgactgaatgttctaccgacagacttcctgaaagatggacgacgatgatcatgaagccgacagcattacataaagcctgggtggatagtcaaccagagacgcgtcgccaaaggcgacaccgaactctgagactacagcagtccgctagggaactgtgatgtgatgtcgccatacggatgtgaccagcaagggaatatcggagcccggcctctgtaagttcgacagactagctcttgaacatacgctacgaaggtaagggaacgactgcacccatgcctacggcgcaatccccccgaataaggccagctattaaacatcccgggcagagggactcagacccgggcaccggtcacggcgggcacggctccgccgggacacacaaaggagtgcccacaagccaccgggagccgcaccccagcccagggcggcgccggcaccccacagcaaccacacaccacccccacgccacacagcgcaaccaccgcccccgcacgcacaacacacactcagggccacc

SEQ ID NO: 583415 - DNA, 103 bp, Homo sapiens
tgacatcactgaggatgtggtcagcacagaggagggtgacgttagcattacccccaacctcattttagtcgcctaagcatttgcctggcctccttctgtgact

SEQ ID NO: 583416 - DNA, 1335 bp, Homo sapiens
ctagacgtggtggccccgcccttgtgggtggcgcatcgtggcggtggggtctccgtgggttcgcgggtttgagtcgccccgtcggtggcaaaacggtgggagaccctcgttggtttgtagctgttgaggtccccggtttttcccgcgcgtttggggggccccctcttctgtgtgtgtgttccgtccgcgtgtttttcaaccaggggcgttgtgctgtccccgcggggaggtttcgctggtggagcccccccgggggggcaagaagggggtccccagggggcgcctggtgaagacagagtgccgcccgggcagaaaccccgcgcgcccttagggggaacaagaaaagggggaaacggcccccaacgtcctcccccggggggaaaaaaaaaagaagaccgccccgagagttgtgggaagagacccccaagggtgagacccgcaacctaaaattttgaggggctaattgttggcccccttaggctccgttaaaggtaaagtgtgttttaagaggaaacccggcgcgttggacccaccccacactgtttttgtaaaaaaacgcacactggcgcgctcggggggcgttatagggaaaaaagtaaataagtttgcgcgcgtctttgtgttatagggagtttttaaaaggtgtgtcactgtgataactcttgtcacaaggtgaaatggcactgggcgcgcccctcagtgtgtagctcgagaagttctcacgagatttttgagaaaccccaccttgatagagagagttcccccacacactctttttctttgtgtctcgggtagatatgagggaaaagttaaaaaaaatattgtaggagccatgtcacatgtgagccacattgggaggaagaagctcgtgtgtgtgtgaaaccactagtgataggtttgtaaaatagtgccccacacataaatagtgtgtcctctgtctcaagagaaaaatatatatttgatatgttttggtgtttgttttgttttgggataatagcttttagaagtacccatttcacgaagaagggtgtataattcttgtggtatagaatgcctcacttacacatcttttgagaaaggtgttatatgaagttcccacaaatataaagagatttaataatgagcctcggtgagatatctcgggctttacacgaaaatttcacgagagaactaatttttaaaatctttagcacattttaaactttttttgttttgttttctgagacactaattctgaccaaagagcacgccaaacccctgcctgtgtggcactttcttggagtgtgctgtgaatgtgctttttaagaaatttaaaagagatcctttttaaattga

SEQ ID NO: 583417 - DNA, 125 bp, Homo sapiens
  misc_feature (102)..(102): n is a, c, g, or t
gagcggtctcccgcccgcggcgccatcgcgccattcctagttaaggcggcacagggccgaggcgtaaagtgggagactatgctgatacttgggttccggcgnctgtgatactgcagtgcagcctt

SEQ ID NO: 583418 - DNA, 496 bp, Homo sapiens
  misc_feature (169)..(169): n is a, c, g, or t
  misc_feature (344)..(344): n is a, c, g, or t
  misc_feature (347)..(347): n is a, c, g, or t
  misc_feature (359)..(360): n is a, c, g, or t
  misc_feature (363)..(363): n is a, c, g, or t
  misc_feature (367)..(367): n is a, c, g, or t
  misc_feature (373)..(373): n is a, c, g, or t
  misc_feature (377)..(377): n is a, c, g, or t
  misc_feature (381)..(381): n is a, c, g, or t
  misc_feature (389)..(389): n is a, c, g, or t
tggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactntggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagagcnttnaagtcctttccnnctntcanccattncccnccantaataagnttagctttcttttccccccccggggcttggatttgtggaattatgaactggggccatgtcagtttgtcactcacccaaactgacccaataaaacctttatttatgct

SEQ ID NO: 583419 - DNA, 135 bp, Homo sapiens
atcagctcggtccgattacgctctagacggagaaggacggttcttgtcgttattggggtcacttttgctcctcctggtgtcggcgggtctccacgtacaccagcacctctccctggccagcacttctggtctcca

SEQ ID NO: 583420 - DNA, 494 bp, Homo sapiens
  misc_feature (169)..(169): n is a, c, g, or t
  misc_feature (344)..(344): n is a, c, g, or t
  misc_feature (347)..(347): n is a, c, g, or t
  misc_feature (359)..(360): n is a, c, g, or t
  misc_feature (363)..(363): n is a, c, g, or t
  misc_feature (367)..(367): n is a, c, g, or t
  misc_feature (373)..(373): n is a, c, g, or t
  misc_feature (377)..(377): n is a, c, g, or t
  misc_feature (381)..(381): n is a, c, g, or t
  misc_feature (389)..(389): n is a, c, g, or t
tggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactntggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagagcnttnaagtcctttccnnctntcanccattncccnccantaataagnttaactactcttgccacctcaaaagataagatatgtggaataaagaaatgaggccatgacagttaaacaatcacccaaaaagaccaaaaaaacaattctttaagc

SEQ ID NO: 583421 - DNA, 168 bp, Homo sapiens
ggatcatagaaaagtctctggacctagcatgacctatcctggaacctggaagtaaagcagaaccaggttgtggggacagaggaagagatcacttcaagatggcacagccgtgagcggccaggccaatatttcatatgaactgtggccctgggttggtgacactatgag

SEQ ID NO: 583422 - DNA, 175 bp, Homo sapiens
cgttcattgagcggaaggctgtggaatggattatctataagttgggggagggctgtggaacggattatctataagctgagcggaaggcctgtggaacggattctgtacgagatgagcggacggcctgtggaccggattctctattagttgagggaaggctcagtcgaacggactg

SEQ ID NO: 583423 - DNA, 437 bp, Homo sapiens
agcccaagtgaaaacacttcttcatgtcccatgtccatctaattacattgtgttattttttgtcatttgcatagtctacggttgcaggaacagtttgatgaaagtgaattacatctaaatcttggtatagtatataatttcatctgttttcaaaatataactttttttgaacctcagcaactttgattgattttagaactttagaatgattttctccacatttcagtggaattgtggctagccccagtataaaaacaaaacaaaaaaacgaaacaaaaaataaaaacaaaaaaacctgcttatatttatacagtgagtctgaagcgaagaaatttgaaccatacaatgtttaattcctatggtgcttttcatgtacttcatttatcgtgttaaagttcagaattgcacaaagataaacaccattgacttcagctgcc

SEQ ID NO: 583424 - DNA, 432 bp, Homo sapiens
cttgcaacagacgggccttttgtttgttactttcaaaaggcccccatgattcaattagagaattccccccgcccaaaaaaagttcctaagtatgttaaaaatggcaagctttttaggcttgtcccaaaagattgctttgttttcctaagtccccaaaatggatataaattatctagattggaaaacagttttgcatgtttatcaggttacaatttaaaattccatcggggccaacccttcctttcccatcctcaaaaaagggcccttttatgatgcattgccccccctttggggaaattgatctttaaattttgagccagaataaggaaaatttggttggggttttacaagtgagctgaccccattttttattcgggggatttaaaaaaaagtcttgaaaaaaactttataaaaacatcttttatccttccc

SEQ ID NO: 583425 - DNA, 684 bp, Homo sapiens
gggtccaatatggcgacctccacgtggtcggtggcttctcctccggcttgcactattcggcttcctctgggaaacgtccggcggcctcgagtcgagggcctcccgcgacgacgacattgctactgccctatccacagcgcgcgcgcgcgccttcctcccgggactgcacacgggtgcgcgctcggaacccagctgagctcgacgagttggcctcgcgcctcctcgcgattcccggcgccggcgtgtctggcgctgtgcgcaccttcgtgtccgtagctttccagtgtaccgcgcggtggcctggccaacttgacgcggggccgttgatgccccttgctgcaatccttgctcggatggctgagacgcccgtgtgaggcaccgagcgagctgcgacaggcggaagaccgacgcgcctaccgtggtaggagacggcgcagggcggccgaactgccgtgtcgcccagaacggcggttcttccgcgatgaactcgggcgagtgcctgggtgaacgtggtgagcgacgagcggcgggtgagcagctccggggggctgcatgaacgcgcagttcgggatccgccgctgacgggaccctggtcacctgggtacctgtctgaggaggaggtgctggacactgagaacccatttgtgcagctgctgagtggggtcgtgtggttgattcgtaatg

SEQ ID NO: 583426 - DNA, 126 bp, Homo sapiens
cctgcgccgttacgcgccatagcttactcctcgctctgcctcatcctccttcccttccttcctgcctgtcatctccatatttgaacccctcagcccctcagcatccctgcgcgtaagggccagcag

SEQ ID NO: 583427 - DNA, 326 bp, Homo sapiens
atctcattggcgccactcgcagtcaccgaaacctctcgtgtctgccggtacagatttctggttacgccaccgtgtccgaacctcgaagattgcgtctaaggtggtatattgactcgatccgacgatggattccgtgtacaatgtgtcattagctgttcccggttcatcctggccagtccaccgacgccttcgtcgtccatcacccggagacaaactactttcaatgccacgtgagacgcacacagcgagcgccgaccgtattttcgccgctgtcttgtgggatttcgacggtactctcgtcgacactgagtcccggtgggtcgaga

SEQ ID NO: 583428 - DNA, 846 bp, Homo sapiens
atccgaacatgggaaagaacaaactccatcacaagccgcttttagatgaagctgtaaacactcaccggcggggctccgtggcttcattcttgaagtcagtgagaccaagaacccaagaattccagacacaaaatagatgtgaaacactgtttccaagaattataaagctgtcggctgtgcacggtggcgtcatgttttgtaattcctgcactttgggagacctgaggcgatgtggatcacttgatggtcacggaattggagaccagccgtggccaagcatggtgaaaaccgccgtctctagttacaacacatacaacacaaaacttacccacggtgcggtggatgcacgcctgtggtcccagtctacccgggagcttaagggcaggagaatcaccgtttgaaccgtgcggaaggtggaggttgcagtgagcccgacgatcgtgcatccactgtcactccaacctgggcgtcagagtgaggcttggtctcaaaaaaaaaaagcactttttgaaagtgtaatgtagtaaaaccccagaaagcaaatgaaacagctagacattggcgccgggaccacgaaacgctgaaaaaggtccttaaagacatctcatgccccggggggcctggcaacaggagggaaccaaccagtgtgcatgtagactggccttgcaagaagacacctgccggaagatgaaggaagttgaggattcatccccaaagatagaatgaccgccgggagcaaaccagccgaggtggcagaaataggcccaaagggttgcgcggggacaacatatggagttacgaaaaagggagcagtctcaaagaggagaccctaaaagcaaattgagc

SEQ ID NO: 583429 - DNA, 172 bp, Homo sapiens
tgctgtccggggcacttattgctggaggaaaaggtggagctaaagagaagatctctgcccttcagagtgcatgggagtgtgtgtcaacttatgaaggcatgtagtatgtcagtgtgtgcagtgcgtgcatgtgtgggaatgagtgcttgtaggtgtgacaggcatttaggta

SEQ ID NO: 583430 - DNA, 100 bp, Homo sapiens
agggaatttttagggtttttttccccgctttgtttcccacccccaaagtaaaaattaaaaaaaaaaatttgccattttttccaaaattgaaaccccgtta

SEQ ID NO: 583431 - DNA, 1746 bp, Homo sapiens
  misc_feature (246)..(246): n is a, c, g, or t
  misc_feature (273)..(273): n is a, c, g, or t
  misc_feature (403)..(403): n is a, c, g, or t
  misc_feature (476)..(476): n is a, c, g, or t
  misc_feature (478)..(478): n is a, c, g, or t
  misc_feature (784)..(784): n is a, c, g, or t
  misc_feature (1047)..(1047): n is a, c, g, or t
ccagcacttcgggcgggctgtagctcaggtgtgatagttttgaatcctcaggtagattttgaaaccagtcctgtgacaatatgttgtagaccccgagtctcatacgacatataaaatactagacacattatgcttggcgcgcaatgatcgcgatagttgcgaacctcgatagatcactaagcgtagctccagagacgcgctagcgagtgtcgaagaaggactattgcctatgcatccctctaaganacgcgttggaagactcttggaagttgntaagccagagtgacacacccagtgacacacgccagtgcccacactccccaggtctgtgtgactcgcactgggacatgagacagacaggtgtaataccagtgatagagatagagacacaatacaaagacanatgtaggtggcgaagccctggcttccctaaagtgatatctttgctctatcttgaaaacggcgagccctgacanangtgtatgatcacgcgtcgtgttcaccccccgcagtcatatgtcctctgtgtgtgtcccccacagcgcgtgggagtgtcccacgtgtaaagtcaccgtgtatagtgtccggtataagctacaacatatgccaacatagtcgaagtatcagttgtgggtcgcagagggccgcatttgtgtttaaaccaaaggaccaggcctcccgaagaagaaaactgtggcgcggaagacaagaacttttctgagcatatccgcttgtatgagcgggcccatcttctcctccgatgttagacaccaagcgagataancccctgtgataacaaactctgtgcgcgaagtggggtgagacccggaaactcactgtgtgagccctcaattaaaactctaacgccatttgtcgttccgaagtgtgttattgaggaccccgtcttctcttttaccaggggcgggatggcggatcatttctcggacagaggcactagtgccccccacccgagtgtgatagtgtcactagggttggtgtgccgtttaaacatacctttagagggggggggctccattgtgttgaccnttcccgtcgccgttgccactattgtgtcccacaccggttggggggcgtctaacggcctgggtaaggacatatccattcctaaaggaatttggactcggtaaggagacaaaatttttttctccaatgattaccccccgcggagcctgtacatagtaagattagacgacactacacaagacgaaggctattgggaatattgggttcttttaggacctatccccttttttttccaatttggacactggaatttttttcaatttctgggggccaaaaacaggggacaaggtttttccaaactctgggggtaaaggaacccaaaaaaaccagaaattttccgaccccttttttaaacttataaggggtagcctttccccttatgtgggagacaccagtgaaaacaacaaagggcgtttcgaccgtttttttccaacattgggggcaatactctcttggattgtggcggacactatacgtttggcttggatcacgctttaaccccaggaacaggtatggtgatggtccgtgacaaaaggacatgtacatatttattcacacgcagccaggcccacatattaacaccccccggccccgtgtccaacaatcatatcactcggttgtgcggcacacaagcagaagctactactaattaagcgaggaagaattataataatctcactgatgagaaggagcgttccctaa

SEQ ID NO: 583432 - DNA, 973 bp, Homo sapiens
cctcctgtcacatagggcccctctgggtctcacccccgtggcctgttgttgtcgcgaccacagtccccttggcgcccaccattgtatgcggggttcttaccacagcgctctcctgtgccgggtcgctcggcaaacgctgtgtgattcacaccgcgcctttttgccaacgcggggtacacaactgtcggtctctggggatgcccccacccaccttctgtgtgggttcgtacgcctctcacagtttgctggcacccggtcgttcttctcgcggaggtgctccactagccccgccatgcccccggttcctttttgagtccctcccgccctcctgtatgcttcccatcgcgcggttatttgggccccctctctcccaatcaagccctgggtgggccccccaatgccctccttttggccctcccaacggtatttcctcgcctggtggccccccccacaacccaccacatggaccatgttgtatggttacggcttgctcattatgtagacaaccaacttgggccctgctcccgcgttcttgtgcagctgactagcatcaggcagtaggacttcgccctcccgttcctcctcccttgggggagggggtttttcctcaaattcttgcgtcggcttgatgccatcatcgcacacacgaacaaaatgtgtgctgaacaccccccactgtcgggaaaacacgaatagacgattatagacccccactctaggagcaactcgactcccggtaagcagagagagtggggacaactcagcgtgagtaggggcagaaactgctcacctacgggttagggcaccacctcttggtgtgatcctggacacacagaaccatttcaggagggcgcactctcactcgctccctctccctcactccacgacacactgtcttgtacctcgacgcctatttttcccgctcaccttgcgccccaaaaagcctttcttttgggccccccccacatataca

SEQ ID NO: 583433 - DNA, 369 bp, Homo sapiens
  misc_feature (3)..(3): n is a, c, g, or t
  misc_feature (17)..(17): n is a, c, g, or t
  misc_feature (66)..(66): n is a, c, g, or t
  misc_feature (288)..(288): n is a, c, g, or t
  misc_feature (340)..(340): n is a, c, g, or t
cgngttcccgctcgcgnctctccctccacacatccctgcaagctgagggagccggctgtggcttgnagcacagaaaggggctccacagtgcagcggtgggctgaagggctcctcaagtgccgccaaagtgggagcccaggcagaggaggcactgagagcgagcgagggctgtgaggactgccagcacgctgtcacctctcaactcagtctcccacatggcgtggccacccttgtgtctgttaaactctttctcttacaaaaatgccatggtctttctttgttgcagtngtcagggaaaaaccccttggggcagattacaaaagttctttttcagggcatntgttttccagaataggcgaggttttcctc

SEQ ID NO: 583434 - DNA, 409 bp, Homo sapiens
  misc_feature (222)..(222): n is a, c, g, or t
ggcctaatgtaggtgacgggttgatgggtgcagctaaccaccagggtacatgtatacctatgtaacaaaactgcatgttccgcacatgtaacccagaagctaaagtattaaaaaaaaaaaaaaaaaaaaagaatgtgctctcagctggagacatgcttcagtctgatcccatggggacctctgcagcataaattgaaccacagagttgatcctgccttcagnaagagggctggccttttgagcactctcttcccattgccatcagttagttatttggatgcagggagtccttgaacaggggacagacattagcagcaatcattgaggcacaagtacacctgtggtaaaggcagaggaggggagaagtatagcatctggtgcagaagttatacccccaaatgaatgaaat

SEQ ID NO: 583435 - DNA, 428 bp, Homo sapiens
caattggaaaacctcctataacttggaactgtccccagcccgctttgggttgtcctgcctttccagatcaaaccaatgtacatcgtacatgtattgattgatatcctctgtctccctaaaatgtataaaaccaagctgtagcctgaccacctcgggcacatgtcatcaggacttcctgaggctgtcacaggcatatccttaaccttggcaaaataaacttctaaactgattgagacctgtctcaggtactttcttggtttacaggaatttaagcaaattacaggactgcactacccatgagtttgtgaaaggaaaaataaatctcaggaccccaaaatcactaagccaaaaagaaaagtcaagttgggaattgcatcgagcaaacctgcctctcattttattcttgaataagatagctacaaagatta

SEQ ID NO: 583436 - DNA, 246 bp, Homo sapiens
gggtgggggtgtggatgtatataaagcaagactaagtctgacttcctaagggctttctcaaaccatttctgtccaagagaaaatgacgttgggcttggatataaaaaatccaatgagtaaaacacaagctagtcaaatgtgttcacagcatgcagaacaaaaactttcaacctttctctctcactatacagtctcttgtcatgtgaacgtgtggcatggcagcatggccgtctatgcaagcaggga

SEQ ID NO: 583437 - DNA, 153 bp, Homo sapiens
  misc_feature (55)..(55): n is a, c, g, or t
gaccaccgctctttcagttctggcgagcagatttgatgatttaactgttgaggtngtggtctaagcatagcgcggtatctaatcccagtttggttcttagctattgtgtgttcagacatgttaaagccactttcgtagtctattttgtcaact

SEQ ID NO: 583438 - DNA, 669 bp, Homo sapiens
  misc_feature (13)..(13): n is a, c, g, or t
  misc_feature (215)..(215): n is a, c, g, or t
  misc_feature (347)..(347): n is a, c, g, or t
  misc_feature (350)..(350): n is a, c, g, or t
  misc_feature (423)..(423): n is a, c, g, or t
  misc_feature (425)..(425): n is a, c, g, or t
  misc_feature (437)..(437): n is a, c, g, or t
  misc_feature (442)..(442): n is a, c, g, or t
  misc_feature (451)..(451): n is a, c, g, or t
  misc_feature (459)..(459): n is a, c, g, or t
  misc_feature (476)..(476): n is a, c, g, or t
  misc_feature (481)..(481): n is a, c, g, or t
  misc_feature (494)..(494): n is a, c, g, or t
  misc_feature (499)..(499): n is a, c, g, or t
  misc_feature (505)..(505): n is a, c, g, or t
  misc_feature (507)..(507): n is a, c, g, or t
  misc_feature (551)..(551): n is a, c, g, or t
  misc_feature (553)..(553): n is a, c, g, or t
  misc_feature (570)..(570): n is a, c, g, or t
  misc_feature (577)..(577): n is a, c, g, or t
  misc_feature (588)..(588): n is a, c, g, or t
  misc_feature (590)..(590): n is a, c, g, or t
  misc_feature (632)..(632): n is a, c, g, or t
aatgtcgacaatncagggaatgaacagcctccatctgggcctctctggtcaaaaccacttttttgagttaggggcccagccccaggcctcccaggtcatcgtcctctgccccgaagcccgagaagctgatgggctggcaggccaggctgcgcaggttcacaaggcaggcggtctgcgtggcactgaagttagggacagttaccaacagcactgtntggtcctcaggacctcggatgattttggagccaaagctgggggtgttgccacaaaagtagacatgcgggcactctgggaagatgaacgggttagttttttagaaggggtaacaacctagagttttaggggcngtngggctgatgttacggacccgcagcaacttccaggatctccaagttatcctccatgctgctgtttcggaaaatntnactcacgttctntcctnatgttcccnaaaatctnacttcatcaatggtggnctggnaggggttggtgancagcnggagcntngagtaggcagttgccagcgggaacatgcaggggtggaggggctncngggggagcgttttattngtggganaaactcgcctngnatcacgtccacgggcactgaggcgctcagctgcaggaggatntcatccagcatcttaacagcttccacgctggctgctt

SEQ ID NO: 583439 - DNA, 107 bp, Homo sapiens
cactaggtgctctagaggatctttttcttgcccagactcgtacgtggttatgtaacttacacagcattacatgcgggttgaagcagcacccgcatcgtgtttcagac

SEQ ID NO: 583440 - DNA, 346 bp, Homo sapiens
  misc_feature (318)..(318): n is a, c, g, or t
ccgggcagtagagctgggattacaggcgccgccaccacacctggctaatttttgtatttttagtagagacggggtttcaccgcattggccaggctggtctcgaactcctgacctcaggtgatccatctgccttggcctcccaaagtgctgggattacaggcgtgagccaccatgcccagcctttggacataaggattttgagtagctcttattgcccaggctggagtagctcttattgcccaggctggagtagctcttattgcccaggctggagtagctcttattgcccaggctggagtagctcttatgcccaggctngagtagctcttcttgcccgtcagatggt

SEQ ID NO: 583441 - DNA, 377 bp, Homo sapiens
  misc_feature (349)..(349): n is a, c, g, or t
agtaagagctgagctatagcccataggtgctggagagaatagtggtcagtcttcttgggctgagaggttaaccatctagcttttctgcatcttattggtcgatacgctctctcctgttgtgcttgatgatcacgccctcgattgagaggtcctctgtcttactttttcctttgattaaaattgcaaaatatattaagatctggtagaggtaccagcttcctttccagctggagtagctcttattgcccaggctggagtagctcttattgcccaggctggagtagctcttattgcccaggctggagtagctcttattgcccaggctggagtagctcttatgcccaggctngagtagctcttcttgcccgtcagatggt

SEQ ID NO: 583442 - DNA, 310 bp, Homo sapiens
  misc_feature (282)..(282): n is a, c, g, or t
actccagcctgggcaataagagcttaaccaaagacccagttagcctgaggtacagaaccaggaggtgctcaaatctggggctgagagccagagagacgtcagaaggtgagaagtgcccagccaggactccactctgcgttctttgttttgtttttgagacggagagtagctcttattgcccaggctggagtagctcttattgcccaggctggagtagctcttattgcccaggctggagtagctcttattgcccaggctggagtagctcttatgcccaggctngagtagctcttcttgcccgtcagatggt

SEQ ID NO: 583443 - DNA, 234 bp, Homo sapiens
  misc_feature (206)..(206): n is a, c, g, or t
ttcccctctgcaacagacgcccactccacgcgtccagcccacgtacagtctgagcattacgccgcagagctcttattgcccaggctggagtagctcttattgcccaggctggagtagctcttattgcccaggctggagtagctcttattgcccaggctggagtagctcttattgcccaggctggagtagctcttatgcccaggctngagtagctcttcttgcccgtcagatggt

SEQ ID NO: 583444 - DNA, 735 bp, Homo sapiens
gttcactttctggttgggtggatggagccgggcgggagcgcgcgcggtggaggggctgcggttcagtctccgcccggcgctccctgtatcagctgtctgtctgtctgtagcctatctctgtcccttttctcgctgcatcgcctcctcttctctgcttcacatgcctgtcctgctgcctttacaatgtctctgggctggtatctaggctccttcctttctatcctttcaagtttaaacttacactaatcgctttctggatgattatcttacccttttctctatttactctcatattcctatcttcattctcccttatttctcatttctttctattcttttctcatttcttctcttcattgtgtattcttatattaaatcctttttttcttttttcttatatcttttttctttcttttattttttttcttttttttttgtcccttattccttattttttcccttttttttatttctttttttcttaattttattgtaccttttttatttatctatacttctcttctaatttttttcatcctttactctctctactttttctctcttcttctctaatcattaatcttctctctactttctcttatttttcctatactctttactatctctctcatttctctcacttttatatttctctttttccttccatttccatatatcttttttccattcatcttacttatttttctaattctcttctcacaaattcttttctcc

SEQ ID NO: 583445 - DNA, 333 bp, Homo sapiens
  misc_feature (7)..(7): n is a, c, g, or t
  misc_feature (305)..(305): n is a, c, g, or t
tgtgcantagagctagactccgtctcaaaaaaaaacacaggcaggtgtggtggctcacgcctataatcccagcactttgggaagccaaggcgggcagatcatgaggtcaggagatcgaaaccatcctggctaacacggtgaaaccacgtctctactaaaaatacaaaaaaataattagccaggctggagtagctcttattgcccaggctggagtagctcttattgcccaggctggagtagctcttattgcccaggctggagtagctcttattgcccaggctggagtagctcttatgcccaggctngagtagctcttcttgcccgtcagatggt

SEQ ID NO: 583446 - DNA, 280 bp, Homo sapiens
  misc_feature (252)..(252): n is a, c, g, or t
gcataatgagctgggattacaggcgtagccaccgctcccgacctatgtatcagttgtttttttcaatgtaaaatgaaaaaaagaattttctttcttttttttgtcttttttttagaacagggtctctctgttagagtagctcttattgcccaggctggagtagctcttattgcccaggctggagtagctcttattgcccaggctggagtagctcttattgcccaggctggagtagctcttatgcccaggctngagtagctcttcttgcccgtcagatggt

SEQ ID NO: 583447 - DNA, 217 bp, Homo sapiens
tagaacatgtagggactttttaagttgccaaatttatacaatgaagaatgttacttgttacatcaagtatctaagcgtgcatttcatgctcatcaaactctagtttaataacttagatacacgagccctattatcttagacatctacacctcagtgacttctaatatgaaagtgttaacatcccaaatgttgcctcacatctacggtgaactattaa

SEQ ID NO: 583448 - DNA, 241 bp, Homo sapiens
  misc_feature (213)..(213): n is a, c, g, or t
agaccacgccgttgggtgagagattgtgagcgccttcatgtcaggattggggtctatatgcatcaatggctggagcctcagcgcccactccacagagtagctcttattgcccaggctggagtagctcttattgcccaggctggagtagctcttattgcccaggctggagtagctcttattgcccaggctggagtagctcttatgcccaggctngagtagctcttcttgcccgtcagatggt

SEQ ID NO: 583449 - DNA, 258 bp, Homo sapiens
  misc_feature (230)..(230): n is a, c, g, or t
gtgggactcaaagtgatcaattttcgccactctcagcctcgccaaagtgttggaattataggtttgagccactatacccagcctcttaaaatattttttgtagagatgggggagtagctcttattgcccaggctggagtagctcttattgcccaggctggagtagctcttattgcccaggctggagtagctcttattgcccaggctggagtagctcttatgcccaggctngagtagctcttcttgcccgtcagatggt

SEQ ID NO: 583450 - DNA, 164 bp, Homo sapiens
gagctcggtaccccactgctacgtgcccctcctgagagcggaagagacttcttctccagtcatcggggagctgtggctcttctccagaaggcaccaccacagctgcccacttctggaaggttctgtctcctactggacctgatctcggctggacctgatctcgg

SEQ ID NO: 583451 - DNA, 316 bp, Homo sapiens
taccgttattgtgtactctctcttttctgaaccatcatgtacttaatgtctgtatcatatgagtagacacttgattgtctgttcacatgactccctaatggtttcctatgtgatattcttgggtctagagttaaatttaaagtaaacaatctctattgaaaaccacttttccagacactttcctagatttgttttctcaacaaaacatcctttcttctagagcttcccacaattcttgtatccatttatcatatgtcaaccaatcaagtatacttgagcgtgtattttagtgagaaagacatcctaggtgtgagtc

SEQ ID NO: 583452 - DNA, 630 bp, Homo sapiens
ccgccatcacccaggggatggtggatttcgttccatgaagaacaaggtcaccttgtggttggagctccccaggacatcatcccccagctgaagaagaagtatgatgtggacacactggacatggtcttcctcaaccactggaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcaggccctgactgccccccggcccttgctcggctctctcacccgcctggtatgaggtgccaactgctctgcgacttctgcggcccgggcggtctaatcaagcacacctgccggctgcgcctgacatgctaacctctctgaactgcaacactggattgttcttttttaagactcaatcatgacttctttactaacactggctagctatattatcttatatactaatatcatgttttaaaaatataaaatagaaattaagaatcta

SEQ ID NO: 583453 - DNA, 1326 bp, Homo sapiens
  misc_feature (389)..(389): n is a, c, g, or t
ggtggacagagcctgggtatactgagggtcgccgattcctagtgtcctggcgggtctctgcgtctcgctggcgccgaggtggcaagcttcgtgacactcgatgatgcaaccacgatctccgagtcctccccatgatactggctagtcgtagtttagcgggaacgatgaggttccacccagtcgaccctagacccgtgcgacatatggtctatgcatgtcaattgcgtatcacgattactgctccaagctgcgctaagtacgaaaaacagtagacactacagtgagcaaacacgaccacacatacaacaccatacccctaatactcccactagagttggacactctcagctcccaacttgcagtccggagggtttcacctcatccagagnagttacgaagatgtggcagagctgcaaatcggtgcagacacaagagagttctcacacagtgctcagacgggtatactatcacagagtcttcctgatactcatgacacccgcactaattgatgaacctctcatatctccatggttccagtaaaggggacagtacaagtaattacccctccctgtagggaacagttttctcggctctgtaaaaggagtcaatcgggtttggacaaatagaaaaatccgacgcttggttggagctttgcgcaccctcctcattcgtcttatctcatctttgtgcctcggacgggaatccatccgcattatgcaggacacatgggacccgcacttatttcttgggggacactttagcgcattcgttgtgcggtggtttcgcacctttagccgttgtaacaactataacgttatgccaatgaggtccctcaaggtaaaccaagagtctctatagaggggttaaccaaaggggggggtataaacggttggtgaatttacatttggcacagcgggttcctaaggatccaagggttgattgacattcttctctcagaagacgtacggaagctttggttttcccttaaagcgagctcacggggcacacatggcggtaggtgggccacccattgtctagcctcgtataatctacggccatcttttccggaggtcgaattaccatcgctccgtgttaagagggaccttggaagcccacatacaaagacaaagtaccttaacgcggaaggaaaataaaccaaccaatagaggattccataactgggcgccgttgtccggaaaaaggttgcaccgccccatttccaagggccctttgtaaggccttctgccccctggttcaacaaacacggtatgccttatcaacaccaggggggggaacaacgctggttcacgacacggggagagacac

SEQ ID NO: 583454 - DNA, 103 bp, Homo sapiens
ccatgccaggtgtggtgcagaatcgtaggcagggggatgtagcagagataggcctgcactgcctgtggcctttgtcgagtccctgcccttctgtcgtcttctc

SEQ ID NO: 583455 - DNA, 204 bp, Homo sapiens
taacctggtatcccacccctgaggtcaggtgtatgagacagcctgaccaacattgtgaaaccccatttctactaaaaatacaaaaattagctgagcatggtggcatgcacctgcactcccagctactcgggggcggctgaggtgggaggatcgcttgagtctagggaggcggagcgatgaggtgagccaagatcatgccactac

SEQ ID NO: 583456 - DNA, 560 bp, Homo sapiens
ggaaggttttgcctgttctagaaacaactgttgtacttgcacaatcgtgatttgcgataaagactgcaatccatttaggagaggtgggatacattactatgccggggaaattttccacattttgcaaacatacagatactaacaatgtcattctggatcaatgactggaacagttaagttattgcgaaataacttcatactcattgcagatgtttgtagacgcactgagaagactcactgaatcctgtgatgagtgtccaaagagacgcgctgaattaactgggtcaacattgataggctattcatacgtgagctacatgagccgccaagtgatgatttgtaagagtagactttagtacacatattctgcacatacatgatagtgtacattgaacctcataatagtccaactatatttagaacaaaggtgaactttacgtactgaacttgtccaatgacgaaccaagagtttcacctctcgagacttagttataataggccgaccaatcatgctattccgtgacccacccctcaggttgctgctgtttgaacatatagtg

SEQ ID NO: 583457 - DNA, 460 bp, Homo sapiens
ccctaaaattttttttttttgaacaagccccctcattttgtggaccccccccctaaccaaattggatggggttgggggctaaattaattgggttggggcggggggggaccccgaaaactttgatccgggggccccctttttgggttgggggggcccgaaaaccaattttggggcccccgttctgggtggaatttttttggctttggccttttgggtttgtccttcttttcccccttggttttttaagggctttttccttttaactttttttggtggttttcccggccaggaggccaaaaggggggaaaatttccctcttttactgggataatttttttggttccaagtggggtaaggtttttttttccatttgaaggcccccttggctggtaaaacctcttttgtggattctcccattttttcttccctccctttccattataaattttttttttgccca

SEQ ID NO: 583458 - DNA, 202 bp, Homo sapiens
gcaaagtaacaactggacacaagtgaaaaattgaggtataaattgaagcagcaactggtgcagtgtgtccagccagtggatccactatggaagaggatgtctggagtataggctacagagcatacaggtattgtgagttttacttcagtacagcagcctttcttgtcatctgatggacatctgtttaaatggagctcgtcag

SEQ ID NO: 583459 - DNA, 871 bp, Homo sapiens
ggcgcgtcccccaggaggtccccccacgggcgaggcgccaatcttgtagagggttccaaaaacccttggaaaaatggcgcaagccaaaaggggtgaacaaacccggggcgcgaaggaatgccctcggccaggaaaacctattctatccgggggtcccgcacacaacggaaagtggggtgtcccaaagaagaaaacgccggctaggggcaagagaggcccccacaagacgccaccacgaaaaccgtcgggggacagcggacccacacgtttccagatggctgggagatagccgtgagggaccaaaccttccccccaagaggtttttaattgctgaaacacattccctccttccccgtccgatatattacccccacccttctgaaagaaaggaggaggccccattccagagcccccagcctgcaacctttttgttgagaccgctttgtgtgaagcaaacccaagcgccccacaggccccccccaacgagcccccttgttaaaagctgcattatatggagatgtagtttttcccacaaccttttgttatagaaggagaattctcccacacaggcctcggcgatataaggagagctcgctcttcgcaaaggaagggtgtaaaaaaaactctgttgctgccaaagtcccacactggccctaaggcggtataaacatccaacacctttacagcatttctccccctctccacctgaagataaaagaaaagaaaattgaagatcccaatgcataatcatctgtttttctttttccgttggtgtgataaacccacacccccctctaaaaaaacataaatttttttaacctttccccttttttctgtgcttccaattaaaaaaaaagggaaaaatcccaaa

SEQ ID NO: 583460 - DNA, 361 bp, Homo sapiens
ccctcacagaccctggcagaagcaggaagcatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggcagaagcaggaagccagagttgctggaaccacaggcttgtgccaccacgcctagctaattattttaactttttgtagggacaggttttcatcatgttgaccagactggtcttgaactcctgacctcaagtaatccacctggctcagcctcccaaagtgctg

SEQ ID NO: 583461 - DNA, 425 bp, Homo sapiens
cacgaggagggcagcgacgacagcagcttttccatcggtgacaacaacgggctcagcaggcggggaaacggagacgtcgccggctagaactgggagattggacaccacacagtattaaacagttggcctgattgcatcaagtcatctttccagtcagctacattgacaagttctacagggatgtgctggaggttggtgagctagcatcacttgcctatttcaatgatattgctgtaggtgcagtatgctgtatggtggatcattcacagaatcataagagactttacatcatgccactaggatgtctggcaccttaccgaaggctaggaataggaactaaaatgttaaatcatgtcttaaacatctgtgaataagatggtacttttgacaacatttatctgcatgtccagatcagcattgagtcg

SEQ ID NO: 583462 - DNA, 168 bp, Homo sapiens
tgttaattctacaatcaaccaacaagtcattattaccctcactgtcaacccaacatagtgcatgctcataatgtgaaagtgttaaaaaaaatgtaaaatgtgaactcgtgcaaatcttaccccgcctgtttaccaacaaacatcacctctatgcatcaccatgtatta

SEQ ID NO: 583463 - DNA, 466 bp, Homo sapiens
cgaggacccatccctgaggagagtggcgatgaggacgcagacgacccttacaagcgcatctcgatctgctcctctgacagaacgattgcctgtgaggacgagttctccgagcctgaagaggagggcgaggggggccgaagaactcttccaacttccaacaaagcaagagagtcacaacaggggatgaacaagcgaaaggaccagaggagaagaaagaatccccgaagaggcgaaaaccaaggaggagaagccagaaggcaaaggggtcaaggaggagggcaagttgggctgaatggacctctccagctctggattcctgctgagtccctcacgtatcttccccaaacccgtcagattttatattttctatttctctgtgtatttatattaaaatttattaaatataaatatcccccgggacagaaaccaaggccccgagatcagggcagctgtgcggggtgagctc

SEQ ID NO: 583464 - DNA, 426 bp, Homo sapiens
aaaaaaaaagatacagtagtccatggtgagatgttgcaaaattattcaaaatattgccatgggatacccttaattgggaacctatagaagcacagattctgacataacaagtatttgctacttccaagcactgcagtcaactaatggatataatgggatgggctggttgctcctaactgtgctggagaaggtgggaaagaaaaagatgagctcagctccacacgaaggacctgcaagcttctatcttggcccagaagaagcccttattccctgtagctgcagaagtaaaattgctgaacaccatgcctagagtttaatcctgtgagcagctgaattacaacagaaattaaattcacaactgatgttattaaactttgtccacttggccagtcctatccatgtaaaattacatttcattgtctttga

SEQ ID NO: 583465 - DNA, 117 bp, Homo sapiens
agggtccattgacagttgccagaagaaagcccagaacatcatggagtcctttgaaaatccatttaggatgtttctgccctcactgggacaccgtgtctcccgtctctcagggcagcg

SEQ ID NO: 583466 - DNA, 408 bp, Homo sapiens
cgtatctggaaggatgaccaaggagtgttcctttcgaacgcccttcccccccttgtggtgatcttacaagagcctctggcatctctttctgcaaacggcaccctgaattgtgtatgccgtgccctgattacgcagtagatgctgagggacggtgtgagagagcagcaccagcccattcgctgtctcatctgtgacccccatgttcccatgctgacctctgtttcctccccagatcatctttcgttgttccagatgaggtggggctgccatgtctccatctctgtctcaaccgtttacgtgcactgagcgtgcaaccttcttacttccctacgtgaaaataagaatcgtgaatataaatttgttttctcaaatatttgctatgagatactgctggactaacttcatcag

SEQ ID NO: 583467 - DNA, 601 bp, Homo sapiens
  misc_feature (464)..(464): n is a, c, g, or t
  misc_feature (510)..(510): n is a, c, g, or t
atagcttgcatctcatcccagtaaaaccacttatttataacatatcaacgtattgacaaggttgaagagcaagattgttctgaggtgagatgcaaatttcaaaggggtgagcactaattgttccagtgattgtttatttattggctaggacataattactctctttgaggttacacatctgcctccaggttcctgtgtgcttgtgcccttgggatcaggccagggcagactgtgatcactgagattcaaactcccagagtaatcagcaagagctttctagagaccaaggccaggcctgatccctgagggatgcatgagaaggcttggaatctcattctgctatggtggctctctcttgatcttcttggagtagcaaaaacagcaatgtgggcccaatggtgtggcctaaatgatcacaaaggtaaatgagtaaagggctcagcagatgagtaaggagccttgtnctgagaaattagcactgggctctgcattcagaaacatgtgataagnattgcccattgcacattggctttattggggtaaggacttgaaaatttcagttttgcattaactggggaagaaataccctgagggaaatggc

SEQ ID NO: 583468 - DNA, 142 bp, Homo sapiens
acatgatgctcaccgctcagaaaacagcctgctcctccttctggccttttcatatttccaagttactgtttggaaggaaaaaaaaaaggtgtggtgtgggctggtttattctctaaaggtgacaaaaacatgaccatcggac

SEQ ID NO: 583469 - DNA, 920 bp, Homo sapiens
gtttcccaaggggcataggccaatgtttcttgatcccacagactcccaggcatatctttgatggaagcatctctgcaagtacgggagggccaaactgagtggtaagactgtacctgggggagattgcatgaccaggagtgacgcataggcgtgatcggtatgtccgcaagtttgaaggcttcctctgctcttagagtatgggttgtgtgactccctcttgatactatactgcttttgattgtatggcgaggtcacgatgaaagacaaacgttggcgacatagttaccgatctgtgatatatactcttctatgtgcctttgacgaggaaaatgccgaggaatgatgcggcctgaatcggagttctaattgctatcctagtgacgactctggagagtcatgagaacgcctgctcgtggcagtctacggtgtttgcggcatttctctcagtgtcccaccacaaacggtctggtcaattcctgactcagcaaacctctatcggtctaacttcggactatacgcctgaacggagaatgagtctcagaaggattctcggtattgacatgtctcttcaatctccagtaaagctcctgaaggactgactgagccaacgtgtcaaagcaggtaatggacgcgatttgggacttgtcagcaacgttcatgctggaactggaagccagcagaggattcatgaggcaaacgaagaggtaatgagcagagcgcttcgggattgcctgatgaagagttcctgatactttctcgttctccagtgctattctctcatttctctccttcattcgttggtcacatatatgcctaaatgcaccagtaatgtgcctacgtcctgcctcgcaatgagggagcatgtacccacaggtacatccatgtagctgcaggcagcagtctgacttattggtaccccc

SEQ ID NO: 583470 - DNA, 501 bp, Homo sapiens
catcagaatgagatctgcacgaggactgcgtagccaccttcctctagtgcagtgcaggtctttgtagtgttgcttcatctgcattcccttcatttctcctaaaacatggtagaagattttcaagtcccggctgatggagttagcttcagttgtcctatcgcaacaccttctttgtggttctcattgtcttccttgtcctgttcgtcattgatgcctcgctcgaaatacggaagtatgatgatgtgacggaaaaggtgaacctccagaacaatcccggggccatggagcacttccacatgaagcttttccgtgcccagaggaatctctacattgctggcttttccttgctgctgtccttcctgcttagacacctggtgactctcatttcgcagcaggccacgctgccggcctccaatgaagcctttaaaaagcaggcggagagtgctagtgaggcggccaagaagtacatggaggagaatgaccagctcaagaagggagctg

SEQ ID NO: 583471 - DNA, 324 bp, Homo sapiens
ggtgatgagagaggtaaggtctctattctccagagaaattcattcagcaaacgtccatttttttttgagacagattctcgctctgttgcccaggctggagtgcagtggtgcaatctcggctcactccaacctccacctcctggattcaagcaactctcctgcctcagcctcctgagtagctgggactacagacgcacaccaccatacccagctaatttttgtatttgttagtagagatggggtttcaccgtgtcagccagttggccttgaactcctgacctcaggtgatccacccgcctcggcctcccagagtgctgggattac

SEQ ID NO: 583472 - DNA, 348 bp, Homo sapiens
gcgagtgatgcggggtatatcgattacaggaacaggcccctcaagagggatatgaagcaccggcaggtcctttgagtttgaagcttgtggctcgtagtgtgcgggcgagcagttcgtggattcaactgtggaggtttagggctaagcatagtggggtatctaatcccaggtagggtctcagctatggtgtgttcagatatgtgagagccaatttgcgtagtctattttgtgtcaactggagtgtgttacaagtcaggtgagttttagcttgataggggagggggtgatctaaagagagtctttacgccggcttctatggactggggtctaatcgcccggttaaactcg

SEQ ID NO: 583473 - DNA, 250 bp, Homo sapiens
tccccacacatcaagggaattcacaaggcacagggacagctccccacacaacaaggaattatccagcaaggcacaggacagctccccacacaacaaggaattatccaacaaggcacaggacagctccccacacaacaaggaactatccaacaaggcacaggacacctccccacacaacaaggaattatccaacaaggcacaggacagctccccacacaacagggaattatccaacggggcatggggaccg

SEQ ID NO: 583474 - DNA, 343 bp, Homo sapiens
gagtgtactcctatttataaaaaaatgttaactgtaaaacagtctctggcaggtctttaaggagatattctagagggaaggtattgttatcataagagatgacagcttcatgggtgttactgttcctgaagaatttccagtgggacagcatgtggaggtgaaaggcagtgatattgatgatcctgaccctgtgtaggtctaggctaatgtgtatgcctgtgccttagtttttaaggcacagtttaaaaaagaaaaaactttaagttttcataacttaacttaaaaaagtttacacaaataaaaaaagtctaagaaatttattcacaaaaaagcttagtaatag

SEQ ID NO: 583475 - DNA, 139 bp, Homo sapiens
ggaaggaagcaagcacttggtggtgcctcaagccattggacttggacccgtttcttcttcctcgggcttcctctcttcaactgcacaaaggctcttgttgacctccctatgttcgtgacttgagcccacccctcggtgt

SEQ ID NO: 583476 - DNA, 104 bp, Homo sapiens
ttgatagcgagtcgtcgtctgctgaatgtacaccagcctttcgcttatcggagtcacgggggtccccttcagggacatctttcccgcccgaaactccaccaagt

SEQ ID NO: 583477 - DNA, 906 bp, Homo sapiens
  misc_feature (5)..(5): n is a, c, g, or t
  misc_feature (118)..(118): n is a, c, g, or t
  misc_feature (196)..(196): n is a, c, g, or t
  misc_feature (727)..(728): n is a, c, g, or t
  misc_feature (733)..(733): n is a, c, g, or t
  misc_feature (738)..(738): n is a, c, g, or t
  misc_feature (743)..(743): n is a, c, g, or t
  misc_feature (749)..(749): n is a, c, g, or t
  misc_feature (752)..(752): n is a, c, g, or t
  misc_feature (763)..(763): n is a, c, g, or t
  misc_feature (772)..(772): n is a, c, g, or t
  misc_feature (779)..(779): n is a, c, g, or t
  misc_feature (785)..(785): n is a, c, g, or t
  misc_feature (788)..(788): n is a, c, g, or t
  misc_feature (792)..(792): n is a, c, g, or t
  misc_feature (797)..(797): n is a, c, g, or t
  misc_feature (806)..(807): n is a, c, g, or t
  misc_feature (810)..(810): n is a, c, g, or t
  misc_feature (814)..(814): n is a, c, g, or t
  misc_feature (816)..(816): n is a, c, g, or t
  misc_feature (821)..(822): n is a, c, g, or t
  misc_feature (826)..(826): n is a, c, g, or t
  misc_feature (834)..(834): n is a, c, g, or t
ataanaataaaaaattataacaaaccctgagaaccaaaatgaacgaaaatctgtgtcgcttcattcattgcccccacaatcctaggcctacccgccgcagttactgatcattctattnccccctctattgatccccacctccaaatatctcatcaagcaaccgactaattcaccacccaacaatgactaatcaaanctaacctcaaaacaaatgatagccatacacaacagctaaaggacgaacctgatctcttatactagttatccttaatcatttttattgccacaactaacctcctcgggactcctgcctcactcatttatcgagccaaccacccaagctatctataaagcctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttccgcaagggttttccaagcaagaaagcnnataangaacnaccantgacangcntataagatagnagaacgcancccatgnatcctnacngggngcctntcaacctcnnaangacntncggcnnagcnatgtgatntcattgccatgtgcgagcacgatcggtcatggataggcaattcataacgaacacgaccgagcgatatacgga

SEQ ID NO: 583478 - DNA, 742 bp, Homo sapiens
  misc_feature (5)..(5): n is a, c, g, or t
  misc_feature (118)..(118): n is a, c, g, or t
  misc_feature (196)..(196): n is a, c, g, or t
ataanaataaaaaattataacaaaccctgagaaccaaaatgaacgaaaatctgtgtcgcttcattcattgcccccacaatcctaggcctacccgccgcagttactgatcattctattnccccctctattgatccccacctccaaatatctcatcaagcaaccgactaattcaccacccaacaatgactaatcaaanctaacctcaaaacaaatgatagccatacacaacagctaaaggacgaacctgatctcttatactagttatccttaatcatttttattgccacaactaacctcctcgggactcctgcctcactcatttatcgagccaaccacccaagctatctataaagcctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagttaggtctacctggacgacaacacacaataacccggacg

SEQ ID NO: 583479 - DNA, 624 bp, Homo sapiens
ctcaagtagatgaacactctaaactatctcatcaacaatacgactaatcaccaaccaaaagatgagtaagctatctactctcagaccacatgatactcagactcagatactaaaggacgaacgaggatgctctttgtactaatatctcatacatcattcatcttgacaaaaagaaactcatcaagagggcagcctcaatcatttacatgaaggaatcaactatctatagagctcgccatggcacatccccttatgagggggcgcagcggagtcgtaggctataacgcactaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagttaggtctacctggacgacaacacacaataacccggacg

SEQ ID NO: 583480 - DNA, 458 bp, Homo sapiens
tcccgacatttgtcagctagacggagtcttgcatgcctaagtgacgctagccagcaaagtgtaaatttagctagcgattgacgtacagtgaggagcaagctcagccattattgacgttaagtctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagttaggtctacctggacgacaacacacaataacccggacg

SEQ ID NO: 583481 - DNA, 880 bp, Homo sapiens
gccgagggaggtactggaacaagtgcatctgggactccctacactcttgagtgcaccagattccccaacacagaacactggccatcctgatcagatagactccagctgtgcctacgtcacaccaccctgggtatcatgggcacacagatgctggtcacccaggagctgctgcgttaactagccaaaagctttgatctgctctgacctggccgtgactcacttgaacggacatatcaacgcaggtgcgcacttctgaggcggcctcacaaggtgtcagacctgcaaatgcgttcgttttagcctacgccgaggaccagtctgtcgtctcctcaccatggcactgtcagtgaacgactaaggtgaccctggccagtgtgtgtcgaggaaagtaacttggcagggactagcagtactatgtgcatgacctacactgagagaacgcacacgcgacggaggcctcaggacgatactttcttgcatgctaatctgtataccgatgcaaggcacagcatagatgcctcacgagtcaggagtccgcatcttgaggagcatactgactcctcgtatggcttgaccgtcttcaggcactgtcgcagcgtagcctggaacggacgcccaggacgaaagtcatgaggtgcccaactagggcttctattactcccttgacggaaaccatcgagacaggttcctcgcgataaacacatcacaagattggcatgctcttgactggggcggagaaacgaagggtatcgctcgatgcccactgtaagtggtgcggaagcgttgcttcccgggtacttagagtacctaatcttgaagcagaatcaccattccaggaagggttgccatcgttccggggctcttcggggggacccccctg

SEQ ID NO: 583482 - DNA, 367 bp, Homo sapiens
cagagtagtaacacgggaggcagcctagatacctggctagacagcaatttctcaaaagcagactgcagctcttcacagggactgtcaaatgctgtcagctggagagaagaaagacaagcaaaaaacaaggtgatgaagcattgccctagaaaagctttgacactcaggaaaagattggcagagaaacaagggtctactgcaggggtagagggagggagccctgataacggtgacttcagatgggtatggtctttcagttttgctgtaatagtgtatattgacaacaacgactataagggtcctactatctagctatattaataaaattgctccatcattttattagaagaataaaccgaagggcaaa

SEQ ID NO: 583483 - DNA, 430 bp, Homo sapiens
gtctaacggcacaggtgatacactatggatccttggttgcggcgcttaaaattatgccagcaaagccaacagctccccatcgtgaggccttgcctataaaacttgcctggatatgtacataatatagccaggacgcatcaagaagcaatctgtgacaaagtctgagggtcttcctttgtgcttgccctccacactaagagaagttggcgtctccctcctgggaatagtattgccttactgttcatctgtgaactgtatttagtattaaattactctgtaccccatccgaatcagggcttctaccactgctgatgcgaaaccacaaagggacctacctgagccaccgtcctagccaagcgagcaaacctgcagggggtttggcagtggacttggtcaccgcagaagcgtgtgcgccgttaggccgatctga

SEQ ID NO: 583484 - DNA, 377 bp, Homo sapiens
cggtaccacccaggtagacttaaccacaggtagacctaatcacagggtagacctaaccacagtgtagacctaaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagttaggtctacctggacgacaacacacaataacccggacg

SEQ ID NO: 583485 - DNA, 321 bp, Homo sapiens
tgagacaaagtctcactgtcacccaggctggagtgcaatggcacacttcggctcactgcaacctcctgctcccaggttcaagcgattctcctgccccggcctcccgagtagctgggattacaggtgcacaccaccaacacccggccaattattttgtatttttagtaaagatggggtttcaccatgttggtcggttggtctcgaactcctgacctcatgatccgcccgcctcggcctcccaaagtgctgggaccccaggcttgagtcaccatgcctggctgtttatgcctagttttaaattagctggacagtccagatgca

SEQ ID NO: 583486 - DNA, 821 bp, Homo sapiens
  misc_feature (43)..(43): n is a, c, g, or t
  misc_feature (81)..(81): n is a, c, g, or t
  misc_feature (85)..(85): n is a, c, g, or t
  misc_feature (104)..(104): n is a, c, g, or t
  misc_feature (106)..(106): n is a, c, g, or t
  misc_feature (108)..(108): n is a, c, g, or t
  misc_feature (116)..(116): n is a, c, g, or t
  misc_feature (123)..(123): n is a, c, g, or t
  misc_feature (177)..(177): n is a, c, g, or t
  misc_feature (182)..(182): n is a, c, g, or t
  misc_feature (193)..(193): n is a, c, g, or t
  misc_feature (203)..(203): n is a, c, g, or t
  misc_feature (220)..(221): n is a, c, g, or t
  misc_feature (278)..(278): n is a, c, g, or t
  misc_feature (301)..(301): n is a, c, g, or t
  misc_feature (311)..(311): n is a, c, g, or t
  misc_feature (315)..(315): n is a, c, g, or t
  misc_feature (331)..(331): n is a, c, g, or t
  misc_feature (335)..(335): n is a, c, g, or t
  misc_feature (355)..(355): n is a, c, g, or t
  misc_feature (454)..(454): n is a, c, g, or t
  misc_feature (458)..(459): n is a, c, g, or t
  misc_feature (568)..(568): n is a, c, g, or t
  misc_feature (571)..(571): n is a, c, g, or t
  misc_feature (580)..(580): n is a, c, g, or t
  misc_feature (606)..(606): n is a, c, g, or t
  misc_feature (611)..(611): n is a, c, g, or t
acggtgctggtggagctgactcccgacatccatatctgcggcntctgcaagcagcagtttaacaacctggatgcctttgtngctnacaagcaaagtggctgccngntnaaaggaanatccgcngcagcccccagcacggtccagtttgtatcggaggaaacagtgcctgccacccanactcngcccgcctccngatctcatcncctcggagacccagacnntcccagtttcagctccagaatttgtttttgcacatggctatcaaacttccctgcccncggaaagtaatgaaacccagacngccactgtcntctntctccctgcccagtcncgcnccaaaacgcccacaacaccncctgctcagaaaaggcttaactgttgctatccaggttgccaattcaagactgcttatggcatgaaggacatggggcggcatttaaaaattcacacgggngacnnaccccataagtgtgaagtctgtggcaagtgctttagccggaaagacaagctgaagactcacatgcggtgccacacgggcgtgaagccctgcccagtgtaagccgtgtgnctncgccgccgnccgcacagcagcagcctccacaagcncctgnggatccactcggacgagcggcccttcaaatgccagatctgcccctacgccaccctagcaatatcaaccattaaccttccctctacacttatcatcttcacaattctaattctactgactatcctagaaatcgctgtcgccttaatccaagcctacgttttcacacttctagttaggtctacctggacgacaacacacaataacccggacg

SEQ ID NO: 583487 - DNA, 757 bp, Homo sapiens
  misc_feature (5)..(5): n is a, c, g, or t
  misc_feature (118)..(118): n is a, c, g, or t
  misc_feature (196)..(196): n is a, c, g, or t
ataanaataaaaaattataacaaaccctgagaaccaaaatgaacgaaaatctgtgtcgcttcattcattgcccccacaatcctaggcctacccgccgcagttactgatcattctattnccccctctattgatccccacctccaaatatctcatcaagcaaccgactaattcaccacccaacaatgactaatcaaanctaacctcaaaacaaatgatagccatacacaacagctaaaggacgaacctgatctcttatactagttatccttaatcatttttattgccacaactaacctcctcgggactcctgcctcactcatttatcgagccaaccacccaagctatctataaagcctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggctgatggtttcgataataactagtatggggatacaaggggtgttatgctgcatgctccctcggtatgatctcattatctatgatatcctaggaaattcgctgtcgttacttaattccaagacctacgttttgtcacactgtctaggtaagcctctaccttgtcacgacaaccacataagaacaacaaaacaaaaagacaaaaaccc

SEQ ID NO: 583488 - DNA, 722 bp, Homo sapiens
  misc_feature (306)..(307): n is a, c, g, or t
  misc_feature (351)..(351): n is a, c, g, or t
  misc_feature (356)..(356): n is a, c, g, or t
  misc_feature (362)..(362): n is a, c, g, or t
  misc_feature (377)..(377): n is a, c, g, or t
  misc_feature (417)..(417): n is a, c, g, or t
  misc_feature (419)..(419): n is a, c, g, or t
  misc_feature (427)..(427): n is a, c, g, or t
  misc_feature (431)..(431): n is a, c, g, or t
  misc_feature (433)..(433): n is a, c, g, or t
  misc_feature (450)..(450): n is a, c, g, or t
  misc_feature (453)..(454): n is a, c, g, or t
  misc_feature (459)..(460): n is a, c, g, or t
  misc_feature (468)..(468): n is a, c, g, or t
tagagattgtggcggggctggcatgagaagtgacatctgcgttacaaagtctatcttcctcataagtctgtaaagagcaattgaatcttctagctttagcaaacctaagccaaaggaaggaaagccacgaagtatgcagaagtcaaaccctcatgtcttattatggcacaagtctactataagtctaaatcagaatttacatatacaagtgtcccaggtagcagtgactcccgtcattggagtgtaatggatcaatgtttgaattaaggcctatggtaaggtaacattgctttgttgtacttttgnncaagagctcctcctgatcactattacatatttttctagaaaatntaaanttcagnagagaatgtatcacntgctgacttttattccatatttggatggagtaagttttangntagaattntgtncngtttggatttaatcttntgnnaagtnnattccttntttactggttctgactaataattctcctgtttatcttttacgggggtaacaaactgccaagctgcactggcctagttctcgtgaatatctgcccattcgctgaaagaattgtttatcaacacacattgtatcactttctcacctgtatatatgagatcgctcccaaataaacaatattattgtgaaaatagacatacccccaataaaacaacaaaaaaaacacatcatacacttgcggccccgcaaggcttcat

SEQ ID NO: 583489 - DNA, 1009 bp, Homo sapiens
ttgcctgctgcttaccaaagaggagagcaaaacctgtaagtcggtccaagtttcatgtccgaatggtctccagtcagagcagaacttcttgggttccttgatcttacccagcaatagtggacacgcggctaagtgagtaaactctcagtcagaggtgacctcacatgacaaagaacagtatcaaaccaagtaaaaaaacccggtaaacagcattcgcctgaaattacgccccgccctgaaaagaaaaggagaccagcacacaccgcgagaccccagacaaggcggaaacacaacacaggaaggcagcacaagaagcacgagcgacaccacgaacaaacagcaagggaacaatacaggcaaagaaggacggagaccgagcagagcgagacagaagagagcaaaaggagcaaggaagagacgacgggacaaggcagcagcgaccaacaagaaaggaacaatagaacacacacaccgacacggaacaggccgacgggcacgcaacacacacacgaccaaagcaaagacaccgccgacaagagagagcaaacgaccgccaagagcacaccacagacacagacgaacagaaaaggaggaacacaacccaagaacaagcaagaggcacgagcagaacgacaagcgcacagtaagggagacgcggagaacgggagaagagagaatgacccacgcaagacagaccgacccgagtagcgacgagaaagcaagacacgacgagcgacagcgaggacaagacagaaggaatgacgagaagaagagcgaagaccaccagacagaagaaacagaggaggacaggcaggagcgaaaaaacagaaacaagataagggacaaggacgcccgagaacagggagcgcgagccgactagaccagcaagacgacgagagacggggagagggacgacgaactggaggacgctgacacggacgacgacacgtgaagcgaccgcagaggacgagaccgagagcaggcacgagagaccgggcagacacgcgcc

SEQ ID NO: 583490 - DNA, 631 bp, Homo sapiens
tgtcctaaccaacctctaaagatcaaaaaaaaaggcccatttgatgtgggggtttacccgagggtattttgggggcccaaaatttatctggttctgttctttgaaggagataactaaaggaccagaaaaaccgaaggggcttaatagccgccttctgtgcaggtcctactgctttgttggctcataaaataggttttggaagtaaagttcaacacccctttttgttaaagacaaaatgatgaatggaggtccttcccccctctttgagatttgtgtgaaaaaaccggcctgatttttccaacccgggggcctgggcccagctttgagtttgggcttccaatttttaaacccctaaatggcaaggaggtggcggctcaagtaagggctccccttgtttttaaaaactagagcagcgaactgcgccgttcccttaaaaaaacaggccgttaggaacccattttccctgggttcgctttaaacaaaacaggggtaggttaatgggttcaaaagtcgctgtccttactacttttggggaagtatggaagtccccactacccaaaaatttttcaccccccaaattgggtttaaacatttttaacccttgtttgcaaaataaacagggcatttagca

SEQ ID NO: 583491 - DNA, 333 bp, Homo sapiens
ctccgggcccctgcccagggttttttcaggttttttccccccgggtttccgttgcttacaaaaccccccactgcctccttttaggttgggggtccgggtttgggccctttttgggctccatttttttttttttttttttttagaaaaacccccccccccaaaaaaggccattaaaaaaaaaacgtcctgtgagtgtaaaaaatgtccctgtttgtggttttggaaaactagttttgtagcttagggggggggtccctctgtttggggccctggccccccccgcagggctccccccgttttatgcccgggcttaattaagtgttttttccccca

SEQ ID NO: 583492 - DNA, 886 bp, Homo sapiens
cggggcggtgcagccccgccttgatgggaccaaagcgacgaacacagaggcgaccactcacggggcacaaagacacccgcgcggggagctgtggtagctcccccggcacaaacgggagtagtggctccgcagaaagcatggcgtggtacgccaggaacccgatggagccctggggccaattaccgggaaagacgaggcccgcccccgattataagagaagcggcggagccgcaaacccacaaccgaaggcaccacagggggtctgaggaccaccaaagaactacccgattgggtgaataggctaccccagcagacaagcggcgtggcacagaaaaactagatatcggcccgccagccaagtcgaagacaacccccttgaataagtgtacaaaaaaggatgctgtaacacagcgagaaagaggggcgcctcggctgtaggaagaggcctccccaaaagggtcaccgcagcgaggcgtgctaaccccccataacgccaacgcgcaccaaggaggcgcgcgcaccagggtggcagctcctctcaggagcagcgggacgagggcccgacaccgcaccgccccgtcgactacaagaggaggcaccaccgccacttgctgggtcatgaaggcgcagcaccccccgggttgggggccaactcgacggataacgcgtccccacgcattcggggggggcagtgagggcaggagcagactcagggtggcccacgacggggagggggcagcgaactcgctcacgtgaagtgtgcgcgccccggtgaaacacaggaacgcgcccactacgagcaagagatccgaatcccgcgcaacaagaaacgcgcccccaccccccggccccccgacaacaaaacaaaaaaaaaacacaccacatc

SEQ ID NO: 583493 - DNA, 755 bp, Homo sapiens
  misc_feature (176)..(176): n is a, c, g, or t
acgcgtccgctgcatacttcatggatcccatggtgggggtcttgcatctgtaagaatggaattgattttgcttttgcaagaatctcagcaggaaacatcagaaccactattttctagccctctgtcagagcaaacctcagtgcctctcctctttgcttgtacagccaatgccaaancagtagttgccaatccattattgcacctgtaatctgacacatgatattctccatgccataataaactttgattcaccaccccaccctgatatccaaagcaataaagtgtatgtaatgcatactttagcagcttcactttctgcttgtatttatcagtgcctttgtggtagtcataactacagttcatttcagacgaatcagtttactggaatggtatatcagacagtactgcttcctcatcgaccttctttgaaaacaggaagcttagatgaagcattaactcccaatacgtcaccagctcaatggcaggaataacttgctaattcgacttttgaattcttctgcgaggaagcccagtcagggcttacagtcttgctctgtgagattctcacagcagtgtatcttagtctcttcatccatggcctggccacacattcaagtaatgagctatttcggattgtggcccatcctctaaatgagaaaatgtggtctgctgtgtttggtggaggtgcacatgttcctagcaaagaacagacacattcaaaaactttacctgtttcttcactagttgaagaagga

SEQ ID NO: 583494 - DNA, 444 bp, Homo sapiens
  misc_feature (266)..(266): n is a, c, g, or t
  misc_feature (272)..(272): n is a, c, g, or t
  misc_feature (279)..(279): n is a, c, g, or t
  misc_feature (296)..(296): n is a, c, g, or t
  misc_feature (342)..(342): n is a, c, g, or t
  misc_feature (382)..(382): n is a, c, g, or t
  misc_feature (387)..(387): n is a, c, g, or t
  misc_feature (399)..(399): n is a, c, g, or t
agtacatctttattttatctctttacttctcccacccagaggaaagtataagttctttatatatccttttagaaataaactgggtataaataagcatgtgtatacacacacacacagaaacacacacacaaacacacacagatatgtatttatattccagtgtatataaatacatttatatacatgccatttatatacacatttgcatttctgttattagcgactctaaacaccatttgaaatgagccgtacccatttgtaattcngttttntgaactntccttcacttccttttncattggattgctgaatttttgcttattgatttattacagttaaganaattaacttgtagtctgtgacaggaattgtaatgctttancattntgcatttctttnttaacttgcagattaaaataaaaagttttatatagttaaaaaaaa

SEQ ID NO: 583495 - DNA, 206 bp, Homo sapiens
agccggatgtgacacagatgaactggtggctctcaaaaaactaaaaatagaattatcagtgatccagcaattctgagtatacactcaaaagaagtgaaagcagggtctcaaaaagatatttgtatatccatgttcctagcagcattcttcatgataactgacaggtggaagcaacccaagtaccctgtgatggctcaccaatagta

SEQ ID NO: 583496 - DNA, 1264 bp, Homo sapiens
ctcacgcgcaaagccaagcatcctcactaacagatacaagcaggagatcggcttcggcaattggggccactgaggcgtggcgcccgtggctgcccagcaccttcttcgacccatctcaccctctctcattcctcaaagctttttttttttttccgggctggggggcgggaagggcagattgcaaactggggggctgcgttacgtgcaggaggcgcggtggggctgcgttggaggagggggccacgtgttgagagagaagaaaagtggtggccggacatgggagggcccaaggaacctccgtgggagggggccagtgcatcaagtgtgggctgggaagtgggacggggcagtagacgcccgtgcattcagccgggtgccataaccgggggaaaacatacacggatactataccggaggaaagggcccgaagaaggggccataccaggaacagcgagagcagggtaggccacaactgggagaacagcaggcccggaacctgggatagcaggggcaaggcggggcgccgaagcacacccagacgaccctgcggatgggcaccgagagggagaggcaccacggcagctagacaaggagactgcgcactccagatacaccgaggatggacccaaactacgctcagggacacacataggggcccctgatgtagaagatatcgcgaaaatcacacaccatggcctccgagaaccacacacaaggaaatagccccactgggataaataaaggcggcaccaaaacaagacacacagacaacgagcacggcaaaactcgggacacaaccccacactgacgcggcatcccgggaacacccgacaaatcaggaagccactaggggcgaccaacacacacacaagagagagcgaacacaaagcgacagcgccgcagagaaacggcaacaccaggcgagccgaccgcggacgaggccagaagacaagaccgagcccacacccgaccccagcagagcacccacaccagagagacacagaaaaaatcacagacagcgagcaccaccaggaaaggacaacacagaaagagagaacagggaggaagcagagggccaagcacagaggcgcggacagcggcaccccccagcggagaggcgggacgcaaccaagaagcaacggagcaaaggcaggggagcgacggcgccgacaggcggagggaaggcgcagacgcgcgcaggaacgccacgacgagcaacggcaacacagaacagcaaagagaacggcacgaactgagaaggaag

SEQ ID NO: 583497 - DNA, 257 bp, Homo sapiens
  misc_feature (47)..(47): n is a, c, g, or t
  misc_feature (62)..(62): n is a, c, g, or t
  misc_feature (105)..(105): n is a, c, g, or t
  misc_feature (114)..(114): n is a, c, g, or t
ctggtcttattggtcttggttggagctccaaacccaacgtttcccantttttttccaaactnagccaggtggttcgaaagacttcaagcaattgaacatgaactncatgaattnggtttgctcaaggatcactctttggaggggcggcatttccagaattacacgttatggagcgtgtgattcaggatgaccatattccacttttaagaagaggcgctccagttctggatctgataccgtctcctttccctgaagcc

SEQ ID NO: 583498 - DNA, 257 bp, Homo sapiens
ctcggtcagctgctccgccgccggaaggaaccttatccccgtgctccggacaccccgggcctcgccctgctgaccagctgactgaggagcagattgcggagttcaaggaggccttctccctctttgacaaggatagagatggcactatcaccaccaaggagtaggggacagtgatgagatccactggacagaaccccactgaagcagacatgagatatgatcaagtgaggtggaatgcaaatagataaaccaatgta

SEQ ID NO: 583499 - DNA, 973 bp, Homo sapiens
tggtctaggaaatttacggggtccatattcaatgtaagccataatgctctaaatgttgccgagatcttcgtatgttccacattaagacttcggattctttacagggactatgcttgttgttgataacagttctgtgtagtctcaatcgacttacccataatggcggttacgcatacatcgttgtggaaagtctcccacgagagctaacgatgaaacacggacctctcaccttctgatctccctgtgccgtcctctaagaataacgcgttttgcatggatctacacactttgttcacccacgagttttccacttctgccctttgaagacttggtgaacctccctatgggtctccctgtgggctctgccactggacagaacggcctcctagctctctccgctctgtcctggtagcccttcgtcgataggctttgtgttgcctacgtaagtgctgtcctggcgtgtctgtggctgggccccgagggtggaaacgtattcgcgtctccccgtctcctccttaacctgggactctccgggtcttctgagtatttgcatgctgcgggtgtctaggacagagttgcttccactagaagcctggagacatagcatctttgatagcataagccagattatctgtgtgtgcaggtggtgtcgcgtgtagcgtgcatgtgtgaatcgtgagctagtcatacgttgagatgtgactccacaaacacctcgtatatagcgagcatatacaaccaatgtgggtagacctaggtgttctctacagaggggtgtgtgtgtgctgatgcgagcgcgtgtgcctagaatatatattactctcagaggagattctgttgcgatttgaataggaatttctttatgtgattagttcgccccttccccacccctgaccagatgttaagcagctatgaaacattctctgtactagttctggtctccttttaacgcacgggggctctgaaccctttt

SEQ ID NO: 583500 - DNA, 86 bp, Homo sapiens
tggggaagagacgggggtctagcattggttccccaggtggggtatagaactcctagccctcaatcactcccaccctcacgcctccc

SEQ ID NO: 583501 - DNA, 251 bp, Homo sapiens
  misc_feature (16)..(16): n is a, c, g, or t
  misc_feature (76)..(76): n is a, c, g, or t
agatatgcgacatatnactgtctcatcatagattcttaaggtatcagggtgttctggagctgtgatcctcttggtnttaagatattgcactattccctttgaaaaaaatcaccatattatataaatggggttaaggttctgcatcaggtttttgtactgctgctggttttaagactcaggctgctgagtgcccagcctttgcaagaatccacttcaggaataatgacatcatgccttaagcggagggtacc

SEQ ID NO: 583502 - DNA, 114 bp, Homo sapiens
tcactccaatccctgcctccatctccccatgggcgcctgggtccctgtggttttacattatcttcctctgtgcatgtctatctcagtattcaaagttcccctttttatcaggac

SEQ ID NO: 583503 - DNA, 318 bp, Homo sapiens
atcccaactctaaccctatggttaggggctatcccccctctgtttgcagcagtttgggcccttacacaaaatgacatcaaaaaaattggagccttttccccttcaagtcaactagggctcataatagtttcaatcggcatcaacccaccccccctagcattcctggacatttggacccccgcctttttcaaaaccatactatttatggggtccggggccatcatccccaaccttaacaatgaacaagatatttgaaaaataggagggctactcaatgaaaaaccatgataattttttgtatataaaataaacctttga

SEQ ID NO: 583504 - DNA, 391 bp, Homo sapiens
cgccaaccggcgccaggtggtaagtaccaggaagtctgcagagttcgccggtggtatctgtcagcacttctggggtgaagccaactcggatcccacgcttcttgatttcatccaaagccaagtggtcaatgcccccacacatggtgctgatgcctttgagattggcccttacagcatccaggatcttcgtgtccacgtggtcgaagagaagccagaccagcccgtgggcccccgccacacctcgctcaagctccttgacaggaatgggctcatccaagtcccagtgctccacctcacagtctgccgcgcgggagagcgcgaccctaccctcggcgggtatcctgcgggtcacgcacaccctcatgagtcgccgcggtctcatccacagtgc

SEQ ID NO: 583505 - DNA, 245 bp, Homo sapiens
tttttttttctcctatttatctatcatgtcactggcaactgatcaagggaacatacaaaacaattccaagtgccccagatgtctctcgctggtgatcctttctggctaggcagtagtcattttaagaacaggtctaggtcatgtagtccattctaaacagttggacacaaccattctcaattcccttaaaatctcttattgcatcttctatgatttaaggggcaaataaaaataacaaaatagat

SEQ ID NO: 583506 - DNA, 1708 bp, Homo sapiens
tgggtctgggaattggccccaaagggcaaacaggttttattgggccagcagtccgggaaaatatcagcggttgggacttgtggccacacgcctccagctctcgctccttctctttcttataagtggcattaggacgtttcagaggagagccctttgggcagcatttgatgtgagcctcattctgtgccgaggcactctcagacaatgtggctctataatgtgttctccgagaaggcgcagcgcctctcaacagaagcgcgcctgtgtgtgcaacaagacacgcacaagagtgtgcgcctgtggttctcacccacggcgcgcgcagaggggcggagacaccactctcacacacagcgcctgtgtgtcggctctctcacacaggtctccccgggcggcgcgccacaatgtgcgtgtgtgtggaggtctcctctccggcgggagacccccccctgtgtgtgtgatgtgatgtgcgggttctcaccccatgagacccgctgtggcaagagggggatctctctcgccactgtgtgtgaccgccagggtgtgtctttgtgatctctctccgaaaggcgccatgtcgtctgtgtgaaacagaattcgcgcgacacacaggctccattgtgaggctctctcttgtgtgccccggtatgtgtttagtcgcggggcgccgagggtgcacttctccatctccagtgcggaggagcgtctctaagggagaggggcgcgcgcctcctcccaacacaacgtgtgggcgggaccccctcctggaagagcttcttttttgacgcggggaagaaaacctcctgtttgtgggcggcgggggctattacacccgcggcgcctcctgtgcccactcttgtggtgcgacgggcgcccaggggggtacacctctggggggcctattaaaatctatctctccctcttttccccattgtcgggccgactatgtgtgcatactcccctcttgggcgaggggggggaccactctgtggttccctattctgtggtattctctcggcgcacctttttctccactcgcggggggtgcggccccccccatttttttcccccccctaaaagagagaaggctcttttggaagtcggttcccgggggggggggctctcttctcttctggcccaccacacagccggcttcttagtgtgtgcgggctctgccgcttgttgtgtcctcccccccccaactttcgcggggcaccatatccctcctgtggggaagagaacaacccacccaaagggtccttaggagaacgaggcgtcaccttccttggggtgccccaccctccccgggcgggtgtggttgaagagacaccccaacgcgggctgttaaaaaaaaaccctgctggtggggttggcggcatcgcctgcggtggcgggagaacgtcgtggtggtgtgcttccgtcgggcgcgccgcggagagaaaccctttttagtccggcaacaacacctctatctccgctcggggggcgttgtttggacagggggccccccccagagagaagaagggtggtggcggcccgcccttatttgaggggcgcgtcctcacacaaaaaatctccctccgggcggtcgatcgtttgttcttcccccgccccccgcgacagaagaggagaacgcaccatcttgtcgatgcttctgctgcagtagagtgtagttgctgccccccgcctcgcacgctggtacgcttta

SEQ ID NO: 583507 - DNA, 269 bp, Homo sapiens
ttcggtacgctcttgactcagagaaggagcgacctgctcagtttctgcctacttctttcccttcggcttcatgtgtactaccatagttctcatcgctttcctctgtgtgagacacgcaattagggaaaagaagctctggaagcccactttgccatctctacactggtccaggtccttcattattttgtgggacagccagagggtctttttgattttccaaaaatccagggaactccttttccatgagtactcctcaaaggatttagcga

SEQ ID NO: 583508 - DNA, 868 bp, Homo sapiens
ggacgcccttccgattcactctccgctcccgttctccggctgtcctcccgttcctgctgcccgtgctgccaccatgacggaacaggccatcttcctttccgcctgagacttcgtatgaggacgggggtggaatcggcctgtctgaacgatcttcgcgatagcacagtgcacagtggacatccgtagtcagagaccgaggtctaagctgtgcatgtcttagcagtgtccaatgctactgccaagactaaggcgagaagtaccgcctgcctggagcagagacaggttagcaaagggacatcgcttggcatctggacatttgtcctggccactcacccaaggaagcaagtggttgttgactgtaaccttcttggagggagtcaatacactttgtgcaagcagattcaacttaccgcatatgcttacctccagacttcaaatcgcccactgtcaaaacgttcaggccttttccatagagtgagttacatggtagcgacatcgcagagagatctttttcccgttgtgagtgcggtgccggcttagttagccatcagccatcatcgagcttcggtctgtcgttgtgagggggtaacctttcttgcttgtggagccagatgccttgtgcccgttccctgtcctgggtctgcaggtgtcccgcagtcgggcaggaacccagttccctccttcatgccctttctgggttgtttacctcccgggctctggggatttttcggtgacatggaaaatctcgctgcggcgttgggcgaataccgtccaaccgttgggtgagagttagcgatgaggaggacacacgtacgctggcgaaggctccgcaagatagctcgtgggggttaggaccctgactttgggg

SEQ ID NO: 583509 - DNA, 434 bp, Homo sapiens
tttctctctttctctctttctttctttcttagatgaagtcttgctctgtcgctctgtcacccaggctggagtgcagtggtgcgatcttagctcactgcaacctccgcctccccggcccaagtgattctcctgcctcagcctcctgagtagctgggaccacaggcgcccaccaccacgcccagctaaatttctgtatttttagtagagacggggtttcaccatgttagccaggatggtctcgatctcctgaccttgtgatccgcccgcctcggcctcccaaagtgctgggattacaggcgtgagccactgcccccagccgagaatttctctttgcgtccttcctactttggggacttcgaatggtgggaaagagttatcaaggccaaaataaggaattcaaatgaaaacaaaacagaatcaaagaagaaaaaaca

SEQ ID NO: 583510 - DNA, 1102 bp, Homo sapiens
gagcttgtcgacgctgtcgcaggggtggatcctgatgctgcctgaagcctgccgtccatgctctccacgcgtgggcttctctaattccattgtatgtaagatactctcgtggcctagcctgtccttggaacccgcatataacggtgctgtggctggttcacggccgtgactggtgcctatgtggcgcgttaacatgtagcaacatgaatgctggctgtggtgtgctgtgcagcatgcatgcaatgccatgacaagtctcattccctgaacagctgacgcaacacatagtgcgaccctgaaatgtgcctggaaacacggctgtacttcagcagcacagaattggcgcagcacgcatcatgtgcatcatcgcagagcgaaatgctttggcaggcctccttcacgaaagcaaagcgcattgaggcacagcaaggttcgagcgaagatgaccaaaagggaccattgcaaggcaacgtcagcaacacaagcagggcaacgcacaaagcgaaggcagccacgaaaagttgcgaaagggaccattggagccggaagaagcacgaaagccaccaacgtacaacgggacactggacacggcgccaagttagacaaccacggccgaccgagggagaccacacggacggcaaagagcaccgaaggacaacagaccacgggcgacgcgtacgaaaagccagacagagcactggcaaccgcgggacagcccggcatccgaaggcacagatcaggcagacatcagacaacggcagaaaagcgaggaaacggcataccaggcaaagtcacgtctaacaatccaggaaaacgcacagaaacgattacaaaagcacaagatgccacaataccaggaaggcaaacgacgcaacaggaggacttggcccgtgacgattaagacaatcaccaaaatttgacaagcagcagaccacggacccgagtaagccacggaaacaggcgcacagaagtgattccgcagttgtcagaaagaaaaggaaacaaaaggcagagccccagtgagacacggcatgcaagccccgttaatgggacgacaatagtatcaccgcgtccccttgtaaggtggaacaaaggaagacat

SEQ ID NO: 583511 - DNA, 456 bp, Homo sapiens
ccctttaaacccccgccagctcttgcctaagatcttacaaaaaagactatttggactttcaaaaatgtcaacgaccgcccttgaggcaatcttcaaagcttgtgtatttaaggactggtagaaattagggaacaaaattaggttaaaggtttttgttctgggagccggaaggcaaaaattggggtgttcaccaaccccataaaactttttctttttttgcaccctcaaaaggcctctctctaccgaatgtaaaaggcccaaaaatatttttccaaaaatggtttttaccttatagcccccctgaaacttaatgcttatgttggaagccgggtcatcataaaaaaaatcaatggatttagcccccccaggggcccaaaagggaaaccattttctaataattctggaccatttgaccccttaggatttttggagttttaaaaaaatgacccaataaat

SEQ ID NO: 583512 - DNA, 785 bp, Homo sapiens
  misc_feature (496)..(496): n is a, c, g, or t
  misc_feature (718)..(718): n is a, c, g, or t
ggtgcgtgctcgcggtgggcggtggcggcggtgcctcgcgaaggttcgagatccgtcgcgtgcgggaggcgggccggatcttgcgcagggtcggtgtgggcgcaggctgcagcgccgcgactcgtgcgggtaggcgtctgcgctcggttggagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaaagagtacgtgatgcccttacagctgaaaaatccaagatttgagaccaggaaatcaagaacaagatgcaacagaaatcacagaagaaagcagaacttctttgataattgaaaaaaccagctgctgtggtttgctcccaatttacaaacgggctatacggtgaaaatcagtaattatggatgggatcagtccagataagttgngtgaaaaatctacattacctttaactggagtccatcaagttcccactgagaatgttgcaggtgcattttcacaagagaggtcatttggatctttgtggtaaaggaatctaaatgggaagagttactcccatgatgtgtgaccaatctcttggaaacccaatctctggtgggaagggagttcaaaaaaagtcagactggtacagtcttatatggtgtgcaagnaagtgggacacaccaggtggattactggaccaggttgaaggctgcaagaaagagagcctttttgatg

SEQ ID NO: 583513 - DNA, 1362 bp, Homo sapiens
  misc_feature (509)..(509): n is a, c, g, or t
  misc_feature (1362)..(1362): n is a, c, g, or t
agcggatcgagatgggcggctgggaccgctctcagccccttcgaggccgtctatcctgaatagacctcgccccgtctgctacacccaagctgatggattgctctcaaagtcgacgagagaggagaggccatcatggatggcatagacgtccaggattactcacattagtggccgttctcggacagggctcgatatgttagctgtggtcgtctactccagggaatgctgatgggattgctcagcaaacgcgtatactggaggctttatgtcacagtgggggacgtactacgatcgttgtgcagatagctcgagggaagacgtcagtcgctaggggcatcgcacgaggcctgtgcagggtcggactgcaagtctcccagcggcgcatcaacttgtgggttatccctaagccttgtccctcatacaccgatgatagaagattggggttcgttggacggcaatgcttggaactccatgaatggggaattggctctgcatagtagtgactagcntggaagcggtgaacaattaggggtgtccctcgactggttagcccggaagcataagatctcggaggatcgggtggaacgtcaatgctaggagtcccacgcgtgtcgtcaatgcccatctcgcatagaggtggccattagcagtgcgttgatgcaaagcagtaatccctgtgctgaacttggtaaatccttgtgaataggctatctgcaaacttctttgggtttacccaaatttttttagctttttgacaaggtcacaggaaagttcccagagccaatgactaacacacaagtccctttgggagaaggggtgtccagttcacttacgccttcaagttcggtagcctcaagggtattcaccaaaacccaagcagttgtgccaagaacctttctcccccattggccgttctcaacagctaaacattcttccttgggcgttcagcccaagatgattgggggcggaacagggagaatataacatgggtcctatactaaactcactgtgattttgggaataacgttggattcgttccccccttttatgggtcatttactctccccttttgggtgggccagttcccgtttcacacagtttacccctttacggtcctggaaggggaaggaccccctttgggcatgtggggacctgggctgaacggcggaatactccccacaaggtttcccaccagatatacttactaggacaagcacccacccagtgggaatgaatgtgatgtggacatcggagtacagggcgagctgaggcccctaaatggaaaacgcagcaaacaacttaaggggggaggtgaaaacacacggcaccgagcattctatgagaaaatatagggcgggccan

SEQ ID NO: 583514 - DNA, 439 bp, Homo sapiens
  misc_feature (439)..(439): n is a, c, g, or t
ggtgcgtgctcgcggtgggcggtggcggcggtgcctcgcgaaggttcgagatccgtcgcgtgcgggaggcgggccggatcttgcgcagggtcggtgtgggcgcaggctgcagcgccgcgactcgtgcgggtaggcgtctgcgctcggttggagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaaagagtacgtgatgcccttacagctgaaaaatccaagatttgagaccaggaaatcaagaacaagatgcaacagaaatcacagacgattgcacagcctcttgataatgttatggatcggatcagtcagataagtctgcgtgtctcn

SEQ ID NO: 583515 - DNA, 403 bp, Homo sapiens
ctcattcatgaactctaccagcccagagacggcttccagctgagccttggctctgaccttttcaccgacctggcggtctacctgcgggacacctctgtcagtgccttgacgacgctgtacttggcctactctgtacctacctactctagggcctctgacggggccatgaagcacatcaatgatcatgcggcagaccacacacagggcctgatcgtggacttgcttaagacccttgatgctatgcggacgtgagcatggtgaatctcatcttgtttgctaaccttgagacacgctctactcgcagatgcacccaagatcgtgacttattcgtgacctaagagactgaggtgcggtgacccatgatgagccgcgctgatcagcatgtctccttctgggccggcct

SEQ ID NO: 583516 - DNA, 575 bp, Homo sapiens
gagactccctctcaaaaaaaaaaaaatacaaaaaattagccgggcattgtggtgcatgcctgtaatctcagctatttgggaggccgaggcaggagaatcacttgaacccaggaggcagaggttgcagtgagtcgagatcgtgccactgcactccagcctgggtgacagagcaagacttggtctcaaaaataataatagtaaaatgttacattgtgcttgaagttttaaattactcatttttattaatgaagcaaaataccggtagtttagactttccaagagttaactatagtttacaaaatcttttttaagcaaaaatatgcttgatatattaagcagaaatgtggtatattaagcaaaaactgtcacaattcagccaattataaactgttccttacagacaggtgtacttgaagctctttagggatagttctgcagaactgtggctcattgaagttggcatctaagaggaaaagtgcgtaactcggtatgccttataaatttattaacaggattggcaaacttacacacttagcattttagggccagtcccttacaaaaaacacacacacaca

SEQ ID NO: 583517 - DNA, 597 bp, Homo sapiens
cctttatttatacagccaacaaatacttattactaataagctaccccagcctggcaatatgacgaaacctcgtcgctactaaaaatacaaataaaaattagccgggcttggtaggagggcgcctgtagtcccagccactcaggatgctgaggtaggagagtcgcttgagcccaggagacagaggttgcagtgagctgagaatgcgccagtgtatcccagcctgagccacagagcaatactctgtctcaaaaagaaaaaaacgtaataataataaagaaggaaagaatagatgatagatttgaggacctgctctaccaaatatcagtactacggcaagtaaaatttagtgtggcattggtgtggaatagactaaccagtgaaacagactaaagggcttagaatcgtagtcacacatgtagggaaatgcagatataaaacagaagacattgcagataaatggcgaaaggagaatggagagacaagtgaatatccacatgagacaaatgaaatggtaccttgtatccctgccttacgcgaaagataaaaatttccagtggattaaagacctaaatgtaaaagacactttgaaacctaaga

SEQ ID NO: 583518 - DNA, 140 bp, Homo sapiens
acccgcgtactagctgcgggggactcgacgaatccctccaggtcgccgagaggtattacaggaaatacaaggagctgctaaagtcctaccagtggaagatgctcaacacctacctccttgctggagcagactgaacgagc

SEQ ID NO: 583519 - DNA, 838 bp, Homo sapiens
aacggggtagggatgctccaagaggaaaatcattctacacaggggactgggtggaaaccccccccccaatcgtggctaacccaaggagggacagctggcccgcagtcagcaacaatgggcaagggacagcacaagggaatagaaaattgtcgtggtcccgccgtggacggtctgtttaatctcgagaggttttaaacatgcaggcaagctgactgtgaaggccaccgtgtgtccgagatgttacacaacaagtccaagatgacagctggtcccacccacccaggtcctctaagcacatactctgcttttctgtcaacaatccccattttggggaaaggaaaagtcatatttattcctgcacccccgttttttaacgctgttctccccggtgtgccccctcttctctgggtgtaaaaaaggggaaattgggaaaaaaattaaaaataattctccctttaatggtggggggctactggagaggagagacagcaagtccaccctaacttgttacacagcacagaaccacaggtgtctggaaaatctcatcttcgaacctagagaaataggtgctataaacaggggattaagccaaattagctggatgctatagatcttttaattgtcttaatatttttttctattattaaactacaggctgtagatatttttagttttcacaggacttctatcattttaaactgacttgtatatttaaaaaaaaaatcttcagtaggatgttttgtactattgctagaccctcttctgtaatgggtaaagcgtttgattgtttgagattttctgtttttaaaaaagtagcacttgactttttgccacagga

SEQ ID NO: 583520 - DNA, 676 bp, Homo sapiens
gcaagcagccgtaaaattccaaacgtggtttgccccctacggcttccggtaaaaatgggctggccagctaaacagaagggttcgatattgagggtgaggccatctgctgctcgaaaggatcaccaaaatagggggtgtcgtaaggttgtgctctggagcaaaaggccaatcttaagttgcaggccatttgaagttatcatggtgcttgtggcagccggaccgcaaggcaaaaggcttatgatggcatctcagtccggaaacttgagtctcggaagagccctgtagggttcaggcgcacagtaaatgagcccacgtctgtgtctggcatctattagtcctaggcttcacagggttatggcgatccgggcagtgcattatccgttctcgccatgaggaaggacaccgtgtatgcgactcggttattacgctttgataacagctgtgctgtggctgaggtatggtgtgtacgtacaggtggcttccctccaggcttgggttcagaagacgatagttgagacctaatgcaaggctgaccggaagcccttgcctcaaagcgtcatttcggcctggaacagggcatagtggacggcagtggccagcagtgtatgccataagacggagttcgaagcgggggggtgccaggcctgcatagcttagtcaatcaattaagagcttt

SEQ ID NO: 583521 - DNA, 1019 bp, Homo sapiens
  misc_feature (113)..(113): n is a, c, g, or t
agacactgaccttcagcgcctcggtcagcgccatggcgccctccaggaagttcttcgtggggggaaactggaaggatgaaccgggcggaagcagagtctgggggagctcatcnggcactctgaacgcggccaaggtgccgggcgacacctgagtgttgttgggtgctccccttagtgcctatatcgattcgccctggaaggaagctagatcccaaagatttgctggtggttgcgcagaaacgtgttaccaacggttgacttactggggcgcttaccactggggagagcatcacgccgtgcatagttgaatcaaatgagttgcggaacgccacagtgttgtgttggtctctgtgggggacacatccaggaaagaggaaggcgaattgtctttgggggaggtcagattgaccgtttgttgggggcatgaaacggtggcccagtgctctgggaagaaagaggacctcggaagagaaattcggcttggcatgtagggggacaaaggctaagatagaaaggggaagcgtctggcaatacatttgaaaaggggtgtgttatcgagaggcaggaacaagggtcatcggcagatcacgtgcgacgacgatggcgcgcaagggtcgtcctgggacccaatgacgccgtgtggtggcgcatgggtacctgtgcacagatttgaacaacgccaaagagggccaagggacgtgtacccgaagaacgtccgaggattggctagaaggccaaagggtcactagtgggagggataagacgcaccggtatcatatatgagcgctctgtgattgacacaccttggaagatgtgcacaccagcatggtggtgatgacccttggggggggggaccaacagacgaaatgtgagtcacagggacaacggcgccataatttcatagctttggagcagggaaaggaaaaccaaaggaccaaatagcgaggagacgctggccacaggcctagtgacacggggagcgccccaatattggacaggttcgcgagggagttcctagg

SEQ ID NO: 583522 - DNA, 109 bp, Homo sapiens
gagaaacactgggcacagggggaggtaactgcagtaagcccagcttggccctggagtccacgcggattttcaaagctggtcctctaagagggggctggacccacgctcc

SEQ ID NO: 583523 - DNA, 312 bp, Homo sapiens
tgtacccacatgctgacttaccaataacaaacagttgataaactcatttgtatgttatatgctatatattttttttcttttttgagacagagcctcgctccatcacccaggctggagtgcagtggcacaatcttggctcactgaaacctccacctcccaggttcaagcgattctcctgtctcagcctcccaagtagctgggactacagccatgtaccaccacgcctggctaagttttggtgttttaagtagagacagggtttcactgtgttagccaggatggtctcaatctcctgaccttgtgatccgcccg

SEQ ID NO: 583524 - DNA, 162 bp, Homo sapiens
attgtgtgaaggagtctggctgttcgctaaaggtgacctagcgctcagatagagtctattgcagtctatcatacgctggcagctgctggatcatcatcagagggacatgggtcattcagtaagctggcattatttcaatggagtattatttgtgtggtagct

SEQ ID NO: 583525 - DNA, 1011 bp, Homo sapiens
gctggcgctgaggaggcggcgggtggctcccggggcgtttgatcggtgctcacccgagcccgtcgggccatcgcggatccaggccctgattgtcgtgacctgccccggattccccgcgggccttcctagccgccatggacggacggtgtctatgaacccccagatctgactccgtgagtgagcggatggcagctggctgaacatcctgtgcggctggtcgcatgagctgttggttggatgattcagtgcctgcgaggatcgagctcagtgaagccatgatgctgaagtgtacggggacctggagtgccaactgaccgtccagaaaagaaccattgatgatggtacacctcgacatggaattggccattggaacacgcgaacgaaactctacacacgagctgagaccaccaaggacaagagagggatccactctcgcagcgacgattttacaaacgtgcaccctgcgttgatgtgtaaacaacaacatcccacgtgagcgtaagcagtgggtacctagcagaaacccttggttagcacatatgctcaggaccgcggaccctcaataaacgagagaaagaacgacaatgcgaagaaccaccgaaacaatgggtaagaacaccgagaaagaacacataaacacattggaactgaatgcaacgaataagacgtttatgactggaaatactgtacatcgaagcttcaatacgatcccattaacacgtaatgaacgcgagaagggaccactcacaactggcagtcaatgatcaaaactgcaacccatcgcagtcggcaagcgacagagaacaagaggacccacacaaaagggagatagaacacatgaggagatagacaggcgcaaggaacaagatacagaagcaaacaaggacaaagacgagcacagaaagcagtaacaccaagagaaagtataagaaaagaaagtgcaaagagcacagaaaagcgagtcaagaagacaagcaacaaaacaaacaagaaaaagaaaagacaacgaaa

SEQ ID NO: 583526 - DNA, 295 bp, Homo sapiens
aaaaaaatttgaatttttccaaaacgggaaacttggggggtttggtttatatttcaagcccatttttttttaaggcccttgataaaaattttttttttccccacccaaaaaggaaatttttttgtttttgccattttcagggggtttcattggttttttaacttttcccccttgggggttcccttccagttttttcagcccttttaacccctccgggttttacattttccccacccaaagtttttttgggtcttttttttttttgtaataaaccacccgtaaattaagggggtta

SEQ ID NO: 583527 - DNA, 326 bp, Homo sapiens
  misc_feature (10)..(10): n is a, c, g, or t
atgtgcatgncccagttgttcagcacccatttattgaaaagatgattccttgtccattgaaatgcctttgccccagtatgttcagtgcaaagtcttttttgccagcccatctatagatacataatagtatctctgtggttaattcctttattttaaaatttaaaatctgataaactttaaccttggttattgctttttgtcgtgggacagttgtaaaccttttttggcttttcttttaccaataattctcatactgcatgtgctaaatgtcacaatccccccctttctgtttactttgaaagtgtgaaaatttttattctagtttt

SEQ ID NO: 583528 - DNA, 1215 bp, Homo sapiens
gtctagtcatgaggagctccttagcgaggcgtacggatagtcactttacgccccggcccgtggtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacaaacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatacttatttctaagtatttatttcagcatttatgaatttgcaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaa

SEQ ID NO: 583529 - DNA, 717 bp, Homo sapiens
cttttctgaaacaagatagtcacttaaaattttatttaaaaataaaacaatctctagtaatgctatcttaagcatattatttgtgacttccattgcagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatacttatttctaagtatttatttcagcatttatgaatttgcaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaa

SEQ ID NO: 583530 - DNA, 443 bp, Homo sapiens
cgtggacgtgattcgtaaagctgaatatacacccagaacttctacttgggaaattgcgacagaaagtgcatgtgttcaccactgattaccgtgtgtgcatcctctacagactcctgggagacagcaagatgtccttcgaggacatcaaggccaacgtcacagagatgctggcaggaggggtggacacgatgtccatgaccctgcagtggcacttgtatgcgatggcacgcacacctgcaggtgcaggatatgctgcgggcagaggtcttggattgagcggcaccaggcccatgtgagagatggccacgatgctacagctggtcccccttcatcaaagccagaatcatgtgcagcacctaacgacttcaccccatctccgtgacccctgcagagatatcttgtaacaatgccatggagactacgagactacatgattcctgcca

SEQ ID NO: 583531 - DNA, 154 bp, Homo sapiens
tcacaacattttattgtggtaaaatatcacaccaaatgtgtcatttaactgtctatatagttcagtggtattcagtgccttcataatgttgtgctaccaacaccatcatccagctccagaactttttcatcttctcaaactaaaaatctgtact

SEQ ID NO: 583532 - DNA, 296 bp, Homo sapiens
  misc_feature (276)..(276): n is a, c, g, or t
  misc_feature (281)..(281): n is a, c, g, or t
tttaaaagaaatcttcgaaattatcatctcgtttcacgttaattaactgagcccgcggtcacaaagcttcgcaacggcaaagcaaaagcaagattcatgcctttcaactttctcactacccaagtagcaccgcaagccgaatccgcaggcagtgcaacattgtttgctactcttgcgcagaacaaaaatgctaatcactgcaactgctttacatgaaagtgcacctagaaagacttcaaaacccagaggtacattaactttccaggcaagttcctnccagnctgtgtgccacgagc

SEQ ID NO: 583533 - DNA, 409 bp, Homo sapiens
tatatatcacacatatcatatgtatatatcatacatatgtatatatcatacatatctcatatatatcatatatatctcatatcatacatatacatgatatatatatcataccatatatgtatgatatatattatatatgatatatgtatgatatatgtatcgtatatatgatacatatatcatatatatattatcaaatgttatatatatattttatatatatatatatttttagtttttgtagactaggtctcactttgagaccagcctggccaacgtggtgaaaccccgtctctactaaaagtaaaaacttagccgggcatggtgatgggcacctgtaatcccagttactcaggaggctgaggcaggagaattgcttgaacccaggaggcagaggttgcattgagcc

SEQ ID NO: 583534 - DNA, 213 bp, Homo sapiens
  misc_feature (130)..(130): n is a, c, g, or t
  misc_feature (134)..(134): n is a, c, g, or t
  misc_feature (152)..(152): n is a, c, g, or t
tggattgtctaactcatactggagccacactgaacaaaaaaattaccccctgcaatctactcttaactgatagtcgctaactttggttatgtgtgtctattcagaatattacattaattgatttctcaancaanggtcctttctgaaatggnatctatgattcagctattcaaaacctaatgaaggtggtgactattacaatgtggagaaatc

SEQ ID NO: 583535 - DNA, 569 bp, Homo sapiens
  misc_feature (295)..(295): n is a, c, g, or t
  misc_feature (312)..(313): n is a, c, g, or t
  misc_feature (344)..(344): n is a, c, g, or t
  misc_feature (355)..(355): n is a, c, g, or t
  misc_feature (438)..(438): n is a, c, g, or t
  misc_feature (467)..(467): n is a, c, g, or t
  misc_feature (523)..(523): n is a, c, g, or t
ggtagagacagggtttcgccatgttgcctaggctggtctccaacctggtctcctgggctcaagcgatccgcccgcctcggcctcccacatgctgggattccaggcgtgagctaccgcgcccggcctatttacttttcttactaagctggggatcaccgtcgccctcggcttggcaggaaggcgggggtgcaagaagaaaagaggtacagaacacccagaggtgccctcgattccgtcttgcacttgccttctcccaccgtccagcaataaagcgagagaaacaagtgcaggaaantgggccgggcatcatgnnagaagccaaaaagacaagcctggggagccgnggggattccanaagcgggggctcctcttccgcactttggtagctgcgttgctccgttccatgccctgccttcagccattcctcctggttaccangcaaaaaggaaaacacctttgaagctggncaaggagtaaccagcgttctgtctactgggaatggggtcttggctctgttgtctanggcttggaattgcaacggcatgatcttcggcttgcagccccgtctt

SEQ ID NO: 583536 - DNA, 114 bp, Homo sapiens
acaacaactccatgtatgacctcaaagcctccccaggtggactcccctgtggggcactacaaacggcccagcagttgactcaagaggccacggtggcagtggctggtcctcatc

SEQ ID NO: 583537 - DNA, 712 bp, Homo sapiens
  misc_feature (5)..(5): n is a, c, g, or t
  misc_feature (11)..(11): n is a, c, g, or t
  misc_feature (14)..(14): n is a, c, g, or t
  misc_feature (105)..(105): n is a, c, g, or t
  misc_feature (122)..(122): n is a, c, g, or t
  misc_feature (135)..(136): n is a, c, g, or t
  misc_feature (143)..(143): n is a, c, g, or t
  misc_feature (149)..(150): n is a, c, g, or t
agggnttccgnttnatgacgcctttaccctacgcatgcagcagtactcttcgatccaccaaccatgtgccgcccccaacgcatgtgccgctccctagtaatactngtttctagggagcggcncatgcgttgaacnngggggantttttnnatatttaaagtctctccccataaaatcctatattttaaatcttaataacattatcctttatttcttttctttatactttaatttttctaaaattttatatctatttctcacaaatttcttttttttcttcacattatatttctctacttttcttttttaaaatcatttctactattattttcttaacttcctctttttatatccaatattttacatactttaatataatatttagtattattctatttatcttactattatatttcttatactaccttttttattctttactttttatttctatttaattatttcttttcatatcctcttaaactatatctaattcttattcattttatactttctctaaatttatttccttctattatattttttatttttttaattttctatcaatactttttttttcttatttctttcttcttcctcttttcttacctttcattattttactcttctttattcttttattttttttttctaatttctttattttattattttatatatatttatttatttattttttttttacactacc

SEQ ID NO: 583538 - DNA, 545 bp, Homo sapiens
ctagcactaatttagacaatgaagctatgcagcaagattgtgtatttgagaatgaagaaaatacccaggtaaggaatgtcaaaaatatgtgttagatgtacaactttgattgcttcatgtgtttctttgatgccagaagttatagttcagtattttgctgatacacttaattgtctcaattataaatccccaagaatatacattgtttcagagtttaggaaacatcactgggtagagaagtataaaacaacttattggctgggtgtggtggctcacgcctgtaatcccagcactttgggaggccaaggcgggcagatcatgaggtcaggagatcgagaccatcctggctaacatggtgaacccccatctctactaaaaatacaaaaaaattagccgggcgtggtggtgggcgcctgtaatcccagctaccggggaggctgaggcaggagaaaggcatgaacccaggaggcagagcttgcagtgagccaagattgcgccattgcactccagcctgggcgacagagtgagactccatctcaaaaaaa

SEQ ID NO: 583539 - DNA, 204 bp, Homo sapiens
tctagagtatccccgcgcgccccagcttctcaagttatgataattatttatattactgctgttatagaaatgatctagacctaccgactattggatgattcatgctcgtgtactgtcatcggggttatctcgagttacgtccggtcattccggataggccgataaagtgttttgtgttgatagtttggataagctttggcgccg

SEQ ID NO: 583540 - DNA, 795 bp, Homo sapiens
tggtcctcttaaaagttatttataaaccagtttcataggccacaagggatataaaagggatctatgttacagcctttaggggaaaacaggcagggaagcttgaggagggccaaaagtgagtctagggcctggggggcgcattcccgggggagggggccctcgaatcccagggggaaggaggccgaatccccggaggggggcattgcccattggagagttcccttctttccgggggggatctccccattgggggggacccatataggaggtctcaataccaggatggtgtgggcccattcattgcctgtggaaggggggtgtgccacccatggggaccaaaaatagggtgggggggaagggacccccaagggccacaggggtgggtcaaacgtgggtctgtggagccccccgggaaaaatagcgtggatgtggtgagaaaaaaagtgttgaaagagagagtgtgcaaaaaaaagtataacattcaataaccaatgtaggggagagctaaacataaacctgtgttagtgagaaatttagggcccctgaaaaaccacacaagaggaatagtgagtcccaaagaaaagtttcctgtgaaagaaaccccggtgggggcaaatgtggagaaaaccccccaagctgtgggagaaataacactacgtggaacaaggaaagactccgtggagaaaaactccctgtgggggacccccggggtgaaagttctcccaagaagagtgtggacaaactgcgagagacaatatcacagagaaatccataggagcaaaggagagagcccca

SEQ ID NO: 583541 - DNA, 112 bp, Homo sapiens
  misc_feature (1)..(1): n is a, c, g, or t
nacttcctggttcaagaaggtgacatttttacaggtcatctcttcaggcaaaatttcttataggggaaggagtctctgcccttgctttaaggtattattttagataggggtt

SEQ ID NO: 583542 - DNA, 956 bp, Homo sapiens
gggcctggacttgtgtgagcgtgtggacagatggtggccgcgctgtagctcgtgctcgtgttgcctacatgtttcctggctgtagaggcgctgcttcatgctgcaccgcctccacttgatctcgagtacgcatgactccttttgacactttatcagaataaatatggatggcgagctcctaggcctcgtggcttcctgtgtaggaggcgcggcagtgccgaaacggaggtcgtgcgtgcggtgtggacttgggactgctgggagtgtggcgggttggaccgctgtctgtggcccacttgggcacccgactgcttctgtccacttctggttgccaggagacagtcaagcatagccaggcaggacatgaagttgctattagatggagcgttcgtgatttaggttatgcagctaaagtttgctgtgatttaagcaataaaattctgttcagcccaaggaagagaacaagaccacaacaaaacacacacaaaacacaaggggcaaaccaagatacaatagactcagagagggagcgtgcgcagacactccggggactatctcacgcctggagcggggcaccccgagaccattggccccggatacccccgcgcacgggggttccttaaggtgaccaccagggagggaggcccccaccaaaggttcgagtcgagcgggacgctgaaagcacggacacgagagctgcgcgggaggccctggccggactaagaacgctccgcgaatagcgcgcgcggaagacccacagtgtgcacccgagagcgtgcgtgatccagggcagcggtgacgggcaggccaaacacccccactaaagccccacgtgggagaggcccccgtgcaaccaaaacccggggggcagtggctccgaacacacctccaccccccaagcgagtacatagcttcccgagacctcgcgccagcacgcccggcgaaaactccagagt

SEQ ID NO: 583543 - DNA, 189 bp, Homo sapiens
accccctcaatgctacttgcaaacttagaagtttatagaatgtgcctcaaaataatcttgctaaagaactcgagactggtctgattacataaacactaccgtttagcatggatcgagtgttgtccccatggttattaacccttcgcacttttgagctgaacctcgtatctccttcagggtaccgagctc

SEQ ID NO: 583544 - DNA, 312 bp, Homo sapiens
tagaaatcagcagacatggagcgtgcatatgtcatgccagggcctccatatgtcatgaactatggtcagggaggtccccaactcattatctcagcccatgtggcaaaggatgcctggcttacattgagtttgcacagcacagagcttagacctaagagacaccttagagtttaccctggctaccttacagatgaggacactgaggctcagagtggcactgggctcattctaaacataccctctgtgccaggcactgttgcctccaaatcccttctctcttgtacacctccactacggaggcaggacaagcag

SEQ ID NO: 583545 - DNA, 677 bp, Homo sapiens
ggtgccccgcgcgccggcgagtcgctgagccgctggctgccggacgggacgggacctggctagtgctggtgctgcgccccccgtggccccgccgtgggcattggctgcactggcccggtgccgctgcatgcatgcctctgcatggcccagtgtgcatcctgactgctgccgacccgggagcttggccccccgcagcacttcactgcattgacccatccgtggtggcctgcggacacggaaccagagtagttgcgcccaccaccgggaccctgggaccccatgccgagcgccactggccagacagagcttaggcagcatctgacacatgagcaagccattagaccatgtgaccgttcccccacagactggtgcctgctctgccaaacgtttcattggcccactgggatacgaacaaccattgcatgggagggacatcatgggccaagcggcataccttacccatgagatgactgcttgattcggggaagccccacccgcaggaaggctacagaattcctccggttgaacaccttggaaaggcaggtaaccttttgcccggtgagcaggggaacccccagaaacattcctaccataagaaaagcgtaccatattggacacaagaggcagggtcttagccaccaataaccggttcacaaggggagctttggagcggtcac

SEQ ID NO: 583546 - DNA, 200 bp, Homo sapiens
tgtgagaactagatgggctcaacagctggaggtctagtccacttatttttgctctgataggctcatcgccggtttcattgagaagacacgtgcggatcagggcttctgtcaccgaacaggggtcgcagtttgcagagtgggctacgatcttctagagtaacccttcttctcctggccgacagtccgggtaatgcgtatgc

SEQ ID NO: 583547 - DNA, 125 bp, Homo sapiens
tcgaccatgtgcagaagatacctaggacacacgcatcacctggtgcctcactgaaccctgatggctacgaggtggcagcgcagatgggctcagagtttgggaactgggcgctgggactgtggact

SEQ ID NO: 583548 - DNA, 287 bp, Homo sapiens
  misc_feature (134)..(134): n is a, c, g, or t
  misc_feature (186)..(186): n is a, c, g, or t
  misc_feature (282)..(282): n is a, c, g, or t
agaacgtcttccccaaccagactgaaggcaaaaggctcctacaaacccctggcttcctaaaactgctcctgaatgcccctccaaaaaaccccaattacctgcccctccctaaggaacaaccaggaccccatctnccacccccacagcagtgacccccacccagggccaggcctaaaaggcttctgncagcttccatcctacccataaccccaacttggggcaaaaaaaacccatcctaaaggctgggcccatgcaagggcccacctgaataaacagaattanctgca

SEQ ID NO: 583549 - DNA, 209 bp, Homo sapiens
gggggtttgggcccttaaaaccccccccgggttggggggaccccttaaagccaatcattttttcccttttttgggacccccaggggccctgttgccaaggggggaaaaactcctaatttaaatgtccccgccaatgtcctagtgttggctaccccaatgttgatgccaccccgttggaattattaaaccgatttttttttttttggcca

SEQ ID NO: 583550 - DNA, 294 bp, Homo sapiens
gaactagagtctttgcagatgtcaatgaattaagatgaggttgtggccgggcgcggtggctcacacctgtaatcccagcactttgggaggctgaggcaggtggatcacaaggtcaggagttcgagaccagcctggccagcatggtgaaaccccgtctctactaaaaatacaaaaaattagctgggcatggtggtggcgggtgcctttagtcccagctactcaggaggctgaggcagagaactgcttgaacctgggaggtggaggttgcagtgagccgagatcacaccactgcac

SEQ ID NO: 583551 - DNA, 300 bp, Homo sapiens
cacgagggcgacaacgtgatgaagggctacgagaacaacgagaaggccaatgccgaggccttcaccaagcagggctggttccgcaccggcgaccagggcgtgctctcgccggagggctacctctcgatcaccggtcgcctgaaggagatcatcaaccgcggcggcgagaagatctccccccgcgaggtggacgaggttctgatggaccacccggcggtgtcgcaatgcgtcaccgtcgcggtgccccacgacaagctcggtgaggatgtctccgccgcgatcgtcctgcgggagggggtc

SEQ ID NO: 583552 - DNA, 144 bp, Homo sapiens
ttgttatccgctaattattttgcgccatctaagctcttacgaatggggtgactacttatgatacaaaactacagctagtgaattatcctatttgtaaatacctttgttatattgtattccataaatcttggacacgaatgttca

SEQ ID NO: 583553 - DNA, 505 bp, Homo sapiens
gttaggtgaggagcctaagtgtcgaggtgatgagagatcccaacgggaaatcgacaggtcgttaggcttggtgagttaggaataacacgagatatgccaatgaggctgtggaaggagatgaatgggtaaagacactaagtgtgtaacacatactatattgtggtaggccgtgctacaataagaacgtagaaggggtcatgggcagtagttgaaaagtggaagttgagaagtaggtaagagaatagggagagaattgagatctgatgtcatgggggttgaatctctacattaggaagttggatgacacgtatgggatagatggagagaattaaggaaagaatggtctctcttttggatgtagtataccatgtgctagaaggtatatgctgggaggatggaaagatagcataagggtttgggcttggtctgattctctatctccgtgtaagtaagcagacacagacagtcggtcgactgcagaatgatatggtactgcattaggtag

SEQ ID NO: 583554 - DNA, 777 bp, Homo sapiens
  misc_feature (31)..(31): n is a, c, g, or t
  misc_feature (39)..(39): n is a, c, g, or t
  misc_feature (112)..(113): n is a, c, g, or t
  misc_feature (240)..(240): n is a, c, g, or t
  misc_feature (269)..(269): n is a, c, g, or t
  misc_feature (291)..(291): n is a, c, g, or t
  misc_feature (371)..(371): n is a, c, g, or t
  misc_feature (408)..(408): n is a, c, g, or t
  misc_feature (431)..(431): n is a, c, g, or t
  misc_feature (496)..(496): n is a, c, g, or t
  misc_feature (523)..(523): n is a, c, g, or t
gggagctgatggcataacgtgggggttgagncgctcgancgcaaagcggcggagcgggtcggaggttgcgggaggagcagcagagggagcgcctccgccaggtgtcgcgcannctgaggaaggctggcggctgtgagcgcagcgccgagtgagtggcctggctgctggcctgagagcgcggacctggtaacggagctgcagggccggagcctggtggcgcgagggcctgaagctggctgngcagtgagtgaggttgtgcgactgacccntgaggaggagctgcgggggaangtgtcctgggagcttggccagctgcctgtcctggaactgccaaatacttggtcgtctacacaggcgcgggaatcagcacnggcagcgtctatcccatgactacctgggggccctaantggagttgtggacactgcttcangaaagggagaagcgttagttgctgcctgacctgagctgaggcctgagccaaccctcacccacatngagcatcacccgtcttgcatgagcagnaagctggtgcagcatgtggttgtctcaggaactgtgacgggctccacctgaggagtgggctgccgcgcacggcatctccgagctccacgggaacatgtacattgaagtctgtacctcctgcgttcccaacagggagtacgtgcgggtgtcgatgtgacggagcgcactgcctccacagacacagacaggcggactgcacaagtgtgggacccagctgcggggacaccattgtgcactttggggagggacgtggg

SEQ ID NO: 583555 - DNA, 145 bp, Homo sapiens
cagacagactgggcaagacagacactctgggttgtcaatttctggggagatcgacaagccagattacaagggcattggatccagtccagagaattgacgaagcgcagcgtgtcttgtcttggcccaggagtgtcttgtcttgggt

SEQ ID NO: 583556 - DNA, 283 bp, Homo sapiens
  misc_feature (66)..(66): n is a, c, g, or t
taaattttttttttaatgccattttccaaacggtaaaaaaagttcttccaaaatgcagcccaaaantgctggggccactggccgtcctgcatttttggtttccaaaccccaaagcctcccattcggaaggatctttggggttttaaactgagtgggcctagggtgccccctattttttattttccccggtggggtgctaaaaaaaaaaggggagggccatcggggatatggactaaaacttttttattaaaaaaacttttccccaaggggcctggggagtgga

SEQ ID NO: 583557 - DNA, 1042 bp, Homo sapiens
cggcgattgcggctgcgccggcttgaaacactgatcgccaccacgctgtacgcggtgtggagcaacgttcgttgttgtcgctctactttaccgactgtaacctccgcgtgcagtgtgtggcccctggttcccggcgcatgccgtgctgacctgcagacctgtgcgcctcacgtctttccttcctgtggagaaacctaacgctgcatcacaccctgtggccgtcgggactacatatgtgcccgtccgcggtgcagtggcaggggccggggaggagggggtaaccggaatggactgtgccgcggagcggccagtgatgccctcttggcggacggatccatcgggaaagtgctggccccaccgtgccatgctggcccccaggcggaaacggggcggcctccagcatgtgcccacctggcccgtcccacgcacggcttcactggggccagctgccctgtggctgtgctctccagcttcctgacgccggagagacttccctaccaggaggcagctccagcggagaccttccagcccgcgcaggtcggcgacagccttcgggacccacactggctggaacctgctggttcccgggctggcagctgaccatcccagtaggcatgggatgacccacgaagtcaacctaagcctgacgaaagtcgatggagcaccgtctgcatgtgacgctcatggagaaaccatgtccaacggtctaacccaaagagggctgacacacacgcagccactctccatgacttagacaggactggctaggacaacaaagaacccacgacacgcctcacacttccaactgacgggaagataccacctcacactgagctccacgacgagagccacacaacagccacaaccactcacttagacacctcacataaaccctaacaaaaaaatcatcccacctcaacacctcgaccttaccataacattctatcccacaccacaacacaccacaacacccactaccatacaacaacgaaccacactacctcccaaatacaacaacctccaccataaacaacaacaatcg

SEQ ID NO: 583558 - DNA, 543 bp, Homo sapiens
ggatgggggtggtaagaatccaggacctgaattcccagcctggccaacccttgcagctgtctgctctcaagaggagcaagagccccttgaggccagcagggttgggggagttggagtgacctgaggttcttttctgttagagccctggtcctcctatctccaccacctatccctgctcagtagaacccctgggtgctaaatggcaggagccccggggtgtcccataggggtatggctggctgggtcactaaccactgtgatctgctccctccctctacagatcatgcggatcaaacctcaccaaagccagcacataggagagatgagcttcctacagcacagcagatgtgaatgcagaccaaagaaagacagaacaaagccagaaaatcactgtgagccttgttcagagcggagaaagcatttgtttgtccaagatccgcagacgtgtaaatgttcctgcaaaaacacagactcgcgttgcaaggcgaggcagcttgagttaaacgaacgtacttgcagatgtgacaagccaaggcggtgagc

SEQ ID NO: 583559 - DNA, 183 bp, Homo sapiens
gatcgttcagcgttcatgtacctggtcaataggggcatagacactacctcaaggagtgtgaaaggattaaatgaggccgggcatagtagttcacgcctgtaatcccagctctttgggaggcagaggtgggcagatcacttgagctcaggagtttgagaccagcttggccaacatggtgaaacc

SEQ ID NO: 583560 - DNA, 788 bp, Homo sapiens
gatataaggcagcggtaattcggtgagcggtggtggttgattcttccgtggagttagggggctccgtgaacatctcagagtcttcagggttcttccatctgggaaactatgtaagagtgcagaaaagatgttcgtcgaagatatgactccaggaccacgtatattttctccagaaggtcagcttataccgagttgaatatgccagtggaagctattgcgacatgcaggcccgtgtttgggaacttcttagcaaagtgatggtgttgtggctgtgcagcagcaggagacgcaacatccacaaggcttcctttgatgaatgtcttttgttgtctggaataaacatttgataaatctcgagttgaggaacttggttgtgcagtgtggcaaggcataacttcgtgattgctaatggttctggactaatgaagcgaaggctctatgggctcaaaggtatttatgtgacaggtcatcaggagcgaataccttgtgaagcatgtgtggttacagcgctgtgtgatatcaaaccaagcttatacaacaatgttggaggaaaacgtcccttttgtgtttcatttgtctgtacattgtggtgggataagcactaatgggtaaacagctctatcagagtgacctaggtggaaacttacgggggatggaaggccaaatgggtgtggaaataatagcgtgcacgttgtgtcaatgtgggaaccgggactaataggaagggggaaattgacttgagggtaggattgtgataagtttcaaagttctaattagaccagggtgta

SEQ ID NO: 583561 - DNA, 140 bp, Homo sapiens
gtaccaccggaagcgagttgcgacaaggcaggttaccgcaccggaagaagcgaacaaagcgacttaggaacggacaacaatggtacggtcggggaataagacaactttttactatatattgacgtagtctttaacataat

SEQ ID NO: 583562 - DNA, 388 bp, Homo sapiens
cctctgtctcctaaattaaaatcttctgccactgcatagctactgcggctgctggtaccgccatagccacctggtttcgtggttatcgcaaagtatcggcctccaccgccataggggccagagccttctgcgctccaagaatttcctcccttcatgggtccaaaatttgaagactgaatagtcgtaattcccaaaatcatcgtagcttccaccatttttcaaaattgcttccatcattaccaaatccattatagccatccccactgccaccaatatccaccaccaccacggctgccaccaaagccaccacgaccactgaagtttcctccacgaccgaagtcgtcattcccaccgaaaccacctccacgaccaccaccaaagtttccag

SEQ ID NO: 583563 - DNA, 378 bp, Homo sapiens
  misc_feature (159)..(159): n is a, c, g, or t
ggccttttttggggaaaaggcggggtatttcccctccccaaccctaactgttccatggggaaaccctggagccatccctttggagccaacaaggccgccccaggggtatagcagaaagaactttaaaagccaggagggtggacgcccagctccgcctgntgggaaaagctcccctccccaactgcaggttatgcataggacttccgcagggccggactccccaacttgccccatgttttaggtttcaacaacaaaactgccaggtgggtgggttttgcctttaacctgggccaaaaggaaattagggccaaggagctttccccaactgtggcaaccgtccccggccccccccatggaaacaataaaggtttttcctta

SEQ ID NO: 583564 - DNA, 296 bp, Homo sapiens
  misc_feature (262)..(262): n is a, c, g, or t
aagaaagtgcaaaaggcagcagcacaagacagagtcaggaactttttgaaaggaactctctctggcagctgcttcaatcttctttctctagaggtagtaagagggggctggagatctattcattatcttttaacaatggacaaagagaagcctgtctgctgcgttagtcattgcttggaggtccccgacttctgcttccactactgctctctacccgcaaagtgacttctctttgatggctatttattaaaatgggaatgtngaccctccagctagggcagggctggggggcatgg

SEQ ID NO: 583565 - DNA, 409 bp, Homo sapiens
gaaagaccccattcaaacctgcctctctttaaagcttcagtcatgtttacagttgcattaagcaattcttaccactcttctggctgggtattctaggattccatataggtgacagcttataggaaggggcatgggagctttcaaatgtggcatttgaatcctgactctgcccccaaataggtaactgtggctttcggcaggatactggtccttagccgtgcccagttttccatctgtacaaaggtgttaacatgaagattggatgcatgtagttggcatgaaaccttgggggttccccctgtttcttcccgttctgcggtccaggcagttagagtcacacgatgatctatttggccggaatcccgtgctttggtacttctttctagaggtctgttatgccccttgggcg

SEQ ID NO: 583566 - DNA, 434 bp, Homo sapiens
cagattccattgcgtgtctcttgttgttgcgggcgtcatagaaccggggccaatagatgggatggagctgcctgcctggcccatggaggccagtacgcctcaaagatcttggtcaggtctcgagccaggcagctgcagttgtacatgaccacgcccagctccttgacctgggtcagtgaacgccagtccatgttggcactgcccaggtagaagtgggtctggtccaccacccagagcttggtatgcaggacgccatgggtcagctactgcatgtccaccatgcggacctgggcaccgctctgcagcagagcctgcaggtccgcctgtggctagggcccgctgggcttgctcacagcgatacggacgttcacgccctttggtgccagggtctgcagctgccggaggacctcctcaacctgcagggcagagggctc

SEQ ID NO: 583567 - DNA, 1284 bp, Homo sapiens
gacgggtccagctggtgtgtgatctgctcgacgcgtggggtgtgtttgtcgcgcctcggtaggtcatgacttggcgttgtcccacggtgggtgggccccccctggttgacgggggggccccccggcttgtggctgtgtacccgggcgcagccagtatgtgtgggtgtgtgcccttggggtaggccccctttctcggggcaagtgttgttcggggcacccttgagccctgtggctcgttctgtcctgataggtctcggccctctcccgtggttgccgtgggcccccgggtttctggcccaccgtgtgccccctgtgtttgcgtttcccatacgatgcaagccacttggcccttgcccgtgttgtgtgcgccccccacgggtgggtcccccgccccacaatgtgggccacgtgggccccctccaaggcgccggaatggccccttctaagtctccccccaattgtgtggaggccccagggcgcgtagattcccgtctaatataggtgaatggtgtggtcttggtcccgcccccactttactcgcccggtgtggattttcccacccctggggggaaattgaggggctggcgctgtcggcgggcgttcttgcctggggccccctgaggagccacttcccacggttgttgcccaccacactcaacactcgtggggatgggcgaaggggtggccgctgggcctctataccccccatgaggggctcgttccacgggcttctggcacacaccacagctgtgcgtcaccccacaaatattctcgggtgtggcttgtgtgtatgaaagctataacttgatatagtgggagagcccttccacaggtggaagaggttgaagggaagggggcctgccacgtgttcacaggtataaagatttctcgggcaagaccacgaacgtatcacgcctttggaaagggccacgcggggaacttctaaggcccaaggagatttaccacgcttgggaaaggaaggcacgtggcccagaaggggtgaagggaccacggggcccttaaagtccacgcgaaggaaagcctccgttgtgggccccctttaacgctccgtttcggggtaacctggaacgcctcttttcccacagctccctccacgccactcacgcacgccttcttgtcaaagcgttttgcctcgccccacgtttaatccccacaccccccaagtcaaggccacccttttttcacggtcactatttattttttgttcctttttttgttttgtaagaaaaccattccaccaacccccgggccaaaacccatcca

SEQ ID NO: 583568 - DNA, 215 bp, Homo sapiens
  misc_feature (201)..(201): n is a, c, g, or t
tctggttagatgtgaaattacttctgccgcctctgacgcaccactgccaatgctgtacgttctgcatttgcccctcgagccaggtggatgtttaccgtgatgttatatcacttcctgggctccttcactgcatcatgcctagatccaacattttttcctagatgagtcacatcctgggtatccagctgaaactcccacgtntcgcggggttaccg

SEQ ID NO: 583569 - DNA, 617 bp, Homo sapiens
  misc_feature (273)..(273): n is a, c, g, or t
  misc_feature (316)..(316): n is a, c, g, or t
ttcgtgtcgcgtgcagtgtcagctgtctgatgctggctcagcgatctgctactcagctccaagtgtagatacaggcatgacgcacagcactgacagaattttatgatagctcgacgttttctcatattcagtaggatcgagaccactgcattaagatattactttttgtgccaaacattacatagccagatcacataatgaatgtctcagagaagagttctagtaggaaactggaaactccacaagcagaacgatcaggtccttacttttgtntggtagtcttttcttttctttttttttttgagatggagtctcngcccatcactctggcatgatttcggctcactacaacctccaccacccaagttcactggaacctccactcctaggtaaaagcgattctcctgcctcagtctccccagtagctgggattacagatacccaccaggcctggctactttttgtattttgggggggacagggttcaccatgtggccaggctgtcttgcactcctgacctaagtatctgccatctcagctccagagtgtagtttataggctgagcatggtcccggccaattttgtttttagagagccggttcccatgtgacaggtgc

SEQ ID NO: 583570 - DNA, 132 bp, Homo sapiens
aagagtacaaatatggaatatactacttacggtgtgactactgtgtaacttttacctttgtgtactgagtacgttttttttttctgactactgtaacgacgtccttccttccctctactgcacgttgaactt

SEQ ID NO: 583571 - DNA, 356 bp, Homo sapiens
gtagagatggagtctccctatgttgcccaggctgatctcacactcctgggctcaagtgatcctcccaaagtgttttgattacaggagggagccactgtgcccagcgtattttttttaaacattttcaatctgcagttggttgaatccatggatgcagaacccacagacatagaggaccaactgtgtgtatgtatgtttgtgtgtgtgtgtgtgcgcgtgtgtgtgtgtgtagtttttgctagaatatgtgtccactaaaaatatatgcccttaataaaatgtttaaaatttgaatagtaaaaattaaacctcagaagaatccagttgagtctattttgcacaacagatatagtttt

SEQ ID NO: 583572 - DNA, 302 bp, Homo sapiens
  misc_feature (4)..(4): n is a, c, g, or t
  misc_feature (14)..(14): n is a, c, g, or t
  misc_feature (31)..(31): n is a, c, g, or t
  misc_feature (46)..(46): n is a, c, g, or t
  misc_feature (49)..(49): n is a, c, g, or t
  misc_feature (54)..(55): n is a, c, g, or t
  misc_feature (59)..(60): n is a, c, g, or t
  misc_feature (63)..(63): n is a, c, g, or t
  misc_feature (112)..(114): n is a, c, g, or t
  misc_feature (132)..(133): n is a, c, g, or t
  misc_feature (146)..(146): n is a, c, g, or t
  misc_feature (162)..(162): n is a, c, g, or t
  misc_feature (182)..(182): n is a, c, g, or t
  misc_feature (188)..(188): n is a, c, g, or t
  misc_feature (202)..(202): n is a, c, g, or t
  misc_feature (229)..(229): n is a, c, g, or t
cagncatgtgttgncaaagcctgttaatagnagttaagtgttaagnctnctttnntttnnccntttccatggtaatccatatttagaccactgtatttttgccttgttaacnnnatttaccattcctaaaannaaaaagcaacccnctgtcaaactgttaantctgtcacagcctgtatatnttagtnatttgtaaatctcntcatacaatagtgacttcttttttgantgatacagtatcttaattacaaggttattttgtacttgtcttaatacactaagtgtaataaaaacggcttgag

SEQ ID NO: 583573 - DNA, 145 bp, Homo sapiens
atcacgctggagtgaataggaaaggaactgatgtgtcccaagtggatcaacatcatgaccgagcggagcgtgccccacctgcagaaagtatttgataggtacaagagttacagaccttatgacatgttggaaagcatcaggaaag

SEQ ID NO: 583574 - DNA, 361 bp, Homo sapiens
tggagagtctcacttcatcacccaggttggaatgcagtggtgcaatcttggctcactgcaacctccatctcccaagttcaagcaattctcctgacttagcctcccaagtagctgggactacaggcacgtgccaccacgcctggctaatttttgtattttttgtagagacggggtttcaccgtgttcgccaaggtggtcttgaactccaggcttcaagtgatctgcccacctcggcctctcaaagtgctgggattacaggcatgagccaccacacctgggcctgggatttagtaatttcggatttccaaattcaggtcaagaagtgggaatttatttatgttggtttcttgtgaaaaaaata

SEQ ID NO: 583575 - DNA, 515 bp, Homo sapiens
tgttgaattatatttttgtcaagctgaagagttctgtagatgtctattaggactatttggtcaagtgttgagtttaggttctaatgttttgttaattttcttcttcagttatctgtctattagtgcctgtgggatgttgtagtctcccactattgttgtgtcagaatctaaatctcttcataggtctctaagaacttgctttattcatatgaacccatgaattttataaaccccctttctcttttctgccttttcttccggtaaccattctttcctgtgtgcacaatgtgcaaaatgtagatgtccatgagttcaagaacatgtttagagacctagctgttgtaaaagaaaatataaattagaaataagaggcttaattagtccacataaaaataagagaaaatatcttactaaaatctcttttcttaaaacacttagattatgtgtagatttttatctcctttttttgaaatatatgtaaatcattaacagctaaataaatctttgttatgtaa

SEQ ID NO: 583576 - DNA, 80 bp, Homo sapiens
ggtccccacccagtttcctttgcctctcttccttctaccaggtcatgttttttactctctgccccttctgtcgtcttctc

SEQ ID NO: 583577 - DNA, 471 bp, Homo sapiens
agagtggagtccgacgggcagtccgggagcaagttcctggcactgtggtgaatctggcgtgagtggaagtgcgggtggcattggaggagatgggcacggaggtgacagaggatgtggtgaccgcctgctatgccctcatggagtaggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgttggcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccagcc

SEQ ID NO: 583578 - DNA, 138 bp, Homo sapiens
cttccatcccgttgtgtgtgagtcaagaaggaatcgtagctccatgctgtgcgagtggatgcggaaggtgggctagcaacacatttaacaacatcatgtataaccagtatgatagccacatccttgaatgtcaaccac

SEQ ID NO: 583579 - DNA, 140 bp, Homo sapiens
attaccactgtcaaagaggcaaaggttttgatttttgtattatgaagttaagtctcatgtggagtccatttgttagttttagtggaatcaaagggaaatccaaggtgtcccgatgctatatccacactcagacctctttt

SEQ ID NO: 583580 - DNA, 418 bp, Homo sapiens
cgcctttgctgaacacgagctcgccagcagcatcgttgcgagcagggttagcggcgcgtatctccttgggaaggttgtcatacgcatatttgaccttctctcgaaacaggcgcttggcgtcgttcagggtgtgggcgatcagggcgcacttggcagcctcgaacagcgcggcatccagctgaacaatgcagaccaaggtggtgaagcccagctgacgggccttgaggatgatgttccgggtgtgcatcccctggaagtagtcgatctgctcctgcgtcatccggaagcggaccttcttgccctgcttgtccgtgatgaagtacaggttgttcagtcgccagaacccgtcccgggagcagttcatgtgctcgggcttcatggtcaggcatcctttcgataggtcattcaataggctggg

SEQ ID NO: 583581 - DNA, 1056 bp, Homo sapiens
  misc_feature (630)..(630): n is a, c, g, or t
  misc_feature (745)..(745): n is a, c, g, or t
gccggtcacctgaaactggatgctggtgctgggccgccaatggtcaagatggtggattacaacccgtgtgggaacacattgaggtgtctgatgatcaaagacgatactgcactcccaacattcgtactatccggtcacatgtctcttacactgcgtggacggtatcagagtcactcgggcgttgtgaatcgcactggaacgctagtttccgaaggaacgtgacgaacagtgagctgaactgcgaaccagtggcgcctgaccgtggtagctgctagaagcggctctcggtgtgacctggagatgcctacgcatggtatatacttgacctgcacgcatgagttagtgcttgcgccctgaccggggcgggacgaaacggtcagtgaaagcgtggtgaagcagccatagtcacgaggccgaatggtcgcctagtaaacgcgtcgcaccaaaggaggtgacgcccgacgcctgttgacgcacgaagggcctcgcgccgcgcagatgcggcgaaccgacatcggaagaagactcatgcccaatgcgctgtagtcaaaacaaggtcgcgccataggcagccattccgaggcgacttctggcagcagggctatctagagtggatagtcaagacgaatngcgttaaagacgctttatcacatactttcccgctcaggatagaatgacccgcgaccggaaagtgaaccttccaataaaggagtacgaagatttgaatgcgtggaggccacacgtngagagcgaaagtatacagaaccgttgtcggttcgccaatgagatcatatgctccccgaacaagccagcaattgggacgtcctgagatagggtgagcctgttggccgtttcgctcgccttttgcggcccttgattcacgcggcaaacacggtggttttcgtttgcgtggactacccaacgttttccgctgctgaggcgttgcttgcccggagcggtatggcccaccggcgccccatttgcaaccgttggcagttccaattttggggtttgcccatttggatcccttacactggttggtggggtgtgcaatcc

SEQ ID NO: 583582 - DNA, 225 bp, Homo sapiens
aggggcgaatcgcttgccaggaggccgaggttgcagtgaaccgagatggcgccattgcactccaggctgggcaacaaaagcaaaactccttctctaaaaaaaaggagacaggacctggggtgacccagctggtgaccaaaaacctcgagttggtctgcatgacggatcctggcccatccaagtggacagctgtgacgttcgcccaggccccttcccatctttcct

SEQ ID NO: 583583 - DNA, 771 bp, Homo sapiens
  misc_feature (227)..(227): n is a, c, g, or t
  misc_feature (229)..(232): n is a, c, g, or t
  misc_feature (235)..(235): n is a, c, g, or t
  misc_feature (238)..(238): n is a, c, g, or t
  misc_feature (240)..(240): n is a, c, g, or t
  misc_feature (247)..(248): n is a, c, g, or t
  misc_feature (254)..(254): n is a, c, g, or t
gcagaatggggatgcagccatggaagaccttacacggttaaaagagaccatagataataattctgtgagttctccacttcagtctcttcagcagagaacatggctcatacatggtctctgctggtttcttcaatcaccccaaaggtcgcgataatattatggacctcttcctttatcagccacaatatcttaatgcaattcagacaatgtgtccacacatcttcgcnannnngantanancagtcannacaaanaaggatgtcgaaaacgtcggcaggttctaacaagatctagtaaagttatccaccaggagtcttacacatataaagacccaataacagaatgtgtgaatgtatatatgtaccttgtgacttggatggggctcagaaaaagctgagggaatgtgaatcagtgctgtgtgaattgacttcttcttggggggctggtcttggaggattcatggaaaaggccgtctcttcatattgagactttctgtcgcatccaccagtgtatcagcattaccatgtggccagataaatggaacatgatcaagaagaagtggaagggtgcattgtaaatcgttagaaatgcaagattgatgccaagatgggtctaaataagtcatgtggtatgggtacaatgcagtctcacctattagcagtgatgaaagacaaagtttcttaaagcagagttgcatgatattgaagaattataaaatagagacaggtctaatgggaatcaggttggttatgagactagaagtggaatcac

SEQ ID NO: 583584 - DNA, 395 bp, Homo sapiens
  misc_feature (227)..(227): n is a, c, g, or t
  misc_feature (229)..(232): n is a, c, g, or t
  misc_feature (235)..(235): n is a, c, g, or t
  misc_feature (238)..(238): n is a, c, g, or t
  misc_feature (240)..(240): n is a, c, g, or t
  misc_feature (247)..(248): n is a, c, g, or t
  misc_feature (254)..(254): n is a, c, g, or t
gcagaatggggatgcagccatggaagaccttacacggttaaaagagaccatagataataattctgtgagttctccacttcagtctcttcagcagagaacatggctcatacatggtctctgctggtttcttcaatcaccccaaaggtcgcgataatattatggacctcttcctttatcagccacaatatcttaatgcaattcagacaatgtgtccacacatcttcgcnannnngantanancagtcannacaaanaaggatgtcgaaaacgtcggcagggtatgaaagactgtaggtatatagtagtgacaacaggtgtcatacaagaaaaagaccaaagtacagaataagatgaaagatcatatatagctaatctctgaacatttgagtgggata

SEQ ID NO: 583585 - DNA, 975 bp, Homo sapiens
  misc_feature (586)..(586): n is a, c, g, or t
ccccaacgaccatggttgttgtggcgccaaggggatcccccccttgtttccccccgcggtttggctgttcctccgccgtcaccatttgtcgtcggcgggctcccttgtttaaaatccggcgcgtcattgctgccgcgcgtgcatacttttcccgcgctgccataattgggtggtcgcttggtactctcccccccctttctggtaataacgggctggctcatttcctccggcgccccgtttcctccatggggatggtatatacctcaccaccagggggtctttgcaccactcggcggcacatttgtcggtgccacgcccccgtagttcgtgctttcgtatatgtccacccccagaggggggtctccccgccacccttgtgtgcccgctgcccctccgtgcaggtgggttatgctcgccgcacccttttcgcccgcacacgcctggctgttgtggctgcaggcaaagttgtgcgcgcagctgaacactcactcgctcgtgttggggcagcacgctgacacgccccgcacctgtctgggtctcacttactcgctctcgggggtgcacgcaccgcttggggtcctggcgncctcttggtctttcatgcgatggtcgcggtactatacacccccctctccgccactctggtctgtactatatcggcgcgtggcgcgtcctggtcgggattaacccttgccttccctgtgttgtgggagtgctctcccccccgttcgtggttgcgctccccacccccgcattggtccggagtgctctgctgctcgcgccccccccttgatgcggtgccggactcccacggtaggacttgtgcggggccgcccgtgcgcgggtccactggggattgccgtccttttcgtccaaatgccccccaccacccgcccctcgtgtcccccttttttttcccgaacacaagaaaaaaaaagtaatcccccacaaaacaaaaaaaaccaaacataaaaa

SEQ ID NO: 583586 - DNA, 279 bp, Homo sapiens
gcacgtggtgtactatctgagatggcacactcctgccttgtgttcagctgtgagctcggcccagccgggacgtcaagatgctgtctccacctagtggctcatcattcattaatccagcccaagcttcctcacacagggtgggcagctggactccaaaatgacaggcctgttatgcaggcacttatcaggcctgctgatgtcccgttggccaaaacaagtcacgtggccaagccccgagccggcaggggaggagaacacacatgggtgtgaagactgagc

SEQ ID NO: 583587 - DNA, 818 bp, Homo sapiens
agcggggtgtctcgatgagcagtcagtgctataggggaactgtcttcctccgccaagcgcgaggctgagtacaagttctatgtctgtggttgactccgtatttggtctgaggccttcgggagctttcccgaggcagtatagcatgaagcctgagtggtcgtccccgactccgtctcctctgatccctgcgcgcccgtgcgagggaccatagttggtgtcacttcctcctcagagggtcgaccagatctcattctctgttagatgggtctcgcatccgtattccgcgggaatcagacggagtctcgcattagatggccagcttgcccacccgcagggtcaagcgtaatcaaagagatcggtagcagtatatacagctactatagtgtgaatcattttcatgcctccatgcagactcctttttagacgagaggaacatgtggctcgttgaacagatgtggtacgtgttgcttttatgcatcccagatggttcaatgacatttgctggggtcagcgaggatcatcgccacaggtaagaagctctgttccgcggtcccagggcctatcagaactcttgctcgtagtcgttggtcgagccaagcaatgtataccaattcaaaatcacgttttaagatatgccaagacataagtacgtgatggtgggtcactaaatacatgaagtcctcgtgacatggttattcatgagactgtggagatatagtctgggagtcttgcttgggggtcatctagtttccagaggaaccggagtcactgtgtaaagtatagaatggcattcgcttgacaattttggacaacgatca

SEQ ID NO: 583588 - DNA, 331 bp, Homo sapiens
tacacatgccatcccctgaatggcaggcctccttcagttcctgagctgctgaagtgggggtgcagaaacactgtcccaacccacgaagaaggcccactagaccttccacttagctccacttaggaggcagtgtacataactaagcggggtccctgtactaccggcactctgccttcatcactgactgttccaaggacaacaagccaccaggtttgtgcctgtccccatcagcagatggaatatacactataaaactacccatcttccctgaaccatatctgaggctcaccacttaccagaaataggtggctcaagctcccttggcagagca

SEQ ID NO: 583589 - DNA, 635 bp, Homo sapiens
ttttttttttgcaaggttcagttatccttaaatgacccccatctccctgaagggcagtgtgcgacggcacgctaggtgatggcaagagatgttcacttgaagatctggccctgattgaaggtcttggcccacttgcgggaaggccccctcccagaaaaaagtactctcgcaaccagcgttcggggtctccctcgcgtgccaggatccagttgccgccagtgtgtattgactcgtagtccaccgtgccaattcgggactcagcggaaaggcaagctcctgggcctcggaagacccagacctccagaaaagggagcgtgcgtatggtgggtcccaaaagggagtgacatgggagaaggcattcttcctcagctggtccagtcgtgggaacattccagtgatgagatggcagctcatgaaggtctgagtgagtccttcagggaagcgatactctgagtaccaccagggaccagccgtccttatcaaggggctcccagaaatatggcagtgcccagagagtgtgtcctcatgggagtactggcgcttaaattcatccaacacaaggtactctggggcaggtgagcgaaggggtcctgtggcctatgggctcagaagccaggcctgctcaatttatccaa

SEQ ID NO: 583590 - DNA, 269 bp, Homo sapiens
cctggttcatctatgtgtggaaggggtagggaacgaaaggatccatacatgtcacacttgttctttttccaggtgaatgattttcctaattttcaagggtctgatgccctttttataagcttccaggagcacctgtatgtgacttgctccaagtcatttagcatcatgctcttttcattgtctcttattatcacctaggagattgggagctagttgatgtcaagggctgtgctctgtctgatttctgtctcatagattgttactagggt

SEQ ID NO: 583591 - DNA, 167 bp, Homo sapiens
  misc_feature (5)..(5): n is a, c, g, or t
aacanagcagctatcaagccacgaccgattaccacccggaaagcagagcctatcaattgcattagacccagtgttcttggacattggaaagaaaatgtggaatggaactggatattaggccaagagattttcccgggcatcaacaacatggtttcttctgacgttgg

SEQ ID NO: 583592 - DNA, 2183 bp, Homo sapiens
gctgcggctgcagacggtctctccgagaagctgcaaggatgctgtctgtgcgcgtcgccgcggccgtggcccgtgccctccctcgacgggcgggactggtctccaaaaatgctttggggtcatcctttgttggtgcaagaaatctccatgcctctaacactcgacttcagaagactggcacagctgagatgtcctccattctcgaggagaggattctgggagctgacacgtctgttgacctggaggagactgggcgtgtgttaagcattggtgatggtattgcgcgagtgcacgggctgaggaatgttcaagcagaggagatggtggaattctcttcaggcttaaagggtatgtccctgaacttggaacccgacaatgttggagttgtcgtgtttgggaatgacaagctaattaaagaaggagacgttgtgaagaggacaggcgccatcgtggatgtccccgttggcgaggagctgttgggccgtgtggttgacgccctcggtaatgctattgatggaaagggtccaattggttccaagacccgcagacgagtgggcctgaaagcccctggaattatcccccgaatctctgtgcgggagccgatgcagaccggcatcaaggctgtggatagcctggtgcccattggccggggtcagcgtgagctgattattggtgacagacagactgggaaaacatcgattgccattgacacaatcatcaaccagaaacgtttcaacgatgggaccgacgagaagaagaagctgtactgcatctacgtcgcgattggtcagaagcggtccactgtggctcagctggtgaagagactgacggatgcggatgccatgaagtacaccatcgtggtgtcagccactgcctctgacgctgccccgcttcagtacttggctccctactccggctgctccatgggagagtactttagagacaacggcaagcacgctttgatcatctatgacgatctatccaagcaggctgtcgcttaccgccagatgtctctgttgctccgccgaccccctggtcgtgaggcctatcctggtgatgtgttctacctacactcccgcctgctggagagagcagccaagatgaacgattcctttggtggtggctctttgactgccttaccagtcattgaaacacaggctggtgatgtgtccgcttacattccaacaaatgttatttccatcactgacggacagatcttcttggaaacagaattgttctataaaggcatccgccctgccattaatgtgggtttgtctgtgtcccgtgtcggatctgctgcccaaaccagagccatgaagcaggtggcaggtaccatgaagctggagttggctcagtaccgggaggtggctgcgtttgcccagtttggttctgatttggacgctgccactcaacagctcttgagtcgtggtgtgcgtctgaccgagttgctaaagcaaggacagtactctcccatggctattgaagaacaggtggctgttatctatgcgggtgtacggggttatcttgacaaactggagcccagcaagatcacaaagtttgagaatgctttcttgtctcacgttatcagccagcaccagtccctcttgggcaatatcaggtctgatgggaaaatctcagaacagtcagacgcaaagctcaaagagattgtaacaaacttcttggctgggtttgaaccataaagccctgtcactgtcaccagatactgctttggttttgtcatttattctggtaaaatcagcaccatttgtaaagggttactcttgtattcctgatgtacagaaatcacatgaataaaagttccatactgtgtgctagtttgtgtgggggtgggctcaggtgtgtaccaggatttgtgtggtggtcagaggacagccagcctgtatgacagtaccctccttccaccgggaatttaatgcaggtttttatttaaagcacgacttcatgttgagttccataagttagttttgtaagacagagcttactgtgtgacctcagcaatggctagcctaggctattcttgtagcagtctgtctgccatagctggcaaattgctctcttaccctgttcttgctggtgcagtcagcatggatagataattcaaagctgtccactatgaaattcggaagtactttgtgattgattaaaaagagaactctgctccg

SEQ ID NO: 583593 - DNA, 432 bp, Homo sapiens
cacgaggggctattgagatggtagaaggagagcctccatacctcaatgaaaatcccttgagggccttgtacctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaac

SEQ ID NO: 583594 - DNA, 321 bp, Homo sapiens
tttacgggctacctaagatgaagtagaacaacccctttttgacagggcggtggtcaaggctgtaatcccagactttgggaggtagaatcgggtagatcacctgaagtcaggagtttgagaacagctggcaacatggtgaacacccatctttactaaaaatacaaaaacttaagcgggagtggtggtaaggggctggtatcccaggtactcgggaggctgagggagaagaattggccgaaactgggaggaggaggttggaggtgagccgaggttggaccattggcaactccagcctgggcaaaaagaagtagactctgtctc

SEQ ID NO: 583595 - DNA, 107 bp, Homo sapiens
tggccggctctcaacctatagttggaccttacagaatcagcccaacctaccctccagaatgaggggcatttaaagtcgctctggggcaaggggggggggggcccttt

SEQ ID NO: 583596 - DNA, 125 bp, Homo sapiens
ccccccccccccccttttttttttaataaaaggcccttagcatttgttgtagctttcccccccccagtaagttggtttacaaattttttcccctgagcctcccaataaaaaaaccccttttttta

SEQ ID NO: 583597 - DNA, 881 bp, Homo sapiens
ccacgtgacccaggctgcgcgcatgcggtcccggtgtgcatctggagagctgagcggcaccgggagcccccggcacagccggcccgcccgcgagtgagcccgcgaagatgccccggcgcagcctgcacgcggcggaatgtgctcctgctgggtgatcttaaaggaacagaattacagaccatgatcccaagttgaactggttccaagtggacttatttatggtcctgatggggagaatatgctggtccaagaagtacccgtcgtgtgggggcctgctgaagtcaccacctatagacctgcacagtggacactcctccagtaatgaacgccagtctcacgcccctcgagattccaaggctaacaatctgtaataggcaacaacgcagtttctcctgacacaacaattgggccagttcatgtgaaagactgatcctgtctcttcggacatgcaacataccaagggaacctccagtctcgctacagtgccacgggcagactgcaacctgcactggggtgaacccgaattgaccagacgggggtctagaagctacaaccgacaggagggacaaggaacttttggaccggcgaagcctgcacaattgtccacttataacatcagaactttaattttgacgcgcgaatggcaggcacacaagtaagaaggccctcgtgatcatgggtgatctcatgagaattggttccttaatcggatctaatgagagatctaggtcacttcacatgtaaacggataagggcgggaagacttcgccggggcccctggaaaggtgctacgacagacgcgtaatcactatcacggacctgtacagaacatagtaaagccatgcggacggtaggaacaagcatacaagagacagggagac

SEQ ID NO: 583598 - DNA, 701 bp, Homo sapiens
  misc_feature (38)..(38): n is a, c, g, or t
  misc_feature (66)..(67): n is a, c, g, or t
  misc_feature (89)..(89): n is a, c, g, or t
  misc_feature (91)..(92): n is a, c, g, or t
  misc_feature (95)..(96): n is a, c, g, or t
  misc_feature (100)..(101): n is a, c, g, or t
  misc_feature (105)..(107): n is a, c, g, or t
  misc_feature (114)..(114): n is a, c, g, or t
  misc_feature (135)..(135): n is a, c, g, or t
  misc_feature (141)..(141): n is a, c, g, or t
  misc_feature (159)..(159): n is a, c, g, or t
  misc_feature (163)..(163): n is a, c, g, or t
  misc_feature (183)..(183): n is a, c, g, or t
  misc_feature (193)..(193): n is a, c, g, or t
  misc_feature (200)..(200): n is a, c, g, or t
  misc_feature (210)..(211): n is a, c, g, or t
  misc_feature (214)..(214): n is a, c, g, or t
  misc_feature (221)..(221): n is a, c, g, or t
  misc_feature (226)..(226): n is a, c, g, or t
  misc_feature (229)..(229): n is a, c, g, or t
  misc_feature (237)..(238): n is a, c, g, or t
  misc_feature (244)..(244): n is a, c, g, or t
  misc_feature (249)..(249): n is a, c, g, or t
  misc_feature (272)..(272): n is a, c, g, or t
  misc_feature (276)..(276): n is a, c, g, or t
  misc_feature (282)..(282): n is a, c, g, or t
  misc_feature (287)..(287): n is a, c, g, or t
  misc_feature (289)..(290): n is a, c, g, or t
  misc_feature (296)..(298): n is a, c, g, or t
  misc_feature (317)..(317): n is a, c, g, or t
  misc_feature (322)..(322): n is a, c, g, or t
  misc_feature (333)..(334): n is a, c, g, or t
  misc_feature (349)..(349): n is a, c, g, or t
  misc_feature (351)..(352): n is a, c, g, or t
  misc_feature (367)..(367): n is a, c, g, or t
  misc_feature (378)..(378): n is a, c, g, or t
  misc_feature (380)..(380): n is a, c, g, or t
  misc_feature (386)..(386): n is a, c, g, or t
  misc_feature (388)..(388): n is a, c, g, or t
  misc_feature (399)..(399): n is a, c, g, or t
  misc_feature (403)..(404): n is a, c, g, or t
  misc_feature (410)..(411): n is a, c, g, or t
  misc_feature (414)..(414): n is a, c, g, or t
  misc_feature (422)..(422): n is a, c, g, or t
  misc_feature (428)..(429): n is a, c, g, or t
  misc_feature (488)..(488): n is a, c, g, or t
  misc_feature (689)..(689): n is a, c, g, or t
gaccaggaaaactaatgagtgaatgtgtatgctagtgnaggaattgggaatatagtgaaatttggnnaaagcctgagaaagaaatgttncnnggnntgcnnaatnnnagaaggngtcaatgttggtgtggcttcnatgggnataagatgctgcaagagntttntgtgcaatttaagtgcggcngatggcgggntgagggnaagagtaaanntgntgggtgnagggntgntgctgagnntgatgnaggcnctgctgcggtttggcccctgaangccnagaaantgtananngataannnagctaaggaaggaaagaanagaantttatggatannaaagtgtatgggagnanntgaataataaagtgnataaaatgtgnanttggtncnaggtaaggacnaaannctgaanntanaaatgaanaagaanntgcatctgcacaaagtggggaaagatgaactaaattatggggtggatgatgtgacattnattgggggaatgaggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagaacacgtggcggcttctgggggccatgtttggggagggaggtgtgcancagcctggagag

SEQ ID NO: 583599 - DNA, 822 bp, Homo sapiens
ggcgggagagagcgggtagtgtgcgccgcgcctgagagtgtggaggcgaaagggggcaggccaggagaggcgcagtgagcctttgcatgccacgcgcgcgccttccctgtcttgtgtgcttcgcgaggtagagcgggcgcgcggagcggcggggattacttttgctgctagtttcggttcgcggcagcggcgtgttgtagtctctgtgcggcagcgggtggagacactagcactatgtctggagagagcagttcggcagtgggacaggaggcgtgcgaggacatgaggcaacatgtggcgggatggtagtgccggctcgggtgtggcggagcacggagggagccattggtgtgctggctgacacagaggggcaagcgtggcaggggggcgggaacgcggagcctgggacctggtgtggcggtgaaccggcgtctggaggcaccgaagggggcagcgccgagtcggagggggcgaagattgaccgccagtaagaaccgagtgaggaatgaaggccattcaaaatcctccccaacgacaactctgaagcagacgaaaggcaacagcgggaaacgaatggacacactgttcatacggaaggccttaagctggggaacactacaacagaaacagaatcttgaacggacctaacatataccaacagtcaagagagaacgtttgtcagaccttgcactacctgaaagtaaggatccctatcacaggggcagatccaaagggagtaaggactatgtgccatttacacagaatcggcgacgtgtagaataacgccctgcaatccaaaagaaactcacattgaatcgagag

SEQ ID NO: 583600 - DNA, 601 bp, Homo sapiens
attatcctacagcatcgaagacgggaatagagcatatgcgcaatttgttcactcgcaaccgcaaaactagtagtggtttcgtcccagaggttttcagcagctggagaatatagatattctttcaattaaggcagttgacaatggtcgcccttcaaagtcatcaatcaacagactacatattgaatggatctccaagcccaaaccgtaccctagagccatttcattttgaagaatcatattttacctttactgtgatggaaagtagaccccgttgctcacatgattggagtaatatactgtggagcctcctggcatacccctttggtttgacatcactggtggcaactacgaccagtcactttcgatgtggacaagggaactggaacccatcattgtttgccaaaacctcttgattgcagaaacagaaagtacaaactacaacctcacagtcgaggctacagatagaaccaccactatacttcatcaggtattcctccaagtaaatagacccaatgaccctcgtcctcagttttctaccatcaagtaagaattgtaatcctgaagatacgcgccgaacagaatttgccatcaggcgggatag

SEQ ID NO: 583601 - DNA, 330 bp, Homo sapiens
gtagtgttctagaggattcctcagtaggcaaaagtctcttcaacttctcactactgtgaacaactacacgagaaagcaacaggctggggagaggggggctaactattctcacgtatttcttgggacaccaatgggcatggagacaggtcagaaagcggagagatgtgttaagtggcatcacaaggacaaagactgagcggagcgggtcagacaagagagatggaaaacatactacattccagagtcagactcacccgacacagtaacgagtaccagtaatttcctgagctatttaacatatgtgctaggaaattgttctaagatctgtaa

SEQ ID NO: 583602 - DNA, 1763 bp, Homo sapiens
  misc_feature (305)..(305): n is a, c, g, or t
  misc_feature (562)..(562): n is a, c, g, or t
  misc_feature (1496)..(1496): n is a, c, g, or t
tggcaacatacgttttatattactcaaggacaaccgggacgtcaccaagttgcccagtttcaggggggcttgtaggtgtgactcagggctgtgaacacaaaattcacggtggtgaacgcctgtgtgtgcttacagccctgtgggcatactttgtgggacaccgcaaaaggacacttcggggttacattagaaacctgtgacttgtgcttcttgaacgacatgtggtgatacatgtgtctttattccctctgagaaatatgtgtttccctctatacctctggtgtgtggcgcatggtctacaccanatctatatttactgcgctcttacacaggagggtctatactacaccatgggtgctggggtgtaaaatataaggtgtacttaggggcgctctaagtctaagagacctctatggagtgtaagtgtgcggcgcactctatctgggcgcacacaaataacatgtgggctctggggggccctgagagcgagctgagaacgtcttgtgtgggggctctacggagaaaacgctctggagactctggggctcacgggagaaagctncgagtactgatgtgggcgcgccacaggggagtatgagggctctggggtatttgcgcaagggccacaccacatatttaaagcgcgccatgtcttcccgaagggtgccccccatgttaaaaacgctctgaggaaagaacactctgggggccccaagaggtgtatgagagcaaggtggcgggtgtgcgctgggctaccagcatcttctctctggggagaagaggattctccaagagatattattcaatcgagcatattcatgtgtggccgataaaggggcagctgtggaacagcgcctatgttgcagcgacactattttatcaacgcgccaaagataacttttatcgacgtgatgttgttccccccatggggggagtattctaatgcccgtttatgtgaggagaaaaacccgaggggggactctttgggccatctggtggttcaactccaccaagagggtctgtgggaagtgatgacaaggtaacaaataagccagatactcgtgatggaacgttcacacgttggcagggtaccccactgcaacgtccttccacaaaaagggacatttaaaaggaggaaatctacctaccgaagtagctattgaagaggccgtcccccccaaagacaagagtggtggggacaccccaccaacagggcggggtgagcgcggattatacacaccagacggcgcccagggggcacaaacatagcggtgtacacaacaacacctatttggggggagagacaacaacgaggggggtaccacaaacaaatgtggttgcccacggggcagcgggtaatttgacacacatacagtggggagaccacacagaggaaaaccatcagggcaagggagggccccctcaacaggggtggggaacataacacgagggcggtacgagacaacaagcacaagtgcgcaccacttttcacccantggttaaccggagacaaggggcagcgcaaacaaacatgccaacccatggataaggggagggcatcgtaaactagaggagacacaaagcagacagaaggaggcagcacacaactagtctagatgaaagacacaccacaacatgaaagagagctccacacgagataatgagagaaacacaactagatgagatgaatcaaacagagtgtaagacaacagaacgttcacgtgctgtagcgtcttcacgtagctgcttgcgaacatgcgaag

SEQ ID NO: 583603 - DNA, 149 bp, Homo sapiens
  misc_feature (2)..(2): n is a, c, g, or t
tntctgactggaaggattgtttgccatttattgagattgggaagacaaggcagggtagatttctggggatgatcagtgaccaggacaggaacacgaggcggatgaggcgtcttgccaacacggccccggcctggtaaccagcccatcag

SEQ ID NO: 583604 - DNA, 631 bp, Homo sapiens
tcctctgatgcccgcgggtgtgacaaccgcagtgtccgacccaagccgccctggaggtttcttccgcgccatccaattttctaactctgcgccccgggcgtgttcacccctgcctttgtattgtttggcgctcgtggccgaactcactactgttctggaagccctccacctggcgcgtccttataaccgtccttttccaggagtctccaaatgtctggtcgcccaccagaaaagagggttttgaggaacttttgccaacgatccgtgttacctctggcgcttgcccccccccctttttaccctctggggaagaaacatattcttttgcttaataacaactcgtttctcgtggtccaaattatcaacgttttctctactttccaggacatctcaccataacattgtctcccagccgcctatacttctgcctcttacaatattttccgccaccccaccaccactaggggcgtctacatctcacccccccccacacacattacaccaaccatttaacagccctctcttctcaccaccgaaggaaaccacacccttctttgttcaacccccttccccccttttccccctttccccccacccccaaaacaattcccgggttttcccccaaaaaaaa

SEQ ID NO: 583605 - DNA, 235 bp, Homo sapiens
agctcagctgcatctacaagtcactctagaggattcccagcatgcttgggccccagatagatgtcctgacctttaacaacctgcggacaatggactacccgttgtgactcagaaagtcattgatgcaacacagtgtccagaaggataggggtttgatccctggtcttgatcagcaggttaaggatcaggcattgccttaagctgttgacatcttaatctggggcccaagcctgct

SEQ ID NO: 583606 - DNA, 151 bp, Homo sapiens
ggcgcggcgccctggacttggaacagatgacaggagcgtgaaggacttcgcagactgcgctgctttttcaaaacggacccgggcaatgcttcgttttctaaaggatgctgctgttgaagctttgaatttgactataatctggtttgcaaca

SEQ ID NO: 583607 - DNA, 349 bp, Homo sapiens
tatatctgttccttggccaattatttctaaagacacactacatagaaagaggccctataaactcaaaaagtcattgggaaacttaccgccaattcgactaaggagaggagacacgcccatatgaacgactagagcacatcagaactcctgtggggaggaaaccttataaattaaacacatggcccccttagagaccacaggcgaggcctgcctccatgcttccctctccttttctgccacctttccccctagctggctcctttggacctacccctgtccttgctgacttgtgttgcattgtattccaaacgtgtttacaggttctcttaagcaatgttgtatttgcagg

SEQ ID NO: 583608 - DNA, 166 bp, Homo sapiens
acgtgtatgtcacggtggggttgttctgttttgttgtttttttcttttttcttttcttctttttccccagaaactcgctttttaattattttgttgcgtttcattttcattttcattttttggagacggagtctcgctctgtcgcccaggctgggttgcagtggcg

SEQ ID NO: 583609 - DNA, 188 bp, Homo sapiens
gaccgttcaggtccttccaagtcaatcaccactggtgcgtgtaccgggggcgatcatgacagcaggacttcacaagctgttttcccacaggagggagccagacagttaagccttatcggggaaaggccttccaggggaaataacacggggccggggatcttagagggcgattccagctttaacttggg

SEQ ID NO: 583610 - DNA, 108 bp, Homo sapiens
  misc_feature (9)..(10): n is a, c, g, or t
  misc_feature (94)..(94): n is a, c, g, or t
tcactatanncactgctactagggaaccactgctgctccatagtgcttcctgctgctatagtgcttcctgctgctatagtgcttcctgctgctntagtgcttcctgct

SEQ ID NO: 583611 - DNA, 656 bp, Homo sapiens
  misc_feature (128)..(128): n is a, c, g, or t
  misc_feature (181)..(181): n is a, c, g, or t
  misc_feature (183)..(183): n is a, c, g, or t
  misc_feature (192)..(193): n is a, c, g, or t
  misc_feature (195)..(195): n is a, c, g, or t
  misc_feature (205)..(205): n is a, c, g, or t
  misc_feature (215)..(215): n is a, c, g, or t
  misc_feature (227)..(227): n is a, c, g, or t
  misc_feature (231)..(231): n is a, c, g, or t
  misc_feature (237)..(237): n is a, c, g, or t
  misc_feature (239)..(239): n is a, c, g, or t
  misc_feature (244)..(245): n is a, c, g, or t
  misc_feature (250)..(250): n is a, c, g, or t
  misc_feature (253)..(253): n is a, c, g, or t
  misc_feature (257)..(258): n is a, c, g, or t
  misc_feature (262)..(262): n is a, c, g, or t
  misc_feature (265)..(266): n is a, c, g, or t
  misc_feature (268)..(268): n is a, c, g, or t
  misc_feature (275)..(275): n is a, c, g, or t
  misc_feature (301)..(301): n is a, c, g, or t
  misc_feature (340)..(340): n is a, c, g, or t
  misc_feature (656)..(656): n is a, c, g, or t
agcgggagggagggagaggcacagtcagagggaacgcccgcgcggggagccagggcgcccgaccccgccgcgccgcagcggcgcgcagcccccgacgcgccctgtggggacccggaccaggagggacnctgcccgggaaaaggctgtggagacctgggctccgaccccagttcatcccccncngaaccccgnngncccgtgccanccgtggtccncgctgggagccntatnctgccncntcgtnntcagnccngggnntggncannantcgcggngcatggcggtgaccatgctgcaggantggtgccggggatgggggtcaacgctcgcaggggcctgntcatcctgggcatccctggaggactgtgattgagtgccggaattccaagatgtccctcgagggcgtggccctgagggccctattggagagcactttgagcacgtcgcctaaggccaaaatgcggctttccaaagaggggaccgcactatagtgcgtcacgcaagatggcgccgagtggggaccgaagcattcgagaagcggggcgaacggtccaaacttagtggcctaccggcgccagcgcagagggacaaattccgccagcgggacatggggcggccacgctaggaaacagttggcgacaaagagagacgcccgn

SEQ ID NO: 583612 - DNA, 249 bp, Homo sapiens
tgtctatattggggaaatgtgaaggactgggtacgtgatagtaatcaggatcaatgagtattagcaagttaatgttatgataggactttgacgttcagatatatttttaaatccgtggaggactagcattaagttgacatgctgatccagagtgctacacacgaagtggattcagtgaatctagagaagacagcagcagacacggattccacggaaccacgtgttctgatgaccgctacggactgacgg

SEQ ID NO: 583613 - DNA, 396 bp, Homo sapiens
cagtttatgcaggcaccccatgagcctttttcccaacgcttaatgactagtaatgttaaacatcttttcaggtgcttatgggccatttgtataactactctggagaaatgcctactcaaatatttttccttttcatttttttaatttgaggcagggtcttactctgttacctgggctggagtgcagtggtgtgatcatagctcactgcagcctcaagctcccaggcccaggtgatcctcccactttagcctcccaagtagctaggaccacaggctcacaccaccacacctggctaattttttaaatttttggtagaggacaaggtctcattatgttgcccaggctggtctcaaactcctgaggcaggaggatcatgtgggcccaggaatttgagac

SEQ ID NO: 583614 - DNA, 276 bp, Homo sapiens
caaaaaccaaacaaaaaagagtaataagcacttagaaactgctataacaatctaatattctcacacattccagaaatgtatcacttttctacttattagtatttgttgagactgggtcttgctgtgttgcccgggctggagcgcagtagctattcacaagcatgatcacggctcactgcagcctggaacttccctgctcaagtaatcctcccacctcagcctctcaagtagctgggactacaggcaagcaccacgcacctggctgcaatccatttt

SEQ ID NO: 583615 - DNA, 638 bp, Homo sapiens
  misc_feature (348)..(348): n is a, c, g, or t
ctcgctgcgcatcttgtggggctgacaacctgcaagccaagaagtacgagaaggggcaggcgcggtggctcacgcctgtaatcccagcacttgggaggccgagacgggtggatcacctggggtcaggagttcgagaccggcctgaccaacgtggtgaaaccctgtctctactaaatgcaaaatattagccggacgtgggggcgcgtgcctgtggtcccagctgcttgggaggctgaggcgggagaatcgcttgggcccgggaggcggaggttgcagtgagccgagattccgccagttgcactcctaggcctggacaagcaagtagggctaagaagctctggtctcagnaaagaaagaaaagaagaaagaagggtaccggggaaaagaggtcggcagaaagagcgcgagagccttgtctcgcccgaggtggccgaggagacattccgagagattaaaagcggagagagagagaacctagagggggaggggaaaggcggcgaaaggccactgagcgcggccgcgaagaagacagatagcgcgaagaagcgcgccgccgcgcgcctcgaaagtgaagcgtttccagcgcctgcggggcgtacctgcggggcccatttctttaagcccgtggtgagaatgag

SEQ ID NO: 583616 - DNA, 171 bp, Homo sapiens
atggggccattttttcccctttttgccccctgggggtaaaaaaaaaaaaaaaaacttttttttgggcccttttccaaaaaaaaaagccttggggtttttccccggggggggtttttttttttaggggggggccggtttttccccccccatttaaggttgggggattcttta

SEQ ID NO: 583617 - DNA, 175 bp, Homo sapiens
gccgggtattgggtatatataatatataatatataataatatataaatacgtaatatttggaattatttatatatttatattatgtatattatacatatgtactattatatatattatacatatacactattactcctgcaatagtggccataatttaagaattaaaaaaaaaaa

SEQ ID NO: 583618 - DNA, 823 bp, Homo sapiens
  misc_feature (364)..(364): n is a, c, g, or t
gtccccccggggggcgacggttcgattaaaagcctcttggcactgtccggtatttcgcctggtttcccccctcttggggaggccgtgtgttatttccctcgcccaagcccggcggtgtaatgttcttcctccccggggtgctccttggtcacgtggcccactcttaggttgcggcgccggccgttccttgtttttcaaggtgcccacccccgtccaccttccagtgtctgtgtgcccccctcgctactgtgtttgcacgcggggcgactgtattcgttctggccaaaaccccgatccctcggttcattacggggcacccctctgtgcgttgcccgacgcacccccctggtttggacataaatantgcgggtatcggccaccggcagaaatcggtgggtcccccaagttgggggagcacaaagaatttcaggcacgagctcaaactcacgagacaatggaaaccgaagcgcccttgttggagcacggtttttataagcgcgccccctaatattcgccagctattttcttctctccacaattcggtctgcctgcaagacaacaacttatatgatgatgtgtgccgacaggaccacggtgtgtgtcgtacattgcgcccgatggtggtctacgagagacaactacccagcacatgacgtgtatggtgtgtgagatccacgacggggtgtttgtttttcatttactcaaaagacgtcgttgcggtttgtatacaattacccacaagaggcggtctgagatcaaaagacacgacttaagagcatctgtgtctgcgaccttaaaaaaataacaactgtcccacatgaca

SEQ ID NO: 583619 - DNA, 146 bp, Homo sapiens
tggggaactgtacggggtgggccccccaaaagaggctttccatgccaaccccggctttatttggtaaaagtaggccctgtgccctccggccacctggatccctgcccctcccccctggggcggaataaatgtttttcagacctgga

SEQ ID NO: 583620 - DNA, 370 bp, Homo sapiens
tgataaggtggcagactgggaatcccgactgaaaatatttaattcgattcagagacaaagcatcatatctcggaaattttagacacttatagtgtacctaccactctagactataaaatcatatacacaaaggccatattccaatagagaatgttcccccacctacttaaaaagtttctcaacggataattagcatccatattaagaaactgcctcatgaaatattaaaaggtgcgaaagaaataagctcgattaaaaggcttatgcacgtgtacccaagactccccttgacttacagagggcttaccctaaggttcgagataggtcacggcactatttacaacatttatgccagtaacagattatcttt

SEQ ID NO: 583621 - DNA, 695 bp, Homo sapiens
  misc_feature (29)..(29): n is a, c, g, or t
  misc_feature (72)..(72): n is a, c, g, or t
  misc_feature (75)..(75): n is a, c, g, or t
  misc_feature (83)..(83): n is a, c, g, or t
  misc_feature (96)..(96): n is a, c, g, or t
  misc_feature (146)..(146): n is a, c, g, or t
  misc_feature (177)..(177): n is a, c, g, or t
  misc_feature (179)..(179): n is a, c, g, or t
  misc_feature (211)..(211): n is a, c, g, or t
  misc_feature (275)..(275): n is a, c, g, or t
  misc_feature (306)..(306): n is a, c, g, or t
  misc_feature (335)..(335): n is a, c, g, or t
  misc_feature (473)..(473): n is a, c, g, or t
  misc_feature (509)..(509): n is a, c, g, or t
  misc_feature (521)..(521): n is a, c, g, or t
  misc_feature (693)..(693): n is a, c, g, or t
agcagaaggcacgcagcgccctgggcgcnccgagctccccagggcaggaggccgagcgccctggcgctcggnagnaaggcagncacggggtccagnctgctgcagcggcgtgcagcggctcgggttgccacggcgcggccggcagncttctggtctccattaagcagcggttgcggngncctgctggttgaaatggcacaagggagggtgncagcgggtgtgaggcaggggtgccattctgagggccaggggttccgggcgcaccagggcacagnaactccaaggtcggcccagccaggggcctgnccgcctgggcgaatgggctccttggtggngagggagacggggtccaagaagtgggggccgccagccgcagccttcagcgctgcaggcctcctcctggggtggtgcggaaggcagccaccgaggggtggggccccaggaggcagccccaggcctggccgggggctcantggggcatggttcacagcaatattgccaatgaagancgggagggtcanagtagcttccggcgccttcagagagacctgtgagtagtagtcggtgtggatgaggctgcagcccggcaggccggactggggcaaggcaggcaccaggatctgctcgtgcatttcgcccgccgccaggcttggacgcccgcaccctccacctccgcaatggtccgtacgtcgngg

SEQ ID NO: 583622 - DNA, 228 bp, Homo sapiens
ttgggggggtttcccccttggccggttaaaaaactttcggggcccctttttttcaccggggggggttttttcccttgaaaggggggtttggaaaagggggggccccctttttttttttgggggggcccccccccccccagggggggttttttgccccctttttcccccccctggggggtttttggttttggccatttcccccccaaaaaattaattatttttttccca

SEQ ID NO: 583623 - DNA, 645 bp, Homo sapiens
  misc_feature (31)..(31): n is a, c, g, or t
  misc_feature (184)..(184): n is a, c, g, or t
  misc_feature (463)..(463): n is a, c, g, or t
  misc_feature (503)..(503): n is a, c, g, or t
  misc_feature (612)..(612): n is a, c, g, or t
gctgggcgtgatggtgggcgcctgtaatccnagcacttgggaggctgaggcaggagaatcacttgaacccgggaggcggaggtgcagtgagccgagatcgcaccattgcactccagtctgggcaacagagtgagattccgtctcaaaaaaaaaaagaaagggaaaaaaaaatagcattataccncttcctggtctcaaccgccatgaaaattctgaacactccaaattcagtggaataatccaaaacaaaatttataaggtataaaataatttacttcttatagtaatagtatactttaaaaaggcctcagggtatattatcttctaaacagctacaattcagtggcagctacattaaccaactatgttctctagtggagaacaactaggcctatttcactggctgtgtagcctcagtggcctaacatgggtgccaaataaatattcgtagaattaccctgantgtgtaaaaaccattcgtttggtttacaatgtgccaaaantctcaaaggccctgtatttatgtaattctttgacatcattatctattggattctcagttatggactgcctgggtgtgacttagctactttaggtactcaatattataanacctcaatattgcttgatttacacaaatcttcc

SEQ ID NO: 583624 - DNA, 351 bp, Homo sapiens
taagtaaatatcagtttaatttacaaacatcagcagtgtaaccgatattaatctggagaaagacaaagcacactgaattattcatgtacatctaattttctttgtaaaaaaagaagttttcaggaagagacatctgcatttttacagggcaccctgggattttaattgggggaagagcccagttcactataaacccttatcaattctacattggaatttaacagcaaacatggttaactggggagccttaagataataaagggattttattggtttgagggaaaaaaaagtcccagttcttgatatgacaattttttattccccacctacccccacaaaaggcaaaaaagg

SEQ ID NO: 583625 - DNA, 810 bp, Homo sapiens
gttcccccccccctcttccttgacggtcccccagtgtgttactggtgtctgccatttgggcaccccggggcccactgttgccacggttctcactcgaggtagactacttcgaggcctccccgaggggagacttggtacagccagggccggtattttggcatcctccgacttcgtgtgcttggaccgctggaagttattcctcggggttggacagcgggagaggccctggcttactcgggggcttcttaccctctagtcaccttgccccctggggatggaatgagctggagcccccccctgggtgactgctcacatcagcctctgtgatggccgtgtgagctggactgtgtcagcgacgactcgagcactcattcttgctccctatgttatttcaagggcctcccagggcagcttttttcaggatccctgatcccaaagagcccctgggcctcccctagggtacactcccggcccattccaggacccgcccttttacccctgcagaagaagacaccatgtggagcaatcttttggactgacatccccttatctcaggccaaccgaagttcccacccccgactaggggtcaaggcagctagctacctaccttgccccgtgctgacccggacctcctcccggatacagcactggaggtggcccccccctcttttacttctgtttgaaaacccccgactaggcagctgagattttgggttttccacacgggccaagatacccggcctctgctgaggtcactccccttttcaccagctgcttaagggagccccaataaaggtattcgatttttta

SEQ ID NO: 583626 - DNA, 165 bp, Homo sapiens
gcacttggaggcgcgcgggtggatattagctaggagttgaacagcctggcacatggtgaacctgtctctcgtataatacaaaaattagcctggcatggtggtgcatgcctgtatcacagctactcgggagggcggggcaggagaatcgcttaaacttgggaagcg

SEQ ID NO: 583627 - DNA, 236 bp, Homo sapiens
ccaggtcccgggatctcgctccgggatttggcgctttgcccttctattctcgaaggggtgtaagcttcccccactgccccgtgcggtcactccttttggggtccccccggtggcccatatctccctgggggcccccccgctgtgacctatacaccttggaccacattctctgggggtccgcctcctcccccttaggccgcaccctttttgataaatttgaaaacaccccacatagc

SEQ ID NO: 583628 - DNA, 384 bp, Homo sapiens
  misc_feature (205)..(205): n is a, c, g, or t
  misc_feature (340)..(340): n is a, c, g, or t
attgatttaaaaaaatcttgatcaggaatactgatgtgtggtgtttttttcttatagtgtctgtctggttttggtatcagaataatgctggcctcatagaatgcatttggaagtgtcctttcctcttcagttttttggaagagtttgaggagaattgatttaattcttcagatgtttgccagaattcccatatggccctgggctntttctttcttgggaggcttttctttactacttcatgctcttgactagcataggtctgttcagattttccatttcttcatgattcaatcttgataggctgtgtgtttctaaggaatttgtccagttcatctagggntatccaattctttgatatgtaattactcatagtactcttaatcc

SEQ ID NO: 583629 - DNA, 146 bp, Homo sapiens
tcactagataaaatgctactgaattgactaggaaatccataagagagtgctggggaacgttattcccatgagaggtgcctcagatggaaggcgctgtgtctccatacgcaacttctgagggctggagggtgccaagggcagctgct

SEQ ID NO: 583630 - DNA, 778 bp, Homo sapiens
gtgcggctgctgtcccagtagcccggcccggcctcgtgcaccgcgtgtcgtggtgggtccctgttggcccgcggctgcatgggccgtggcggcggcgaggccgaggggcgggaatgccactgcccggcctgtgcagtgtgaacgtgcaatgtcgatcccctaacccatgaaagccccaggcgcggtctctatgggcggccccgctcctgcttctgtataatttttataacggacagggatgtcggctcataccgcccgggttgtaatgcaatggtgtgatcacggctcaccgacaggcctcgacctcccggggctgaagcgatctttcccggcctcagccatcctgagataactgggaccacagggcgcgccctgactggattataacaatattaatatatataatactaaaatgaggacacaaaaagagggatccgacaaatagattgaaagaacgaagcatgagaattcacacagaaatccacctggccacaagagaaaagacgcccgagatatgttaaaagaggtcacccacaaaaaattgccgccgaaaatatcaacaccagagagaatataaacacaccaccaggatgacgagtgagaacacaaatattttcgaactaagtatgcaccccaccgatgaagaaattgacagtaataaatggagcccaacgagacaaacaacaataggagggaaacccccaaatggcatcaatacactgatatgaaataaacaaaacataatttaatagcgaagacattctttttgaaacccata

SEQ ID NO: 583631 - DNA, 175 bp, Homo sapiens
ctcatcactacagctaaagggaggaccctatcttccaaacctagatgcttctcaaaccatctaggtctggaaaacattccttttggtgcttttgttaagtgttcatgcaaagtaggttaacgatttattgactttaacaaggaatcatcggagatgcatgaccctttaacgaatt

SEQ ID NO: 583632 - DNA, 117 bp, Homo sapiens
  misc_feature (18)..(18): n is a, c, g, or t
cttaagcggcgtcctttntttctccttttgggccttactcagccccaactccctatcctcctcttaccccctatccacatacttgtactcccacaaaagagcacacttactcccaaa

SEQ ID NO: 583633 - DNA, 309 bp, Homo sapiens
agagtaagatacaatatcagacatccaactattcaacacgctttctaatttttggaagttttctattgggtcttgtattttaatattcatcaattgataagtagactcattatcaaattggtaaaaaacaattttaaccggtttcaattcaagacctaataattttaattgtatttgagttaaaaggaaaggcccattattcttgaaaacaggctccttaaaatctttaaaggtgccactgtctacaaactgaacttcaccaaaatgaataatattggtgtcataatcgtaataaagaatcaaactgcc

SEQ ID NO: 583634 - DNA, 696 bp, Homo sapiens
acccgcccaggcaactttaaaacggttccatgaagaagaagtcgaaacccacccgattctgtttatctggtactagtgcaagtgaaaaattgaacccctgccctctagatgttcaaaatccgcttcaaagcttcggtcagaataaattcaccaccaccgatttcttagcaatgccaagaaggaaaatgccaaaattagttataagggaatagcttttctgtgttaaagtgtcagaaggagccttaagaaaagccattccatttcttcaaagcgttactcgattaccaggtgaaagaagtccccaaagaaagtgattccagccatcgccgggttaatccaacttaagaaatttattgaagtattctcgcccggcaaaagtgcttctttgaccaactaagaactggtggccaagattttaataattaaggtcaatcaaccaaccaggttggccaaccacctcaataaggtggtggaagaaaatactttatttaataaccagagttcaattaccccagaaaaccttcccgaggttcacaaatccaacacaaatggtgttaataaccattccactctacacacccttggcacacttgtaacaccacggttatccaaaaatggttaatgtaaatatcccggaatggggggtttggtaaataataggtggtaataaaaataaattgcccaaagcccccttta

SEQ ID NO: 583635 - DNA, 985 bp, Homo sapiens
  misc_feature (21)..(21): n is a, c, g, or t
  misc_feature (24)..(24): n is a, c, g, or t
  misc_feature (30)..(30): n is a, c, g, or t
  misc_feature (40)..(40): n is a, c, g, or t
  misc_feature (55)..(55): n is a, c, g, or t
  misc_feature (58)..(58): n is a, c, g, or t
  misc_feature (79)..(79): n is a, c, g, or t
  misc_feature (81)..(81): n is a, c, g, or t
  misc_feature (83)..(85): n is a, c, g, or t
  misc_feature (90)..(90): n is a, c, g, or t
  misc_feature (96)..(96): n is a, c, g, or t
  misc_feature (102)..(102): n is a, c, g, or t
  misc_feature (109)..(109): n is a, c, g, or t
  misc_feature (118)..(118): n is a, c, g, or t
  misc_feature (130)..(130): n is a, c, g, or t
  misc_feature (138)..(138): n is a, c, g, or t
  misc_feature (142)..(142): n is a, c, g, or t
  misc_feature (150)..(150): n is a, c, g, or t
  misc_feature (162)..(162): n is a, c, g, or t
  misc_feature (179)..(179): n is a, c, g, or t
  misc_feature (185)..(185): n is a, c, g, or t
  misc_feature (191)..(191): n is a, c, g, or t
  misc_feature (234)..(234): n is a, c, g, or t
  misc_feature (236)..(236): n is a, c, g, or t
  misc_feature (238)..(238): n is a, c, g, or t
  misc_feature (241)..(241): n is a, c, g, or t
  misc_feature (246)..(246): n is a, c, g, or t
  misc_feature (263)..(263): n is a, c, g, or t
  misc_feature (290)..(290): n is a, c, g, or t
  misc_feature (308)..(308): n is a, c, g, or t
  misc_feature (328)..(328): n is a, c, g, or t
  misc_feature (335)..(335): n is a, c, g, or t
  misc_feature (351)..(351): n is a, c, g, or t
  misc_feature (354)..(354): n is a, c, g, or t
  misc_feature (420)..(420): n is a, c, g, or t
  misc_feature (429)..(429): n is a, c, g, or t
  misc_feature (436)..(436): n is a, c, g, or t
  misc_feature (449)..(449): n is a, c, g, or t
  misc_feature (453)..(453): n is a, c, g, or t
  misc_feature (465)..(465): n is a, c, g, or t
  misc_feature (478)..(478): n is a, c, g, or t
  misc_feature (497)..(497): n is a, c, g, or t
  misc_feature (500)..(500): n is a, c, g, or t
  misc_feature (502)..(502): n is a, c, g, or t
  misc_feature (507)..(507): n is a, c, g, or t
  misc_feature (533)..(533): n is a, c, g, or t
  misc_feature (536)..(536): n is a, c, g, or t
  misc_feature (543)..(543): n is a, c, g, or t
  misc_feature (553)..(553): n is a, c, g, or t
  misc_feature (648)..(648): n is a, c, g, or t
  misc_feature (677)..(677): n is a, c, g, or t
  misc_feature (704)..(704): n is a, c, g, or t
  misc_feature (741)..(741): n is a, c, g, or t
  misc_feature (759)..(759): n is a, c, g, or t
  misc_feature (785)..(785): n is a, c, g, or t
  misc_feature (792)..(792): n is a, c, g, or t
  misc_feature (795)..(795): n is a, c, g, or t
  misc_feature (806)..(806): n is a, c, g, or t
  misc_feature (830)..(830): n is a, c, g, or t
  misc_feature (848)..(848): n is a, c, g, or t
  misc_feature (856)..(856): n is a, c, g, or t
  misc_feature (887)..(887): n is a, c, g, or t
  misc_feature (889)..(889): n is a, c, g, or t
  misc_feature (892)..(892): n is a, c, g, or t
  misc_feature (895)..(895): n is a, c, g, or t
  misc_feature (921)..(921): n is a, c, g, or t
  misc_feature (940)..(940): n is a, c, g, or t
accggttctacagcacccggngcngcggcngtggccaagnccgcaccgggacgancancccggggacctggctacaccngnannnaaccnattganggcaantttcgcncgactgtcngaaatgacacancgcaaacnccangccagctntcaacattcagnaagaagtcaacggtaantactantcttcncgacgcagaatggccgacaatgcctgtgttctttttgccgtcncngngcnaatgnttataatcacgttcaangctcgcgcttatatgagagacagattnctatatcaagtgaggtangccgactccaatctcctgtnaccgacnttttcgacttcgaccncantggcctggatgcaataagttctctcaccaatctgccaagaatcaaagaatatctcgcgatcatacnaccatgatnatcccanacaaagatgaccnccgnggccttgcgacnccagcggcctccngatggcattgtcctcgtgngcnangcctnattcatcaatattaaggctctatacnaantaactgngtatggaacngactataaatacatacaacagaccgaaacgagccggagattagctgtgtaccctgcctttagaagcacctcctcagtacgttttgccaacctatnaaatggccgtgaaaatgcctgaaaaaganccaccacctccttacttacctgcctgnagaaattctgcctttgacaataaatcctataccagcntttttgtttttttatgtnacagaatgctgcaattcagggctctncaaactngtntgatataaaanatgtagtcttttgtttaagcattnattttcaaacactaaggnagcttttngacatctgttaaacgtctttttgtttttttntnaantcntttacattttaatagtttttgaaganaatctagggttaagcaagngcaaagtgccattgtttgcctttaattggggggtgggaaggaaaa

SEQ ID NO: 583636 - DNA, 361 bp, Homo sapiens
  misc_feature (1)..(1): n is a, c, g, or t
ntaaagaacaaagcagaagtcattcatttattcaaaatctgagcacagagagaccccaacagtctggacactcagtagattgtataatgtgggtcttattcacacagggatgtttggaatccaataacaaagtcctctgagagctgccaccaaaaggttaaattgaaagttgtaagttgaatgactgatcagcctctgattccactgggtgtgggcgctcctacctgtaatcccagctctttagaagcctgcggcgggcagatcgcttgagtacaggagtttgaaaccagcctaggccacatggcaaaaccacatttatgtttcatcagtcctcacaggacagtctctccctcgatttctc

SEQ ID NO: 583637 - DNA, 343 bp, Homo sapiens
taggcaggcccgggttagggtcctggtctcctgacatctagttcctgctcaagagtgagaactgttattattattactattattgagacagagtttcactcttgttgcccaggctggagtacagtgccacaatctctgctcactgaaacctccgcctcctgggttcaggcgattctcctgcctcagcctcccaaagtgctgggattacaggcctgagccactgtgcctggcgtttttttgttgttgttgttgttgttttagacagaatcttgctctgtcaccaaggctgagattgcaccactgcactccagcctgggcaacaaggcaagactctgtctcagaa

SEQ ID NO: 583638 - DNA, 175 bp, Homo sapiens
gatgcccctgagaagagtaactacccccttcgtcctatttccggtccctgtgacctctattctgctttctgtctatatggattcgcctatttggatattcatattaatagaatccacagtaggtcactcttggtgttcagcttttttcagcttggcataatgttttccaggttca

SEQ ID NO: 583639 - DNA, 306 bp, Homo sapiens
ggggggtttttaaaacccccccccttttaaaaaggcaagggttgggcccccccaaggatttttttttcatgggaaaattttcccccccccacccggaatgttggaccaaattgggggattttttttataattttttggcccggccaaaggaagctttttttaaaagggcggggtttttttttttttttgggacccccgcccccggatattggggggcggttttggttttaaaaaaaaaggattttttccccttcctaaagggtttttttttccccccccctgaaaaaaaacccccccttgggggga

SEQ ID NO: 583640 - DNA, 159 bp, Homo sapiens
gcagcgctctactcctgagactaatctgcttctacagcacatcttgcgctggagaccagatctcatccagactgaggaagtgacatgtctgaagaaggaaagacggccatgctgatccccaatgccattcagatctgcacggagagcagaaggtcgacg

SEQ ID NO: 583641 - DNA, 321 bp, Homo sapiens
  misc_feature (1)..(1): n is a, c, g, or t
ntgacatgtaagagggaacagggtaacaggaatttctgagatcttttctgctccctttctcttttatctggaacttttcttgtctttgcttctgtggccctgttcttctcagtctggagtctactcctaggagtttttctaaaagaagtatcagtttcaagagtttacatggcccagactgctctaacacctatttgcatggcattgttcttgttctcagcctgagaacaagatccttcagagcctttcccagatgaggctgctattctgagactagtatgccattgaggcttcagggaaggatcgtgagagagggaagga

SEQ ID NO: 583642 - DNA, 401 bp, Homo sapiens
  misc_feature (2)..(2): n is a, c, g, or t
  misc_feature (66)..(66): n is a, c, g, or t
  misc_feature (165)..(165): n is a, c, g, or t
  misc_feature (218)..(218): n is a, c, g, or t
  misc_feature (226)..(226): n is a, c, g, or t
  misc_feature (329)..(329): n is a, c, g, or t
  misc_feature (337)..(337): n is a, c, g, or t
  misc_feature (346)..(346): n is a, c, g, or t
  misc_feature (353)..(354): n is a, c, g, or t
antccttataatttggcacaaacagcagagactgaagctcctacacatgttgaactgctgacaggnaaagaacccagtagataaatctaggctttccactccatatattagctgaggcaggagaattgcttgaatctgggagacggaggttgccgtgagccaagntcacgtcactgcactccagccctgggcaacagagcaagactccgtctcaaatnaataaatnaataaactaataactaaatgttgtaacacaaaagaggatgaatgcttaaggtgatggatatcctgtttaccctgatgtgattattacaaattgcatgtctgtnccaaaatntctcatgtncccgatnnatatatatacctactatataccgacaaagtttaaaatagaaactgga

SEQ ID NO: 583643 - DNA, 115 bp, Homo sapiens
agggcgcttgtcaatacgtgttgcaaccctgcccatggaggcacccgagtgctggaccttcaccggctccaatctcagcttctggctgcggtaggggaggctatcatcgcgatgc

SEQ ID NO: 583644 - DNA, 145 bp, Homo sapiens
cataagtcattattacctcactgtcaaccaacacaggcatgtcataaggcaaggttaaaaaagtaaaggaactcggaaatcttacccggctgttacaaaaaatactctagcatcacagtattagaggcactgctgcgtacaagtg

SEQ ID NO: 583645 - DNA, 584 bp, Homo sapiens
  misc_feature (151)..(151): n is a, c, g, or t
  misc_feature (158)..(158): n is a, c, g, or t
  misc_feature (210)..(210): n is a, c, g, or t
  misc_feature (265)..(266): n is a, c, g, or t
  misc_feature (270)..(272): n is a, c, g, or t
  misc_feature (294)..(294): n is a, c, g, or t
  misc_feature (334)..(334): n is a, c, g, or t
  misc_feature (450)..(450): n is a, c, g, or t
  misc_feature (483)..(483): n is a, c, g, or t
  misc_feature (508)..(508): n is a, c, g, or t
  misc_feature (556)..(556): n is a, c, g, or t
  misc_feature (568)..(568): n is a, c, g, or t
tgttaccaatctgaaaaccccctcagccgcctacctgtgggtgggtacaggagccagcgaggagagaagacgggggcccaggagctgctcagggtgctgcgggcccaacctgtgcaggtggcagaaggcagcgagcagatggttctgggangcctggngggaaggctgcctaccgcacatccccacggctgaaggacaagaagatggatncccatcctcctcgcctctttgcctgctccaacaagataagcttgctaaaggttcnnggtnnntcctggttgagctcatgcaggnaagacctgggaacggatgacgtcatgcttctgggacaccntgggaaccaggtctttgtcttggggttggaaaggattctcaagaaagaagaaaaagacagaagcctttgacttctgctaagcggtacatcgagacggacccaagcaatcgggattnggcggacccaatcaaccgtggtgaagcaaggcntttgagcttccctcctttgttggcngggttccttggggtgggatgatgattactggtctgtgaccctttgganagggcatggctnaagtggctgcctgagg

SEQ ID NO: 583646 - DNA, 463 bp, Homo sapiens
aatataattgtaagtcatccacgctgttggtctgcaaacttttgaggtaactacacacacacacacacacacacacacacacacacacacaaggattttagatttgaaaatgatgttttttactcatttcaaaatgtactgtaacctttctttggttcttactgttttcatttaactttctctgttttcaagaaaagttgtctttattgacatttgtaaaaaagaatgtgttttgcccagttattaagtattttatttttatgcaatttcagaatcacaatgaggtatgtcattgcttcatatacatgcacattcacctcaacttgcacacacatcacacaccaaaccttatgcaaaggggaaagctaacacttagagtggattttgtcccttaaggaaatggattgttcctgcatatattgctggtggcagtattcagtcttgtgttctttttctaaaaaaa

SEQ ID NO: 583647 - DNA, 529 bp, Homo sapiens
cgcacaggcatccaggccccaagttgggcagagtgctcagacctcagagtagtgtccagggcacggtctccgggtcggtggtccagagctccggcgagaggactcgaatacgtccatcgagtccagtcccaggctgtgtcctgggacaacaatcccaggttcagagctacagcctcacaggcgattccagtgcagccacatacagtctgttcagatacctgcccaaggccaggcgacagtcacaaggccagggtacaggcgttcaactcaaagtctttcatcaggacaagctttaagtcgagtgactgtttcatccccatcgcgtcctcagctacaaatacagcagccacagccccaagtcagggctgtgcctcagctggaacaacaagtccaggttctctctcagatccagtcacaggttgtggctcagatacaggctcagcaaagtggtgtgccccagcaaatcaaactccagttacctatccaaattcagcaaagcagtgctgtgcagactcaccagattcagaat

SEQ ID NO: 583648 - DNA, 972 bp, Homo sapiens
ggtgtttatgaaaatcattgagttgacaaggtgcctatgccattgttaaattgtctttaggtaatttagacaatagatttgctaattccacatataaaaacatgtagaaaacacagaagatcttaccaggatatttgtaaaggtctgggaatcacaggttggcatcctttattcaggtctcttctgcctccaaggctacacttagaattgtgtgccgaggacaatgggagtataaccttgcagttgatgtgaaacaccgaatatccagtctgcccttgcaaaagaggcaaaatgcatgattggtatttctgaagctcaccgggacttgcgccacccatcaaacgtttacgaaatgggcatgagtatctgcaattctcttgaaagatgtacccccatcctttcaataatgcctacaacgatgagagaaaatattcccaatttggtggaaccgattggtcttagcccttgcgtgcgtgcgccctcactctcgtgcgccccggggtttttgttacaacttccacaagcggcatttacaagttaacggctacctgtctttcgaacacctttcggttctcgttcacccaattggtcatacattttttccagatggatgctttgatcgcaagggtgataccagttgagggattctcggccaggaaaagagtgcgtaaaaagtgtcaccacattttcttcaagcctttggatggtaggggggccctagacagtttctggcgcacctctgcctatgatatgacgactgcctgaggaccgtataataccgtgggccaacaaagggctacaaccgtgtccacaaagtggcacgttgtcagctctctgtatcctatcacacctttacgtcaagtttatacacacacgtgtgccccgtgtcttttaaacggcttttgcgcatcattcggcgaaaagatgtctccagcctggctgaggggcacctttacacaccccccggggcac

SEQ ID NO: 583649 - DNA, 127 bp, Homo sapiens
aagcagttaatacagactcattgtctgtgttgatgtgttagcaacacggctgtgtttgacatgactcgtggaacctgtgaaggaagctggtctcatagtactaaataggtggtctacggagcagctg

SEQ ID NO: 583650 - DNA, 178 bp, Homo sapiens
  misc_feature (1)..(1): n is a, c, g, or t
  misc_feature (75)..(75): n is a, c, g, or t
ncaccacttgtgctggactctggtggacgcggaccacctcccctacacttcacacggccactggacctacctttngtacaaacctcctacaacacctgaccaattcaaaaaaactgtgggttttttttttttttttttttttttttttttttttttttttttttttttttttggtttg

SEQ ID NO: 583651 - DNA, 247 bp, Homo sapiens
gcgttgctggtgcttggctatttctcctcctgtgtttcttcggctttgtgttgttgctttttctgctgggtgatgctgcgtcgtcgccccgtctgtggggtcgagttctttgcgtggtcgtcttttgtctgctgctagcttttggttctcccgttgcctcggggccgtgttgctccgtggcctgggtatctcccgcgtgtattgctgttctgctctcatgctcttctttctctctaccgctgctggt

SEQ ID NO: 583652 - DNA, 224 bp, Homo sapiens
tgacgaaaggctggaatcagctttattttatgaggggtggaagcaggggcaggagcatcatccccaccattgagggacttctgctgctcattgctgttgggcgagggggtcctgttgccctggtgatccccagctggctcaggcggctttagtggagagagtcactggtgggcaatgcagatgggggctggaaggcctgaagaaggagctgctgggtgaccggg

SEQ ID NO: 583653 - DNA, 222 bp, Homo sapiens
tagattctttgcccatggtgaacacttccatctctcccgaacgcccgccgatgtccatttgtgcctcctgcgcaaagctgtagttcccaaccaagtgctactgctgcaaaaggcaggattgtagcatttggctcacagatgaggagtcacccatgcgtatcaatcccccccttgtagcattgtccgtcggtgcctttggcatcggggtcacagagtttgccc

SEQ ID NO: 583654 - DNA, 425 bp, Homo sapiens
gaaattttagcctctgacacctacagttacagcaaacaataaacacagactaacttctaggcaaataaacaaacaagagatggagcacattcaagtcacagcagtggccatgatagctagagtttcagaagccattctgtgacctggagcatggaaagaaagtgctaaggttggttgaactgaaggagagaagggggttgtgtccttcataaattcatggagccacacctgatcacctatgtctcagctttatgtaagaaaacaaacccctaatttgtaaagccactacagttagatttctgtttttaagcaaggaaacagtttacggcactcttctttttaaaattattcagtactcagcagccatttgaatgtttaatagaaaggcattatactggcactaaagaactgtgaaaatgaaaaaa

SEQ ID NO: 583655 - DNA, 312 bp, Homo sapiens
atcatacttaaggaagggtcccaggctggggagagccccaagttgaaacagtaagtacaattgtgtactgaccactattacatactgctgatcataaacgacctgtgtgtaatatgtattcacctaaacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcgaaactgaccctagg

SEQ ID NO: 583656 - DNA, 399 bp, Homo sapiens
ttctggatctccgactttgacctaaaaagcctcccgctgtgttttatcgcccccactcccaaagcgtgtgtattgtagctacagtcgcacaataatctattttcttaagacagaataccagcagtccatgcaatatatacgaaaccatttttacggatgtgtacttttaatgaaatatcgaactgtttatttttttcccccctcccctctctcctctctttcattgtgtagcggttatgtacgagttctgtgtttgcactcaaaggctcaatggttaaaaatgctgttggatgtttgtgagtgttgcttttcatcgcatcgatattttcactttcagttttctcttgaacggcacagacgaattgtaaaagagccattgaaagtgatggagaatgtgca

SEQ ID NO: 583657 - DNA, 208 bp, Homo sapiens
ttccagcagcggaccacttgctcctttagcaccctcctgatgggaccagtcatcctggcgcgggtggcttcccaagatcaccctttctcatcctccatctttcaacgctcctaatcacatcccggtccactctcaggagcgaatcaatgatgagcataatcttcatgtctctggcaggcggaggagggttcctgaactggtagacatg

SEQ ID NO: 583658 - DNA, 135 bp, Homo sapiens
  misc_feature (70)..(70): n is a, c, g, or t
agtaattgagccagggtcgtaggttgcagtggtgccattgtgttccagcctggtaagagtaaggcctgtntcagtaaaaagaagggagtaacaagacaggtagggattcagtataataaaagtcaaaagtagttg

SEQ ID NO: 583659 - DNA, 913 bp, Homo sapiens
accctcaccccccggggagaaaacagatgcaagatcaggagagaacggagacacaagcaacacgcgtcacagttagtccacagtatcgtcacgaaggatatagctgcggagccaaacagggaggtgcgaccacatggttgaagacgaaccttggtgctgcccccccagcggcggtctattcgcacgcgggttaatacttctcgcccctgggggagaaacccgctcctccgctgtgagcgacccctccccccctcgagtcgaagacccgccgcgcaaaattggcggggaaacccgcacctttgtttttccccgagaggccccttttgccaatccgtgtgcctcccccccccccgcccttttttgagcgtctccccattccgcctctggtgaggtacgtttttagccatcaagaacttctcgggggttttttccccccccccccccgccccttggaggagaagacccggctcccgggatgtcacccgctgcccagacgtttcacccccggggtaatattctttgtcagcccaagggcactgacaggtaccccacaaacatccgctgtgctttccacaaagggtcgtcaagcccccagcaagtggctgtttcgaacccagaaggccacacgaggggccacagcggttactactagagccccaaaagaccgaagaggctgtggcccctcatgagcacaccccccaaccacaaatggcgcgcccaaaagaccgtccctctacattctcctaagtactaatgccgcgcggtctgtccccccaaccctggagaaaaggaagacttctttggtgaccctacccccgcgttagcgcggcccctgttcccgggcccttatgggctttgggacccctttttttttggggacccccccccgcccccttccaaaaaaaaacacaca

SEQ ID NO: 583660 - DNA, 81 bp, Homo sapiens
caggtggccaccagcaccagcaccggtaccggcaggaagaaccagaagttgggcaggctgaaccaacgttcgaagatcgcc

SEQ ID NO: 583661 - DNA, 658 bp, Homo sapiens
agcagtgtctcacacctctaattccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgggaggtagagcttgcagtgagctgagatagcaccactgcactccagcctgggtgacagagcgaaactccgtctcaaaaaaaaattaacttggcgtggtggtgggcgcctgtaatcccagctactcaggaggctgaggcaggagaatcactagaagctgtgaggcagaggttgcagtgagctgagattgtgccagtgccctcctgggcaacatgagtgaaactcttgctcacataacataatattaaataagcgttccttttatgctggtgcaatgattttggtcagtcccccaatatatttttgattttggt

SEQ ID NO: 583662 - DNA, 278 bp, Homo sapiens
  misc_feature (10)..(10): n is a, c, g, or t
gtcgatctanaggatctcatccccggctctgggtagctgggattacaggtgcacgcaccatgcctggctaatttttttttggtatttttagtagaagatgggggtttctccggtgttgaccaagggtggtctccaactcctggtctcaagcgatccaactggtttagcctttttaaggtgctgggattacaggcatgagccaccgcgtctggcatatttcttacatttttaatagagacgagggtctggctatgttgcccaggcccgtctcaaactcc

SEQ ID NO: 583663 - DNA, 244 bp, Homo sapiens
attaattaaattatttgcctaacttaagaaaactactgtggggaactctcagtttgggcttaactccatttgacatgaggtgacaaaaaaaagtttgagtctacctgtggaatatgttggtttattttcagggcttgaaaaaacattcccaaaaacttggtttgggaaaaccccgtttaattttaagttaacttgcatgttgtaaatgcgttttatgtttaaataaagaggaaaattttttgga

SEQ ID NO: 583664 - DNA, 199 bp, Homo sapiens
aaagacatgtacttccagagaaatagtacaaccctatttcctgctattagagcttaaatccggccgggcgcggtgtgtcactgccttgtaactcccagcactttgggctggcctaggcgggctgggtcacgaggtcaggagatcgagaccatcctggcctaacatggtgaaaccccgtctctactaaaaatacaaaatt

SEQ ID NO: 583665 - DNA, 506 bp, Homo sapiens
  misc_feature (19)..(19): n is a, c, g, or t
aaggactgttaaggaatcntctgaatccataagtgccatcgtggttgagacaagtgtaaaaaatgctattaatatcggagagctctttcaaggaatcagccggcagatcccacccttggacccccatgaaaatggaaacaatggaacaatttaagttgagaagccaaccatgcatgccagacaccggtgctgatgacccaagggccgtggttcacggtactagaagaagccagagcccacatcctgtgcactgatgaaggaccctactctcggtggcctgtctcctcactttgagaagagtgagcacactggctttgcatcctgtaatacctgcagggggctgggcaggaaatgtacctgaaaaggattttagaaaattctgtgaaaacccatcacaccatcacagaatggcctttagggcatgaaatgctcatggagggcatgccctcgcatttttgctacgataaataccacaaggcctcggtgacctcagacgatgacacctg

SEQ ID NO: 583666 - DNA, 649 bp, Homo sapiens
gctgcagttttcctcagctttggcgtggtggcctgctgccgggcatcggtgcttccagtccgcggagggcgaggctggcgtggacatgcggcccggcacccagcgccccgccgcccgcaagccgcgcgcccgtccgcctgcgcccccgagcccgccgcttcctatctcagcgccctgccggcgtctgacggtggaccagcgaggcgtgtcctgaatgcaggccatcaagtgtgtggtggtgggagacggagctgtaaggtaaaaacttgacctactgatcagttacacaaccaatgcatttcctgggagaatatatccctaactgtctttgacaattattctgccaatgttatggtacgatggcacaaaccggtgaatctgggctcatgggatacagctggacaagacagatcctgacatgattacgcccacctatcctatccgcaaacagatgtgtccttaatttgcttattcccttgtgagtcctgcatcaatttgaaaaatgtaccgtgcaaagtggtatcctgaggtgcggcaccacatgtccccaacagctccccatcatcctagtgggaactaaacttgatcttaggggatgatacaagacacgattcggagaacactgaagggacgaagaaagctgacatcc

SEQ ID NO: 583667 - DNA, 162 bp, Homo sapiens
gctctcgcggctcccctcacagcttcgggctaccccattccgatcacctgctcaccctaactcattccgaccacccgctccaccctatactcattccgaccacctgctccaccctaactcattccgatcacctgctccaccctaactcattccgatcacctg

SEQ ID NO: 583668 - DNA, 297 bp, Homo sapiens
  misc_feature (6)..(7): n is a, c, g, or t
  misc_feature (51)..(51): n is a, c, g, or t
  misc_feature (82)..(85): n is a, c, g, or t
  misc_feature (90)..(92): n is a, c, g, or t
  misc_feature (152)..(154): n is a, c, g, or t
  misc_feature (173)..(173): n is a, c, g, or t
  misc_feature (277)..(277): n is a, c, g, or t
  misc_feature (296)..(296): n is a, c, g, or t
attttnnattatccttaaagatattgcattttcatattctttatttataanggctcaatgctgctgtaaatacaggtatttnnnnttttnnntttcattccaccaccatcagatgcagttccctattttgtttaatgaagggatatataagnnntctaatggtgtcttcaganatttataaaatgtaaatactgatttgactggtctttaagatgtgtttaactgtgaggctatttaacggaatagtgtggatgtgatttgtcatccagtattaagntcttagtcattgatttttnt

SEQ ID NO: 583669 - DNA, 594 bp, Homo sapiens
taaatagagacggggtctcggcagttgttgcccagggtgggtctcgaactccttgggcatcaaggcgatcctctttgctttagcctcccagagtactggggattaacagggctctttctttttaaacataaaatgtttaaatgggtataacctctgtactctggcccattaagatgtgttaacgctctctggttctggtaactcatggcgtttggcgtcgggccgatattctcccatagatagatcttctactggaaattgcctaagaggaacgtcacagcgcgggctcctggttaatccaggggattttttatacaaagtcaattcagaaacggggatactgggagcttctccatggttctgtacacacgcttattaacttggcgagacagttgatgaatcagttacaagggtaatatggtattaacaatcaggttcaagatagcggcttaatgtggtatacatatggcatgcttttggtaaaaactttgcggggtgcatgaaagatacagttttaagagcagacaatggtcactctggtgcagaggatgcattttctcccataaaatttctggaaaaacaggtcaacagtta

SEQ ID NO: 583670 - DNA, 1300 bp, Homo sapiens
  misc_feature (1300)..(1300): n is a, c, g, or t
gggttcaagatgtgcggcgcccagatggcacatgtgagcgattcggaaagtagtaacagcagtagcgatgcggaggagctggagcggtgccgcagaggcggcactgccaggcattggggctctggagccaactgcccgccacgtggcagggaagccaagagccggtgctgcaaatagccagttgtcaacctcccgaaacgcagcctcaggcatcacaggtgccatgagcatgcaacaagatggccaccgcagcttcagcaccacccctgaattccgagcccacagtagcctaagcaagctgggagccctgctggacagcattcattcaccagtctcagaagcagtcaaaggacgcaagaaaaaagactaacgggtacaggaaagtcagactattggagagactgatgggttaacagcacttgaactaacacactactgatcacatgagagaggacaaatgtaccaacgttgtgcaaaggatgagacacgatcttacgtgggccacacaaaggaatcccctcatctggctgacatcatgatgccccgccaccagaccgagtaccccgatccccatcatccacggtgaatgataccatcacgatcgacacacaacgacactgcgagaaagacatcacctcgactacccacccacagactcgaccactgcgcaacccatgatgcactgacagccctggcagcgagctaaccactacagcacggactcgcgcggggcagcaagccaaaaacacagccgccggcacccctgcaatcataacgaccgatgggcaacagctgccacagcattgaccaatgggaaagcagaaactaggccaatcggccgagcccaacacattatacgcaacatcgccacaggacacacaaacagcatgcagacacaccataaccaccgaagcaaacaagtggactcgacatcaccacatggacagcacacacacgcaaccaaagacatgagggacaaaaacacgcaaagcgagaacgggcgtccgcggacgccagcagaagccaacgtgcacaccacagacaaagcgccgcaatgaacacgcccaagagacaaggggaacgaacaacaacacaacggaagagcgaagaggacaacgaaacacggcgaacaagagggaatcaaaagacgagaagccaaaagccgcgcgacacgacgcaacgcaacaccaaacagaaaacaacaccagacgacgaaacagaaagacgaagaatgagccagaagtaacaacgcaggaggagccagcgagccaaacaaacaacaagtcgcgaccatccagcn

SEQ ID NO: 583671 - DNA, 173 bp, Homo sapiens
cggggctgtcacttgaggcagaggagcaccagtgcacgcaccttgcaggtgccatggacgcaggcgcggtagccgggagcacgccaggtggcaaggtggcgagaggggcctgtctgggccctcggtgccggggcacttggcaagccgcggtggagtggcggggcgaggcggct

SEQ ID NO: 583672 - DNA, 1041 bp, Homo sapiens
  misc_feature (318)..(318): n is a, c, g, or t
gtcatctctgtcgcctccggcccactctgggggtgactggccgcttctgggacctgttagaaacgattcgaggctggagacgactgatgtagcatcgggcagctccgggctccgctgatgtatgcgttgtcttacgaactccagatggactgcttgccctggttacgagcgggttgcaatgatctcaactgtgatttcctaacgtgccgggagaaacacctcggaagccgcgatgtctctctagactagctagagtcccctcgcggtacgagaaccgtcgcgaggaacacacgtggtagtgcacggaccactagagtnccatgctgtgaatgcactcagagttcgactcttggtgttggaccaatttctcacagcaagcaatggtctgctaccgtatggtggtgggaatctggacgccgtgtacgatctagggaacgtgaaccaacagtgcgactcgcgcgtacccccttctaggcaagggattcgaccctgcgctcccatagggccacaaggcacaatcatgacccctaaagcgcgcctagggcgacacccccctcggctctgcgacgccaatacgtcaatgtatgcctgggcccagcgaccacatgctcgtggctaggcgataggggctccacgtaagggagggacagagacgagagctgcagcacgtaggcgaagcagcggcaggagcacagccagcggaggggattggagcagggaccgaagcggcgagagcggggacggcagcaagccaaaaatgcgcccgaaagcacgtacgagcgaagaatcgttaccaataaccaacaaatagagcaatcaccatcggcgaggtccaaccctggaagaagggtgcgatgccgcgttgcgctggaggcaccacaggaagggacgagaagcaatggcagcggagtggccagtgaggcaggggaacggtccagcccctgcagtggactgtgccaagatttccccgggtgcaaatctggagggtcctgcccccgggaccccaagtggggtttgaatttcagcaccgtgggccccaag

SEQ ID NO: 583673 - DNA, 195 bp, Homo sapiens
acggtgaggtacagctacgggtaggtacagcttcttctccttcagttttctcgactcgtgtctttatcatcacctaagcatcaagtttagcttcccactcaggatgatgggcagtgttcgggacagctggtgcccgcaccctcacggataccacactcgcaccggacacttttcaaactgactgcagcgacctca

SEQ ID NO: 583674 - DNA, 680 bp, Homo sapiens
  misc_feature (182)..(182): n is a, c, g, or t
tccaaaggaactattatccccgggttcctccaattccctttggcccctcagtaatgtacaaaaccgattccgccccagggtggggccataataattattgcagccacccgcagcactaatcggcagggggtacagtacctgagacctgccaaataaagtccaaatggtggatagtttgactncagtctcaaggtcatggcaacattagtattatgagctgtagtctccggccgtgctaccaaaacattagtgtacgtcacgaagattcaagctctttcgtatggcgcacccttcttgttcattttgtattaggaacattgtttcatttttgaccatcttattaaactatgaatcacaggcgagtgcatttttagaatttcagctcagtttaaggtacttttaatagtcaagagaagcactctggttttattcgttgccccgcccatggttatcgttccaaagtatagattcggtcagagttggatatcacttccccaatgtaaattcgaatgcctcaccttgcctataagagtaatagcttctataaaccctcttgtagaaaaaccattatggaacgggcgtgctggctcatacaagtactctcatcactctagaagccctaggtgagtgtctcccctaaggtccgtagtaaaacctgtattaactacatcaagctccgt

SEQ ID NO: 583675 - DNA, 373 bp, Homo sapiens
  misc_feature (86)..(86): n is a, c, g, or t
  misc_feature (156)..(156): n is a, c, g, or t
tttttcagattttggaatatttgcatatatataatgagatattttggggataagacccaagcctaaatgcagaagttatttgtgtnttatatatgccttatacatatagcctgaagataattttatacaatactttaaataattttagtaataatnttatataattttataattattgtataattaaataattttgtgcatgaaacaaagttcatgtacattgaaccatcagaaagcaaaagtatcactatctcagccacccatgtggagtctgtggttgtttgacattaccatcattccctactttgaatttatatgctactgataagcaatcattttcttacatttattcacacataagtatttcgctttc

SEQ ID NO: 583676 - DNA, 777 bp, Homo sapiens
gtggaattgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttgggttttttattttatattgtggctttggccacagttatcacacaaaagaaatagtggggctgtgtaagttgatccgtgaaaatagctcaaaaagaggttttagcagtggctcaaacgggctataggggtttaaaagggtggttatctcgtcttctgtggggaaatgtagcctaagagtgagtggcaataaaccgggtttgggttttagaagtgtctgaggatttaaaccactttagtgtttacgagaatggagcgtgcagaaaaggtgcaagacttgccatttggagacacagggttcttctaagactggagggataaattcaaggcttttcagaaactaaactatcacagcaagctctatctcggagctataatggggttaaaggcaaagacactagttggataatataatcacgggaatcctgaaccattggtgttacttaccttggggggtcgaattataccg

SEQ ID NO: 583677 - DNA, 1366 bp, Homo sapiens
  misc_feature (184)..(184): n is a, c, g, or t
ggaaaaacttcagccgaagttcagctcttactaaacaccagagaattcatactcgaaataaactctaggaaccgtgaaattaaggaatttgcagaatgctttagctaaaatgttctgattcaggatcagaggattcttagagagcttgggaatgtaatgaattacgtgtgtgtttatacgttgntgctgtggagaaaactgccagtagacagaatttttctctttttattttttttacaacataaagacacactctcctcagaatctgacttacagactagtgttgtaaaacacggcctacatgttttgtacctggctgtggggatgatagtgccgtgtatgtgggacttgtgctttggaatatatgctatgcaggactatcatcaagtttcaacatcttgacttgtgacccccaagtgtcaacagctttttaaaaaacaaattcctgcagtaatgaccaaaacccattttaacaaatggcttgacaactgcactcaatctgcagctcttacattaagcttcaccatggaaaccagtccaactccaggaagtcacacattcaaagaattagatcaactagcccaaccacttcattgtacacgatgaagactgaaagccaaacgatgtcgaaggggttccccacacgtatgataacagcctattaagggctaacaagctgggcttcaaaaaactgcagcgtttaccctggacttttgtgggcccccatgtcccttgcacagtgacacaaggttcatactagggcactcaaaaagggccttaacaaaagaacaatttaacgaattgcatctacaagaataaatcaccacaaacagtttctacaggaggcccccatttcatgggggtttaggcaaacacatttggtagacaaattcctcatcaagcagctattcacggcagagcaccaacaaagcttgcatgcaacgaattgtcacacagaacgcattttaaacgcacagactcttagtggaaccggatatcaccagccccacacctatagactagcacgaaaactggtgcaatagagtggttgtagcagcaataatgaggactcctttagtacccccccttatggccagcggctacaacttgtatcctttgtaagcactaactaatatgcagaagttcctcgcaacctactatcgagctaccccctctagatgatactagctaatagagactgcccacgaagagaaacgagcctgcttcgtagccggatgacgcttgagtactgtgtgactgatctacagcaactgctagagttgatgctcgcgttgtattattcacaaacactattctaacgctcatgagcaaatatgtgatagttgtaaactaaagggctattagt

SEQ ID NO: 583678 - DNA, 914 bp, Homo sapiens
  misc_feature (146)..(146): n is a, c, g, or t
  misc_feature (336)..(336): n is a, c, g, or t
cccgaagtgctaaccccgcaagcggagttgtgtgggccgccacagcaaacagattgctgcgccaagccgcgcgggggggcgcgcaccaggtccgctccccaaggagagaggggagcaagagcctacctccccggggggatgtcctncccccgctggacgaacccacttcggcgacggagcccctgggcgtgtacaacacacccaggttcgggtgaactagtcagaaagacgtgctggaaagataaggaaaaatcgtggtcgctggtgacgaaagaacccacgcccactgcgggcacgcaaaatcagcaatctagtgtccggatcgcctccgtacangtaacagttacgctctctgttgtgagcgaacaacaagggaagagggtgactagaccagcccgcaccaaatgcggtccatgcacggaaaatctttccgcgggacaaaacagagaggcgggctctcccacacggatatagacctgcccacgcaaaaacacctggcgggaacaaacgatgcaaaagagtgcccgcgctcgcatggagttcaacataggcggcccgcgcggcatagagaacgcccgccgctcgaaacaaacagcggggcacaccacaaacaatcgacgcacacgattgcaggagcccgcgcataacacgcctatccttaggaagcgagtggatgaggatgagagcaccacacaaagagactgcgcagatattccgaacagcagctaccgtggattgtgcagtgagagtcgccctcacgcaagactgagaatgttcatggaaaagcatggcacgttctttttgacttgtcagggaacggtatttaaataggcgagtatcttcacagtcttatgtaagctgcggctgtctctacttaaacacagcgggttccatcatgccccccccacaaagca

SEQ ID NO: 583679 - DNA, 722 bp, Homo sapiens
cgggccatggaggcggagccgcgctctacccgatggcgggggctgcggggccgcagggcgacgaggacctgctcggggtcccggacgggcccgaggccccgctggacgagctggtgggcgcgtaccccaactacaacgacggagtgaggaggagcgcctgctactacctgcctgcaagcgcctgggcgtgctcaagaacgtgctggctgccagcgccgtggggcatgctcacctacggtcgtctacctgggtaggtgccgctcgtgggaccctggggtcctgcccgccctgtctctccagctccgggcctcgggaaacagagaaccgcgggcctgccgtctctcgcccgctctcacttcccctccgttgccctcgcagctgcaggcacggacccctcgcggcggtgggctggggttggggggtcgactgtcgccgcaagtgatgcccgggtcccagacgcatgagccgtcggcgtgggtgagtcggaccgggcggtccgaggcgtccccgcgacagacctgtccatccgtctgtgattgggagtgccaggctgtgaccatgggcaggcctggggcggtctggggctttagcgtggcccaccggtgtgtcgctggtgcgtgtgcacagcgggcgatggcgccagtgccgggaacacgccggcctgtcctggagcgcggcgcctgtaaggcgggcaagtgccctgccggtgagtgagggctccc

SEQ ID NO: 583680 - DNA, 1005 bp, Homo sapiens
  misc_feature (223)..(223): n is a, c, g, or t
gagtagggggaggtggacgatgtcggagtgtcgtctgggactgtgagtgccggacacagtcataagctgtccagattggtcactgcggagcgaggaaggacggtgcaggtaagcactagcatgagctaggacattgaatgatgcttatctgagcgacttacgcgtgctagaggcatagtcgctcaatgagtcggatcaacgccacgagctcgataactcgttngtattcccctagatcgtgactccccgcatgttgaactgtatagagcagttggaggaatgcctcgctaggggcgagtctagcgagttctggtcagttgcagcacatgctatagaaacgcccacgcaatcgtgtcctaatgagaaagacggaggtcttggctggtgagatggcgatcggaagtccgcagtggccaacctaggctaccaggtctcccgatggggagcttgcaatgagatgaacacatgttgccggcgagccacttcgcacttcgccctaaggatctcaaagacgtgaccgtgctggactgggatgactagtggtatgggcgcgtgtatgcgagtgcctgcgagggctgcactgggagtaatagttgcttgatcgcgatatctggaatgaagttccagtaaccgggaagtcgcgctccaccattgttgtggccaacggtaaaggtttcgtaccccatcggcgttgaacaagggcccgaatccgggttttgtaacacacttttctcgaaagcctaatttttcaccccagacgcggttttagtatccaatccacgcgtgggaatgagcgaccctggtaccgaggtgaaaatcaaggtccgccaaggaaagtggagagaaggggagcggttggcaaccgacgggggtgagacggcctaatagggggccgaagccgatgagcctcgtagccctaagggaggcctccctcctgggttggccaacgccccttcccacggggcccccctcctggtcgtcgttgtggtcacaccaagcaaaggg

SEQ ID NO: 583681 - DNA, 308 bp, Homo sapiens
  misc_feature (308)..(308): n is a, c, g, or t
tctttgaagaacctcgaaaaaggagaaaccagacctcccggttttagacatgcacctgtaaccccggaaaaaggaaaaggcaatgaaaccacttattacggaattttttttttcccccaacccaaacccccaatttttaaaacaagttgtttaattctcccaaaataaacctggtctggtacccgttcaaaaaaggttctttttccttaaattcactgtcttatttaattactattactctaaggtacatatgcttttttgggctgctccaataaaatttctttcaatattccccttaaaaaaaaaan

SEQ ID NO: 583682 - DNA, 224 bp, Homo sapiens
  misc_feature (146)..(146): n is a, c, g, or t
actcagctccgtgcgacccacatggccccaggcggggggacaccagaggctcctccatgagcagcaggagtgagcggaggaatgtgccccacagcaactttcccagccaatgccacgatggagatgacaaccccagatctgggganacagaaaccactcagaacggcacagggtaactggccccaaacgctgaaagttagacttcacccgaattacatttacca

SEQ ID NO: 583683 - DNA, 255 bp, Homo sapiens
tcttcgccagtgaaggactacctgagtctggaaatttttgagttgtttgacagcttggggggtagaaatagtgtgtctgtggtcctttttcttctttgccctgtcctctttcacatcctatgtgtaaactttaccctgcaatgttattcattaaacatttttacagaaacttaattttcctcagttatactgagctttctagctagggcaagcaaacgaactcgtgccgagggatcctactagacgtcgaccctg

SEQ ID NO: 583684 - DNA, 324 bp, Homo sapiens
  misc_feature (14)..(14): n is a, c, g, or t
  misc_feature (60)..(60): n is a, c, g, or t
  misc_feature (93)..(93): n is a, c, g, or t
  misc_feature (107)..(107): n is a, c, g, or t
  misc_feature (152)..(152): n is a, c, g, or t
  misc_feature (157)..(157): n is a, c, g, or t
  misc_feature (160)..(160): n is a, c, g, or t
  misc_feature (181)..(181): n is a, c, g, or t
ctgcctgcggtgcnattacaaacacgggacaccaacttcgggacgaaactgcatctgccncgtgccccaaaagcaagctggcaagtgggccgncatccatcgagtgncacacactgtggctgtccgtggtctggctctggtctgaaggtggncgcgnctnccaccctggactctggacttngcaggttacctgcctgtcacgccacccccttacctgggagcagcgagcagtgccccaggcccgagttggagcacggtctctatggggtaagcttcgctgtctatcagctgtgatttgtaaaaataaaatctttaaatctctcg

SEQ ID NO: 583685 - DNA, 132 bp, Homo sapiens
agcttatgatcctcctcctcctgcctcaggggtaagctaccatcgggcgtgtgcctgtgaccagcctcctgggctctgtcacggctgcgctgtggctgtactgccgtggggctgcagggctgtgcatggtgt

SEQ ID NO: 583686 - DNA, 276 bp, Homo sapiens
  misc_feature (115)..(115): n is a, c, g, or t
ttgaatgttggaaagggttatctcagggaccctgctctctcctctacacatgcgcacgcaaacacacactcacacacacacacacaatgacaggtggtggtctggtctaatatantgtgtctgaattcagagggcagacattaactgccaagttttgttttttttgagagagagtctcactctgctgcccaggctggagtgccgtggcacaatcttggctcattgcaacctctgcctcctggattcaagcaattcatctgcctcagcctcctgagt

SEQ ID NO: 583687 - DNA, 291 bp, Homo sapiens
aaatctggggtcacccactttaggccccttccaatgtggaagggaagggataaatttgcacgtgaatggtgaggtcagtaagccaatcctggttttatatactaactgaatgggcatatggggctttcgcccaaagccctgagaaactttctaacctgcccagattaatgcttaggacccaaacgccttatactgtttaaggccttttatttcatctgtaggaccagaaatttaccacccctgcagggcgctccaaaggccacctagcccatttccctgcctctagaaaga

SEQ ID NO: 583688 - DNA, 221 bp, Homo sapiens
aaaatgggattttaaatgggaaaatcggtaatggggttggtttcaaccatgttaactcccgggtccctgaagagccctcccgaacccccccggaaatttttagggaggaagtgggagctggaggtgggggttggtggtccccgtacaaaaactttagcttccgggaccctattgaggtttttaaaaggcccccaataaaaaaccgtggtcctttcggggga

SEQ ID NO: 583689 - DNA, 641 bp, Homo sapiens
taacaaccggcagcggactcctttggctatggcctccaactttaagaaggcaaacatggcatcaagttctcagcgaaaaagaatgagccctaagcctgagcttactgaagagcaaaagcaggagatccgggaagcttcgatcttttcgatgcggatggaactggcaccatagatgttaaagaactgaaggtggcaatgagggccctgggctttgaacccaagaaagaagaaattaacgaaacatgataagtgaaatcgatgacggaccgggcacaggaacaacatgaacttgggtgactttgtaactgtgatgacccagaaaacgtctgagcaaagatactgaaagaagaaatcctgaaagctcttccaagctcttcgcatgacttgatgaaactgggcagattccgtgcaacacgactctgagaacgcgtgcccaaggagtcgcggtgagaacctgactgatgacggacgctgccagcgaacatgagtcgatgacgctgatcgacgatggagatggccgacggtcacgtgagcaagagattcctgcgcactcatgaacaaagaccagcctctattaagatcagcgtctactacctctactgacagccaaatgtaactaaattacgtgcctgccattgggt

SEQ ID NO: 583690 - DNA, 115 bp, Homo sapiens
cggtgttattacggttgtgagatgataagtcccatacttgtcgctatctgaactatcaacaattctgatgttggacagagtgaactcaaaccagcaggcacacacaaccctcaat

SEQ ID NO: 583691 - DNA, 328 bp, Homo sapiens
  misc_feature (183)..(183): n is a, c, g, or t
  misc_feature (189)..(189): n is a, c, g, or t
  misc_feature (194)..(194): n is a, c, g, or t
  misc_feature (205)..(205): n is a, c, g, or t
  misc_feature (209)..(209): n is a, c, g, or t
  misc_feature (214)..(214): n is a, c, g, or t
  misc_feature (223)..(223): n is a, c, g, or t
  misc_feature (225)..(225): n is a, c, g, or t
tactagtcgtgcctcataagtctgtagaaaagcaatatgaaatctgtcgtagcctgtagataaacctacagccacaggaaggacagccacgaagaatgcagaagtcaaaccctcatgacaaagtaggcacaagtctacaataagctaaatcagaatttacaaatacaagtgtcccaggtagcnttgatnccgtnattgagtgaantggntcaangtttgattnanggcctatggtaaggtaacattgtctctgttgtactatttgcaaccaagcagctcactcctgcatccactattcacatcatttttctcagcaagcatctcaaag

SEQ ID NO: 583692 - DNA, 315 bp, Homo sapiens
ctggaagaattcacggccttgtcgtcagtgacgatgcagccgcccacgtacgaatcgacctgtcgcaggcaatggcacatctcgtcgctgtcgttcccgaccgcgacgaagtacgccttcgggccggccagaacgtcgccaccgcgccgcgctcgatcgacacgcccttgaacagcccgttgaccacgtgacgcttgccgttcgcatagcgctgcacgaccgcgatgcgttgagcgtgacgcccgctacttccggcacgaccttgccgtcgcggaacggcacccacacttcctggaagaacttctcgtggccgcg

SEQ ID NO: 583693 - DNA, 832 bp, Homo sapiens
  misc_feature (1)..(1): n is a, c, g, or t
  misc_feature (64)..(64): n is a, c, g, or t
  misc_feature (100)..(101): n is a, c, g, or t
  misc_feature (122)..(122): n is a, c, g, or t
  misc_feature (138)..(138): n is a, c, g, or t
  misc_feature (145)..(146): n is a, c, g, or t
  misc_feature (154)..(154): n is a, c, g, or t
  misc_feature (161)..(161): n is a, c, g, or t
  misc_feature (171)..(171): n is a, c, g, or t
  misc_feature (176)..(176): n is a, c, g, or t
  misc_feature (187)..(187): n is a, c, g, or t
  misc_feature (191)..(191): n is a, c, g, or t
  misc_feature (225)..(225): n is a, c, g, or t
  misc_feature (229)..(229): n is a, c, g, or t
  misc_feature (232)..(232): n is a, c, g, or t
  misc_feature (237)..(238): n is a, c, g, or t
  misc_feature (241)..(241): n is a, c, g, or t
  misc_feature (246)..(246): n is a, c, g, or t
  misc_feature (250)..(254): n is a, c, g, or t
  misc_feature (304)..(304): n is a, c, g, or t
  misc_feature (307)..(307): n is a, c, g, or t
  misc_feature (341)..(341): n is a, c, g, or t
  misc_feature (347)..(347): n is a, c, g, or t
  misc_feature (349)..(349): n is a, c, g, or t
  misc_feature (356)..(358): n is a, c, g, or t
  misc_feature (364)..(365): n is a, c, g, or t
  misc_feature (375)..(375): n is a, c, g, or t
  misc_feature (384)..(385): n is a, c, g, or t
  misc_feature (388)..(388): n is a, c, g, or t
  misc_feature (390)..(390): n is a, c, g, or t
  misc_feature (415)..(415): n is a, c, g, or t
  misc_feature (419)..(419): n is a, c, g, or t
  misc_feature (457)..(457): n is a, c, g, or t
  misc_feature (461)..(461): n is a, c, g, or t
  misc_feature (479)..(479): n is a, c, g, or t
  misc_feature (494)..(494): n is a, c, g, or t
  misc_feature (496)..(496): n is a, c, g, or t
  misc_feature (508)..(508): n is a, c, g, or t
  misc_feature (513)..(513): n is a, c, g, or t
  misc_feature (523)..(523): n is a, c, g, or t
  misc_feature (527)..(527): n is a, c, g, or t
  misc_feature (553)..(553): n is a, c, g, or t
  misc_feature (561)..(561): n is a, c, g, or t
  misc_feature (591)..(591): n is a, c, g, or t
  misc_feature (596)..(596): n is a, c, g, or t
  misc_feature (598)..(598): n is a, c, g, or t
  misc_feature (652)..(652): n is a, c, g, or t
  misc_feature (832)..(832): n is a, c, g, or t
ngaagagcagtatgaaaatattctaatgcagtgctgtccaacagaactttctgtggtgatgganatgttccatatctttgtgctaatacagaatctaccnnccacatgaatactcaaaatgnggctaatgccattcangacatgnntttctccnccaattnactttccatntcccncgtcatatgtnactngtggctcctgactgcccaatgcagttctaatgcntcanggntcccnnccngtggnttcnnnnngggggtttttttatcattcggtgctaagggtttgggggttgggtgttgtngtngagggaagcactcagagttttttgggcacttacncaagtntncggtttnnncattgnntggggggggnggggtgggnngtngntggtctggggggctcagtacgggcntggntattgtgggtgggaatgggagagttaggattttggtgnttgnaattgtgagtggaataangtaaaaaagaaaaantngaggtaaaaaanagggnaatatgtgantggnaaaaaaaaatatggagatggttgggngttggttngtggggtgaaaaataagggtggggtttaanagaanangaggattagaagtggaggagtggagggaaggaggtaatgagggaaatttatggnaaatgaaggatgaaaaggaaatttattttttgggattaagatattgttattgatattaaaaaatttgatgggatatagattattaaaaaaggagtaggtatattatgtgagaaggtttgtgttgtaggtgataggtttataaatgatgaaaaattgattggaatgtgggataaatgaaan

SEQ ID NO: 583694 - DNA, 310 bp, Homo sapiens
  misc_feature (191)..(191): n is a, c, g, or t
  misc_feature (194)..(195): n is a, c, g, or t
gcaaactcctgacctcagatgatctgcccgcctcgcttcccaaagtgctgggattacaggcatgagcaccacacctggcctacattaatacctttaaacatagatggtctaaaatgttgactgtaaataaaaagaatatgacctgacaaattttagaaggagaatttaatgtgtcagttttattggtaganaanntgtacttcatgaggtttgtggactttgggactcacggaggtgtgtagacctctcagtggtgagtgtgcaggctcctaataggtacctgttcttacggatctatggtctaggttgg

SEQ ID NO: 583695 - DNA, 164 bp, Homo sapiens
gcttcgcatggctcttctctttctctgccctgttactgctagtggacttgggatcagttgctttctggagcttcctggcacctccaggctgtggcaggtgcccctcccctggcaatcacacgcctgagtcccccggcccggccccccagtcaggacggtgggaa

SEQ ID NO: 583696 - DNA, 1049 bp, Homo sapiens
ggttttacaatttcaattctagatcacattttatatatgctgcatgccaaaaaaaaaaaaaagagaaaactggccttttctgggtgtggaggggaaaaaaaactaatattctaccttactagtagagtccaaaacaagttttcactgagaagccttttcagtaaaagttaaacaagttggtttttggagcattggtcagttatcctatttcagaaagagtcaaaattcaagcacgatacatttggaaggcttggcaaactcctaaacccctgatgagtcctctcattctgggaagtggggaattggagtagatactggattggtccccgtaagtatggcagatgacagggaggtctttcccaatcaggcactcagaaacacaggtcaccgtatgttctcagccagtaacaatcatactggaggacgaaggactctcccgttggatgcagacaccaatggtaatgggacgatgtaaaaccttcttagcaatcagatggctaaactccttggcttttaactttacactagggaaatggttttctaaaactaaaataccttgaatggtcagacagtataatctcagctggtataagttttggaatggctcccatcgaggcacgtgtaacaatccatgaactgtgactacattgacaatgtaaacaaaaaaagaaaaacaaaaacaaaacaaaaaaaaaacaaaaacaccacccgggcaactaatagcggggggacaacaacagggccacaaggggacaagtcacaacaggggtacacgcgaaccacagtatgtgtgcacaggggcgacaacatgggaggacccacaataaggggcagcgaataaaaattccgaaaaaacccacagagcacccgctaaagagcgacgacgacgcgaccaacaggacagagcaggcgggaacgaccaaaagaccacagcgagagcgcgcgaggacagacaccagcagcgcacagacagaaaagagacgaaacgaagcccagcactcaagatagtggagagagcatccagccagcccgcgaccagaacacagcgc

SEQ ID NO: 583697 - DNA, 314 bp, Homo sapiens
tgtttcttcttagaactgtctgcaaagcctggacctctttaactgatgaagttaccaacctgaatgactaccgagagagtgtcttcaagacacctgcccagcttaccatacttggatagctatgaccgagaggaccaggaagcatctgagatcagatgccgaggtggatggtgaggatgcagcaggaggaagaaggtgggcacaggtgcaaaagcaggcaagagagcaacagcatcatgaaggagaagatgattaagatccctgatgacctgcagaaaacagaactgttcagtattggttaggacttactcccg

SEQ ID NO: 583698 - DNA, 156 bp, Homo sapiens
acatctcgtggggtgcatacgtaacctgagaggaggctggggactctgcggatatgggggtctcagtcactgtccatccaagaagcctggtcgccaaggttgcattggtccacttcattcttggtgttagccttgggttagtgcgcctctgctcaa

SEQ ID NO: 583699 - DNA, 389 bp, Homo sapiens
gggtttttttttgggtatttccccggttttttttttgcgccccgtttttttttttggggtacactttttttttggggtgggtttttttttaaaaaaatggtttttttttttgggaaatttttcccccttggggttaaattttcaattttttttttgtttttttttgttaaaatttttaaaaatttttttttcttttttttcccttttttgccaatttgggggaaagggggtcccctttttttttttttttttgggttttttggggattttttttttccctttccaaaaaaaaaaggttggaaaaagttcctttggggttttttttttgttttttggccttttttttttttttttaaatttctttcccatttttttaaccccccttggga

SEQ ID NO: 583700 - DNA, 232 bp, Homo sapiens
ggtcgatctctagcaggatccccgtatcagatgtgggcatatgtcaatgttttcctccctcttcgtctcatcccccgggccgcaacactgcgttggcagtcagccaggacggagaccacgggcagctccgggtgctggtgatccccgccttggcgatagagattgtctgctgctccctggcttcgtggattgccacacggtcatcttctcgcatctcgtctcttctcttgta

SEQ ID NO: 583701 - DNA, 124 bp, Homo sapiens
ccacctcaactccccactagcggggaccacaggcacggcaccactacatccgggctaattaaaaaaattttttggtagagataggatcttccctatgttacccaggcgggtctcaaactccggt

SEQ ID NO: 583702 - DNA, 1433 bp, Homo sapiens
gcaaaacaccaaatggctggatgactgccgtgtgcagctggtggtggtgccctggagtgccctgtgtgtgccctgtggactggtggaaccgctgtgtgtgcattcctgctgtgacggtttctgtgccatgttgtgcattctgtgtggcctgtgtggtctgctggcctgtggaccgtggtgcctggggcctgaggcctgctggatgcttcgctgtgcagtgtacagtgcctgcagtgcatcacaggcagttggcattgcccaggtcctacccaaagatatagggagcctgctatggatcgaaagtgcaccactgcacagcatcaaatgatcaccctagagcagggcaagcatctcatcatcgtctcatcccacattggaacacagacatttcaacagtgccagatcgcaagcagaattcagaatctggcaatatttccgtttcccaataggatgggtgcccatcattcagtcggaaagcgccattcgcaggggctaactattggcacagcgcaattctcaagggcccaaatgaatcgcccaagccaaaaggcctaggaactcgccgtggtttgacgcgcaggggtcgcagaatcggcgtcgtccgaacaccagaagaggggatctccaccagagcgtgggacaaacgatatatcatggatacataggcacgttaaagtacccaggtgaggcagaaaccgattaaacagaaacgctcggctagcatatccagccgactggaatacaagcgggaacaccacttggtggtaggcttggagtagacaaccagcgtgggagcagcttaccccacgaatggtgcaaccgatggctttggggtagcccaaaacgacacacggggcacccgaagtatccccctgtagttggcagaagcgtggtacactccaaggatacacaccattatcccgacatttgggggtgcggccatacagagtggacgacgtttcctattcaccaccaatacttacaggagatacacaccaccacgatggatctgtcacgtcccccacgcgcaatgtggtcacattaagatcattggtgtgtgtggagtaacaaacgacaaagcgaggaaatatacagggggtcacataaggccgctcgccctaacgccaagaaccagttgttttctcgacgcatatttagtggccatacagacgggcgatagctgacagcacacgaggcgtacaagacgcggccacatagaccagaggactcgtaccatatggcattgcccggttgtgcgggcataaacgctgcacgccctgattcataaattatcagcacccagttgtacgacacgcacccaaaaggagcgagatgaccaataccatattgtggtgatacaacatcaggtgcgatcacgttaccagggacgacaacaccgagtggtgttgcaccgaattagaagcgtacaaaat

SEQ ID NO: 583703 - DNA, 118 bp, Homo sapiens
ggttaggttcgcttcgtcattgttgcgtggtgattagtcggttgttgatgagactatttggacggtggggactcacatacgacgggggaaactacgaactgatcacgtactgcggcgg

SEQ ID NO: 583704 - DNA, 366 bp, Homo sapiens
ggtcgactttttttccatataactatcatccaataaactgatggctctcttactaaggtaagagaatcatattctcacattattaagatcatcaattatcatgatggccttgtacaattcagaaacagcaaacaatgggcaagtatttgatacagtcatttagtcatttattcttcaaatctctgagtgcctattatacgccatgctttgtctatggaatgggagtacaaaggttgaggttgcagaagacctctttcccatgaatttaaaggatttagatagctccaaggataaagaacaatgcagtgggagtaaagctgagatggaaccagaaaaagagggcgatcagaagagagagagtgtgtt

SEQ ID NO: 583705 - DNA, 100 bp, Homo sapiens
ggatttgctggtgcagtacaactaggcttaatagggctcgaattcgagagatcaagagattgagaccatcctggctaacacggtgaaacccgtctctact

SEQ ID NO: 583706 - DNA, 697 bp, Homo sapiens
  misc_feature (1)..(1): n is a, c, g, or t
nttgttggccgatttctccgccgtgttattcgttcccccgctctgtttggggctccttcctaaggccgcttgccttgggggcgtgccgggggggtcgcggttgtacgggtccgcggcgtcccccactggccatagtgtcaggcggaggtgcgcatctcggtcgtctccagcagcccgttgtcttcgagggcgcagtcaggttttgggtgcgtgatccgctcgcggaagcattgtttgctcaggagcgagtgggtagaacgctggtgggtaggggaagcccgccgctctgcatggcaccgcacggttttattgcgcccgaccacgctgcttgccgctgccgcccccgagtcacggcgggttgtcccgtgatgctctcgtatgtgccccactcgctcaggggggggcttgcgctagaaactcgcgccgccgcggtagggaacacccgcgcaggggggccatatttcttctctagcgccgcgcacccccccgtctggtggaggtttgcctctgcgcccgcacgagtgcacggtccggcgaagggacggacgtcaaccctggcatgtgaggtgtgagtgggagctcatgagtcagagtgcgccacaagggggcccgcaggtacccatggttctgtagtcaaataaggcggtttggtgcaagaaacaattatttttcctccgccccagcaatgtcaaacaag

SEQ ID NO: 583707 - DNA, 124 bp, Homo sapiens
ttgctgtgatctagaggatcccgtactgtggtgtaccgttggcttcagtcgggaggctacaccttttgaaattccgtagacacaccatctctgtgattgtcttcatctaggggaaaaccacaga

SEQ ID NO: 583708 - DNA, 573 bp, Homo sapiens
tgatctaaggatccccaacgatggtcctcagctacttgggaggctgaggcagggagatctgaacctgggaggctgaggttgcaatgagctgagatcgcgccattacactccagcctgggcaacaagagtgaaactccgtctcaaaaaataaaaaataaaaaataaaaaataaacaggcaaaagacatgagacattgcacctgagaagatacatatagatggcaaataagcacatgaaaagacgtccaaggccaggtgcagtggctcacgcttgtaatcccagcacttcgggaggccgaggcaggcagatcacgaggtcagaagtttgagaccagcctggccaacatagtgaaaccctttctgtactaaaaatacaaaaaattagctgggcgtggtggtgggcatctgtaatcccagctactcaggaggctgaggcaggagaatcacttgaacctgggaaggggagattgcagtgagccaagatcacgccattgcactccagcctgggtgacacacacacacacacacatatagtgacacacaaagaaaagatgtccaatatcataagccatta

SEQ ID NO: 583709 - DNA, 896 bp, Homo sapiens
  misc_feature (896)..(896): n is a, c, g, or t
agcgggtgattttcgttaaaggttttctaagcaatatttgtcatagccagaagtcctctaaagtcttgccgagtaccatggtagtctttgctgacgaaaacgtcagaagtacgtgtctcagggtgtcatcttcaaggggttccctgggtcttggacactacttgtaataaataacgtaacacataaccacgtatcctgattgtgccttcaggagatgtgcttagggtgaaagtacattactcgagaactccaggtacctggacaacgttgagacagtgagttgcggaatgtgttggtttccatctctcctggtacattcgttccagagatcgagattagtaatcctctgtagtaaagagtctcatcatattagctcgaaattcctatcgttgtaagggtaccacaggcggtaggtgcttaaatttttccttgtatactaagtaacaggaagactctatgccatgtctaccttctcttcttagccctgcacttatactgctgtctgagcaaagtcaacatttccattgtaaacatttcgaagtgtccgaagacgagttactggaacaggattggccggtatagagcgtctgaagtgttcggtattggcttcgcgttaaggaattccaggaaccatggacaagtagacctgagagaggtaagccaggcggttttttgagtttgcacacacttgttgctgaacgagcgttattcactcgttcccgtcctaatataaagtcaaacggggagaaacggtttggcaccgttacttattattatcctaagttccttacgcgcaataggtttctgagggaacttaaaaggccggcgctttttccacttcttggttaaattcacacgtctaaggacgtaccggcagccagggaatggcttgcacn

SEQ ID NO: 583710 - DNA, 207 bp, Homo sapiens
agaggatcgcgtagaagacgacagaagggaagaggtgcacacacttttaaatagaccagatttcacaagaactcactattgcaagaatggccactaaggggaaatcccacccccatgattcagtcacctccccatattgggctccatctcccaacaattggggattaccacatttcaacatgagacttgggcacgggggacagggga

SEQ ID NO: 583711 - DNA, 250 bp, Homo sapiens
agagcgtataagatcacatgagcttaggagttcccatcgtgactcagtggttaatgaatccgacctggatccatgaagatgtgggttcgattcctggccttgctcagggggttaaggatccggtgttgccctgagctgtgacgtaggttgcagacgcgacttggatcccaagttgctgtggttgtggctctgatcgacccctagcttgggaacctccatatgctacaggtgaggctctagaatagaagat

SEQ ID NO: 583712 - DNA, 228 bp, Homo sapiens
ccaaaaagggggggggttttttttttgggttgcccccccaaagctttttgggggggggggggggcccttaatttttcccccgggggagaaaagggccccctttcccccccggggggccctttttggggaaccccccccccctggttttttgggtggtttttccccggttttttgggccctttttttaagggggttttgggggggaaaaaaagggggccccccttttta

SEQ ID NO: 583713 - DNA, 165 bp, Homo sapiens
cagcttcttgacactagacgatcccctcctcatcatgtaagaaggcgtcttcttcctctatataattctttgtattttcctgataagcaattgtattatccagaggatttagactaacctcatcgtcctcgctatcaaggaataaatgaatttcaccacccagat

SEQ ID NO: 583714 - DNA, 537 bp, Homo sapiens
ccaagtcacacggttgaaaaaggggggcaagaaaaatgaaatgggagtgactaaagggggaatgagggacggggccccccctaaagggggcggggatcaataaggctgatatttaaaaaagaaaaaggagaaatctagtgagaagtttttttttttttttttttccaaagacagtagagctttatggtgtaaaagctaggggggtaaaagtatgaaacggcaacaatgttaagccaggccaatctattacaaatataaaggggtgggggtttccaatacacatatgaacaaccggccctaagccacaagatttatcccaaaaagcaacatcaggtttttggatccgtaagtgaaaaaaaaagaggggaatggacagggtgatatcgcatgacataaacgtacatacacatgagttacttgaatataaaaaaaatggtcaggtttgatagatttatatgggaaaggtgtcagagtgtctctaagactctatctctgtctctctctctctctctctctctacactctacactctctctc

SEQ ID NO: 583715 - DNA, 417 bp, Homo sapiens
aatcattggacttgccagctgtagctagatcaggtaaggacacagtagcttctatgttattaaaacatgaaggtgtaaccacatatgctttagccgacccgcttaaaattggatgccaaattttatttgggttaactgatgcagagacttggcatgataatataaaagaagaagtaatccttcattggggatggtcacctagaaagttttttcaaacagttggaactgattggctgagagagttaaattcagatcattggttattaagagcaaatttggctttcaaccaatataaaactaatgaacctgataaatcacaacttgacttcactgatcctaaagctccatttaagttagcacgcgcaagctatttttggaattactcaagaagagtcctggaacccttcattattaaat

SEQ ID NO: 583716 - DNA, 524 bp, Homo sapiens
agaggactctgtctttgaggtctatgagattattagatggaatcattcatcacatcccatttgggctttagatactttgaagtgagtatctcaaattttcaaatcaaagaaccctgattaaaacaaaaggtcttctcacctcaaatcctttatgaaatgaggtcaacttaaaatactttttagttagctatgatataaaattaaactatatttttgttatagttaatgaattaatattgtatcttctgttccttagtcgaaaagtgagcagttaaatggtctatttctctaacaaaacaattaactgattcctcaggatttaccgcccactgtgaccctcttgccctgtgcccacacatacctactaaagaccagttttcagatccccaggaataacataaaatggggcatatctgtctcgtaaatatgattgaataagcatatgtagagcacagttgtttcacttttaagaatcaattataatcatttgtacaataaaatgaattatgtctttcacacaaaaa

SEQ ID NO: 583717 - DNA, 683 bp, Homo sapiens
  misc_feature (497)..(497): n is a, c, g, or t
gcagtaaatattatactagcatgtacgcatctcacttctagagaatactaatatatcgctcacacctcatatcctccctactgatgcctagaaggaataattactagtcgctgttcattatagctagtctcataaccctcaagagtccattccctgttagccaatatggtgcctattgtccatactcagtgcttggtccgtctggcgaagccagcggttgggcctagtccgctagctagtgctgcgaatctccaagcacatgatgggcctagagctacgtacataacctaaaggctactccaatggctgaaagagctgaatcgtcccgagacaatgtatagtttactaccatctgatcatgactttccgaaaaaggggacatcaatttggagatcgaacacgaacccactccacgagtcctgaatctattagcgatcgagtcccgtctgactgatgttttgtaacccagaatcaacgaacaaaatgcgtattgagcntggttccccctaagcagttttcactccgtagccctcataattaatccctcactcctaatactagactacactgactcctaggcccttcagcaatcatggggagccgaacgccgacgttatccagttgaaccactatcacgaaaagaaactctacctctctatactaatctccctacaaatctcctt

SEQ ID NO: 583718 - DNA, 164 bp, Homo sapiens
aatcgagcgcctcctaacacgccgcctccgtaacgagcgcctccgtaacgagcgcctccgtaacgagcgcctccgtaacaccctccgtaacgagcgcctcctaacgacgcctccgtaacgagcgcctccgtaacacgcttccgtaacgagcgccgggttaaggc

SEQ ID NO: 583719 - DNA, 369 bp, Homo sapiens
aaaacaggcatcttgtttgggatttgggtcattttttaaaaaagcggattgacttcccagaaagcagcttttttgaattttaaaacaaagggggaaatttggtattagttattttgagtttttttcaacttataaccctgtaaccagttatttttaaagcccagatgaaataagttctgcatatttttaaaaaatcccagttccctgttaaccagataatgttttccccacccataaaaggtaggaacattgtttttccttacccgtagtatgcaaacccctatccatgttcattttgacatcctttgttgtttttataattcatgggggagttccctataaataaaaacaaaaatgggttaactttta

SEQ ID NO: 583720 - DNA, 417 bp, Homo sapiens
  misc_feature (121)..(121): n is a, c, g, or t
gatgggactggccctgctgggggtgctgggcgacctgcaggcagcaccggaggcccaggctcgtgcagccaacttccagcaggacaagttcctggggcgctggttcagcgcgggcctcgcntccaatcgagctggctccgggagaagaaggcggcgttgtccatgtgcaagtctgtggtggcccctgccacggatggtggcctcaacctgacctcctctttcctcaggaaaaaccagtgtgagacccgaaccatgctgctgcagtttcggggtcctcggctactacagctatcggagtctccacttgggcagccccttctccgtgtcagtggtggaggtagacttctatcagtacgcgccactgttcagtcagggcagcaagtgccctggcgaggactttcgcatggccgcactctc

SEQ ID NO: 583721 - DNA, 452 bp, Homo sapiens
atcaaagagattacactaattaattttaaacctaacagattttacctaataatgacatatggatcatgagaactgcagaactcttgtcacgtaatgaccttgtccaaacctcagcaaaaggagaccaccaaactatagcgagccttgtagcagcataaggtcgtgttcgtaggatgaccgcagatctctccccgggcctctcggttaaatgtctcccagagaaaactcaacactgcccacctggccatagcctctggaccccctttcttggagcatttacaaaaaaagagcttacaattgtgagtccttcctctgtccccttgacacgtatgtgttctctcctacaattcaggagtatctttcttaaggacctgaaagccattcctttgaaatttaatcatctggaaggttgctatctcccattcttgggtgggagggtagaatcctgactt

SEQ ID NO: 583722 - DNA, 456 bp, Homo sapiens
gtgcaccttgcatgctgatagtcgacgtctagagaatcccatgacttcttagcccagatgatagtgttggcgtacagttatatcgtgaggcaacactatatctgggctatgagggtatagtgtgggcatatcttccagaatctaactatcagttttgcagtatagctcagacttctctaaatctaaattcttaattggaaaaccctgaggattcatgtaaaaggtgtggcgcatttcttggtatatagtatgtgtgatataaaaaccaaccgcttgtcaatgggggtaatattactgtttggtaattcgttctcttgctctactctctacccgaagaacaaagcaccacccaagagtttaaaaattaaagagcttacactgaaggcctccagccagtttacctaaggagatggaatgtggctgggtggagagccatatgctggagaacagaactcc

SEQ ID NO: 583723 - DNA, 627 bp, Homo sapiens
  misc_feature (507)..(507): n is a, c, g, or t
cccaaagtacttgtgtccgggtggtggactgggcttcgctgcggagcccgggaagctgcctttccttctccctgtgcttaaccagaggtgcccatgggtgggataatgaggctggtcacagcagcactgttactggggtctcatgatggtggtcacgggagacgaggatgaggacagcccgtgtgcccatgaggccctctgggacgaggacaccctctttggccagggccttgaagttttctacccagagtgggggaacatgggctgcaaggtggttcctgatggtaacaactacagacagaagatcacctccgggatggagccgatagtcaagttcccgggggccggggacggcgcaacctatatccgggtgatggtggatccagatgcccctagcagagcaggacccagacagagattcgggagacatggggtggtaacagatatcaagggcgccgacctgaagaaggggaagattcagggccaggagttatcagcctaccaggntccctccccagcgggacacagtggcttccatcgctaccagttctttgtctatcttcagggaaggacaagtcatctctctccttcccaggaaaacaaatcgaggttctggaaatggcagat

SEQ ID NO: 583724 - DNA, 171 bp, Homo sapiens
actcatcctcaggtgctatttcagtccaatttttggctttatattttgctatcttctatacttctccaatacttgtcttagtcttgtactcatttatctatctgagcactcttgactaatattttcattttcatatacttgtctctattcttccaacttttctctctaagt

SEQ ID NO: 583725 - DNA, 135 bp, Homo sapiens
aggacaccatgactgccgccacacccaccgatagaaggtcccaggaaaagtccgagcggaggaacgacgggatcgacgagacagcggcggaaatcatcactgccttgggcggtgccgagaacatcgaggacgtcg

SEQ ID NO: 583726 - DNA, 243 bp, Homo sapiens
taagagacgtgttgcatcgttgtacttgcagtggtaggtgatgtctgagagtatagttggcagcagcgcttgaggggcaagttgggtagccatttccttggaagtcactccttctacattatattcaaactggctgccagattgatagttctcctagccagacgtgtatcttgtcccttggagctcctataccagttcttggctgggatgttttcaggttgggcccggatacaggtgccgccc

SEQ ID NO: 583727 - DNA, 387 bp, Homo sapiens
  misc_feature (313)..(313): n is a, c, g, or t
gatttagatataaatttaacaaaatatatataagatctatatgaggaaaaccataaacctcttatgcaaaaaatcaaagatctaaataaatggagaaatattctattctgtttatgaacaggaaggctcaatattgttaagatgtcatttcttcccaactgatctatagattcaatgcaatcccagtcaaaatcccagcaagttactttgtgggatattaaactgattctaaagtttatatggacagacaaaggacccagaatacgccaacatgatattggaaagaggaaggaacaggaatcgtaggtactgntactacctgactttcaaaacttatttttaaaggcttcagtgatccaggaagtatgggtgttgggtggaaaggac

SEQ ID NO: 583728 - DNA, 647 bp, Homo sapiens
  misc_feature (647)..(647): n is a, c, g, or t
acgcgtttgtgggccatacgcgcacctcacactgtacacggagcttgcggaatcgccagggcgcacgcatttctgcggggggtctctagtgaaagagcacaggatactgactgtgccggcagtgcttcttcttctgcgcatatgcctttcacgggctatgaaggatgggtgggcaccctggtccagaacccacagaatggagagcgcaagcctacagcgggtcccagaagccaagaaggtgtgtgggccctcaagcttccagattgtgctggtcaagctggagagaactgtgaccctgaaccacacgtgtgggcctgagctggctggcccctgaaagggatgtggtgccttcagagaccaagtgtgagaatgcaagctggggtgagacccaaggtgccggtaatgacacacaccttgtggccctgctgaatggcatcttcaaccacgagtgtgacattaagcaccgaggacactgtgccggagagtgagatatgcactcggggactgttggcccctgtgggggcctctgagggtgactacacgggcccacttggctgcgttaaccacaatgttgggtcctggaaggagatttataacccccgagtatgcgcacagtgcccgctgggcacctgtgtttaccgcgtgtn

SEQ ID NO: 583729 - DNA, 134 bp, Homo sapiens
tctggccgctgtaattccgagctactcagaatgctaaggcaggagatctcgcttgaaccccaggggcagagtttgcaattgagccgagattgcgcttctgctttccagcctggttgacagagcaaggctctgtc

SEQ ID NO: 583730 - DNA, 244 bp, Homo sapiens
gctccgagacctcgggcatccggtcgaggtatggggctgggacgaggcgaacgtcggtgccgccgtggacgatccgttcgagctggccgagaagattcgggccgtgatcgccgccgagaccgggctgtcgtgcagcgtcggcatcagtgacaacaagcagcgggccaaggtcgcgaccggattcggtaaaccagctggggttttcgcgctcaccgccgagaactggatgacagtcatgggcgac

SEQ ID NO: 583731 - DNA, 110 bp, Homo sapiens
catcaccctcacctctaccatcaccaccatcaccatcactaccaccaccatcaccatcatcaccctcacgcacataccatcaacacctatcaccacgcacaaacaccacc

SEQ ID NO: 583732 - DNA, 113 bp, Homo sapiens
tgttggcagagaccggccaggtctgacacccacgccctccttctcactagctgaactcccactccgctaaggaccctgcaaatgcagaaccgtggaccttggataatgaaagg

SEQ ID NO: 583733 - DNA, 390 bp, Homo sapiens
tatcatacctggactactggcatacctaaaccttctggcatacctgaccttctggcataccttgaccttctggcatacctggacctatctgggatacctggaccttctggcatacctggaccttctggcatacctggaccttctatagggtgatagattaggtccaaatggatgagaggagttcagatatctatttgcgatacaaacgatagtgcgtgtagatttttgaacgctttctataattggtggctgcttataaggcctactatgggtagtaaaatagtctactctactctacaaggtataaaacctaatgtccaaagagcagtaccactatggactaacagttaaataaacaaggagatacaaagggtactgagaacaattatc

SEQ ID NO: 583734 - DNA, 100 bp, Homo sapiens
ttgaatctgacggtttctcattgttctagagactggggagtcacatataaagtccccagcagattcagtgcttggtcagtgctcactcttgcttcatctc

SEQ ID NO: 583735 - DNA, 365 bp, Homo sapiens
ttaaatgggtgtatggcatgatgctcaggttggggagatgaatgaactgtcagccagataatactatctgggtgcatagtaccgaaaagttagtttttcaacccttccttcccctccctttcccccttctattcgtccccagtgtctattcttgccatctttatgtcacttataagtgagaacaggcgatatttggttttctgttcctgtattaatttgcttagaataatggcctccagctgcatccatgttgctgcaaatgacatgatttcctcctttttatggctgcttagtattccatggtgtatctgtactacattttctttatcctatgcatccttgatcggcacctaggttgattcctt

SEQ ID NO: 583736 - DNA, 173 bp, Homo sapiens
gaacttgataagttgtgcaggtagtgaggatgcaatgtgcagaaggcgggtctgcttccaagacgtgcacaaagacaatgacaggcttcttgtggcgagtgctgggtgatagcatggtacacagtgcttgcgactcacagtgattgcatcgtcccagactgctaactatgggg

SEQ ID NO: 583737 - DNA, 150 bp, Homo sapiens
taacaaacaaatttgattattaaaccaaaccctacacagaaaattattccaaccctcaatttttgaattttcatttaaataagcaaactctaaagacacatcttaaaagatgtttgtgcagctatgtatttccaaaatactcatatttca

SEQ ID NO: 583738 - DNA, 1033 bp, Homo sapiens
tgggtgcgggcttccgctggcgtgctcgttcttcgtttggtggcccgccgggcggtgctgtcgtcctctcttgtctgtgcgcgcgtgtcggggggtgggcgttgggggctgtgctgtgtgcggtgttcgggtcttgcttttgtgtcgtttggggtggggtgtgtccgtgtgtggtgtccttgctgcggtttgcctcgctgttggcccgtcgagcgtctttttctcgcgtcgttgtgcttgtctctctcctcttcgtcgggctgtctgctggctggggctgggtgttcggcctctctggggttttgtggctcgcgtgcgtgtgcgtgtcttcgctcgtctttcccccctcctccttcccttcctccccccccttcgcgcgccctctttttctctcgcttcgcttcctcctctctcctctgtcccttctctccctctctctcttgctcctcttttttcgcttatgcttctcttcctgctcgtgtcgcgcggcctctgggctggggtcttctctttttttgtctctctccctgcctcgctctctcgtctcgctctgcgctctcgctccttcttctccttcgtttttgttgtttgccctcgcgctcgcccctctctctcccctccgctctggtgtcgcttgtgctttgttcttgtcttcccggcctccctcccgcccctccctctctctcttttgtcgttttctcgttattcgggtttgtgttctggccgttgttggccctcttcccgcccccccctcccctcccccctcccgccccgcgcccccccgccccgcctcccccccctgcccctcgccgccgcccgccgccctccccctctcctccccgcctgcgggggcgccccccccccccccccccttcttcttcttgtgtgcgcctgcctctctctctctctcttgttgtttgctccgtcgcgcggtcctctctctctctctctctctctctttttctttttttctttcttctcgtcgttggattgattttttttttttttttttttttataggtaaaataatata

SEQ ID NO: 583739 - DNA, 854 bp, Homo sapiens
  misc_feature (2)..(2): n is a, c, g, or t
  misc_feature (239)..(239): n is a, c, g, or t
  misc_feature (252)..(252): n is a, c, g, or t
  misc_feature (259)..(259): n is a, c, g, or t
  misc_feature (270)..(270): n is a, c, g, or t
  misc_feature (282)..(282): n is a, c, g, or t
  misc_feature (306)..(306): n is a, c, g, or t
  misc_feature (327)..(327): n is a, c, g, or t
  misc_feature (336)..(336): n is a, c, g, or t
  misc_feature (339)..(339): n is a, c, g, or t
  misc_feature (350)..(351): n is a, c, g, or t
  misc_feature (357)..(357): n is a, c, g, or t
  misc_feature (372)..(372): n is a, c, g, or t
  misc_feature (389)..(389): n is a, c, g, or t
  misc_feature (393)..(393): n is a, c, g, or t
  misc_feature (396)..(396): n is a, c, g, or t
  misc_feature (408)..(408): n is a, c, g, or t
  misc_feature (419)..(419): n is a, c, g, or t
  misc_feature (438)..(438): n is a, c, g, or t
  misc_feature (442)..(442): n is a, c, g, or t
  misc_feature (501)..(501): n is a, c, g, or t
  misc_feature (602)..(602): n is a, c, g, or t
  misc_feature (604)..(605): n is a, c, g, or t
  misc_feature (608)..(608): n is a, c, g, or t
  misc_feature (610)..(610): n is a, c, g, or t
  misc_feature (614)..(616): n is a, c, g, or t
  misc_feature (618)..(620): n is a, c, g, or t
  misc_feature (635)..(635): n is a, c, g, or t
  misc_feature (637)..(637): n is a, c, g, or t
  misc_feature (681)..(681): n is a, c, g, or t
  misc_feature (793)..(793): n is a, c, g, or t
  misc_feature (823)..(823): n is a, c, g, or t
anagcaggcggggaccgggccggaaggcccgggaggcgcgcgcggccggccgccggccggccggccacggagggggcccagcaccaggagggccgggagcggcgggcgccggggccgggccgggagggccggggcagccccgcagcaagaagcccggccggaggagacagaggggggggaagaaacgggggcagaggggacggagggagcgtggggagcgaagccgggccagggggaangaggagaaggggnggagggnttagtggatancgttgagtaggnttgggcgtaaaagcccggccatanccaccacggcaaacacggcangtggggctngcngtaggtgtacnncacccnctgtgtcggggtctnggtccccaccagcggcncatnccncaggggcgaggnggagaagtggntcatctaggtcttcaagancggngacgcggccggccacggcggggccacaaaggtcacccgggagggcaccatgaagggccncaagcgccaccggtacgacagcgtgccgggcaaagacagccccctcgggccgggacgcggagcggatcgaaggcccccggttttggtgtggacgtgcgcantnnttntngttnnntnnnttttttttttttttntnacaacaaccggcggacggagaagcagaagcggcgggggaagaanagccaggagaaggagaagcgccgggaggcaggagaccaccccggggagcggcgggcccgggacggcgagaagaacgagaacagggacagcggcccgggacacgggcaaggcngccaacgggaccagcaccccagggacgggngaccgcgcccacaccgaacgggcgccacggc

SEQ ID NO: 583740 - DNA, 619 bp, Homo sapiens
aagaaatgaattcgtcccaatccgagtgttggccacatccctccggtgaactggcgaaattcctgaaggattaaacgtgaaatgttcaaggcaagctgtctttcagagcattgcacaagatcagatggggcgctgtatgtgtgttatgaggagcggccggcaaccaacaagtaagcttctgagatattatgcagaattatgcgaaatgtgacgtgcataagattcaagttatcacacataacattatattggtttcgatatttacagagcacttttacaagtcagcatgttaattaaaatgtgtggccacaatcagtaattttggcttttggccttgtacaaaaaaatgagtgtggtgatccattaaataatggataggtctagtcatgttaatagttttctgttcatgatcacgtctatatcttttaaccacatttagggtgactgcaacgtaccagtgatgtttctatgctaaaagatcagtgacatattttatttccgcaaagaaccatagtatctttcagcagcccattcatgagaggggtgttcagtatagccattgcatggattcaaagtagttcttgagcgccattcgtgccaagattcagtataaattgag

SEQ ID NO: 583741 - DNA, 335 bp, Homo sapiens
catgggaagattacaataaacaggagaaatgaggaaaggaaaatagctccgcgcagtctgaagtctgcaaggtgtgcagagccagagagacatgagtatgtatctgatgccacactatgcctagggaaagtttagatccttgtgcccctgactagctgcctcgcccattatcttcatgtacctagaatatgtaacacaaagaacaatgtacaacctataaatagcttatgtaattataatgtaaatatttggtacacaactcaggaactgcctcttctttccctttacttccctaattgttacaagcaacacttattacgttgctgattagagtg

SEQ ID NO: 583742 - DNA, 152 bp, Homo sapiens
caagacggctgagcccgtgccgtgtatacctgtgcaaacacgcacgaacaggatggaacgaggacgaacatcgcgagctccgaggtaaagacaaaccctgcgaactagtgggacgccgcagtcatcgttgttctcgacactccacccatccg

SEQ ID NO: 583743 - DNA, 179 bp, Homo sapiens
gatgatgcgcttctcagaaatgtccaggcatttctgagaagcgcatcatctctacccaagtccaggtcctacgacaagagcatgcagcggggcagccacttctccagctcatgaacagcattggggctgtcaagaactgggtggacgatcaggctccgggctgtaggccttaatcaccg

SEQ ID NO: 583744 - DNA, 846 bp, Homo sapiens
cacctggcaggaggcagtcctggcatccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtctggggtctgcctgaggcagatagaggagcttagggtgccctcccttgtaccccaggagatggagcattgtgtgccaggaggaggctggagactatagttcagtcttgtgggggaaggaggatgagagtcttctggatgaggagttgagcttggctgggtccagggcccagacatctgactctccgtccctgagcgaggacggtacacgacagaggaagaggaggggctccgattgggaccccgtagggatcctggcagatggttgtcacttccgctcgaattccctcttgaaccccctaccaacagagctgaggccctgaccctgtcagacatgtccctggattcctgtctcggatggtctcctgtcacgggctctcctttgctgtggggtcctccgtcatggcctcgtgcccctccttgctgctgcttgcttgcttccattgctagtcaggtcccacgtgtggtcgcgttgtcttgtgacagcaagcgctgggtggtgcttgacgtggaggctcgttgggatctggcggggctttcttaacctggctccgttgcttcgggccccgcacctgcccgtccgtcttatcctatgtcttgggcaatggttaacacaatcggggggcgctctgggggcctgaacattggggccgagggctt

SEQ ID NO: 583745 - DNA, 219 bp, Homo sapiens
  misc_feature (46)..(46): n is a, c, g, or t
cactctacacgagctttggctcagtgatcctcactgctaatagtancacttgggaggtagaggcaagtggaacacctgaaatcaggagttcaagaccagcccagccaacatggcaaaaccccatctctactaaaaatacaaaaattagccaggtatggtagctcaagcatgtaatcccagcactttgggaggccaaggtgggcggatcacctgaggcca

SEQ ID NO: 583746 - DNA, 996 bp, Homo sapiens
ggagcccaaggaggcccgactgacgactgaccagttgccatgggcgatcctacgtacgagatcctagacgtgccgcgaagatgcgtccgctgatgacatcaagaaggcgtatcggcgcaaggctctccgaggtggcacccagacgagaaagcccatgactaataaagagtttgcatgacgaagacatttacaggaggtggccgaggcagtatgatgggctgctgctcgtgacaagcacaagctgggagcatttacggaccgcgtatggccggcgaagggctgcaccagggaccaggcaactggccctatctcgtggccagaagcctggcagctggatgggccttggccttcatgctgtgtcgagccttgtccggcaatgcgcccaggagggcgagggctcgttccggaggtcacagtctcagtctctgagcgcaggctgcgcagtaacgccctgtcttgggccaaggaaggcctccttctttgtgagaagcttgtcaacccctgggccgttcctgctcaccgttgttaccctccgaggacaagggccccggtgattcccacggcataaggaaccccaggcggaggggcggcaattgacctccaccagggtgaaccagcaagcccattccccaaaggcggggggcccgcgccgccgcccccctgattttgttcacccgcgcttggtttcggttaagacgccccccccggtttttgttggccgttttgcccttttgttcccccccggtctacccccagtttttacacaccgttgggcggcggaccgacgccgttccaccagcacaccttgtttttccgtccgccgtttcccctgttcaatggctccttgttgttccctccccggttatccaaggtctccccctgggggggggcccccttggggcgtgcccatattgtctccgcgcgattccgtgactattgtccataaccggatattccgtaagcccccagcgccattttgggggttcgccaaagggg

SEQ ID NO: 583747 - DNA, 789 bp, Homo sapiens
ttgtggctaacaccatattaggggggtgttttgatcacccgtctacgggaataaagtgtccgtcgattccgcgcatacatggaacacgcggggggaactcattgagttgtcagggcccctgaaatttcgaatgtgtccaagcgccacttataaccgtggggttgaaacacggttctctttgctacagggagtacaaaccagtccattactgatgtctatagcacagtgcttcagtgaccagtaatcgccagccacttttggaagcacgcgacatattgcttgagcccaggaggttcatggcacagcctgagcctacacaacgtgagaccccgatctcgtacgggtgcatagggaaaaattaccctaatgtggcggcatacacctgtagcctcagctactcaaggtggctgactggagggatcacttgagcccacaagggctgagtctgcagtgagccataatcatgtcacgtgcaatccaagcctgggcacaaagcagtgagactctaaccttcccagaaagtaattataagagagcctatgtgcctgtctttgtgcatttggtggagggggacagagagagttacatttataggtaactcacaggtggcagattccgatttgggtgcctgtagagccacactgtactaccattaagaaaagaagtcaaaataaacaagagaattgcgcttctgtgatatatctgatagagcataaatttgaaaggggagtactcacaatggaagtaccataataaaatattgaaataaaaaaaacaaacaaacatgca

SEQ ID NO: 583748 - DNA, 201 bp, Homo sapiens
  misc_feature (191)..(191): n is a, c, g, or t
ttatattgtggtgttaccgtagaacagagactcttgaaggatggttaatataaataaacacctcgcaggaagagggaaaagaaaatataccaatgcctgggacccaactcctctattaaattagaatctccaggtggaatccaggttttgtttttttaagttgcccaggatgggctaggatgggcagccangaattaagaa

SEQ ID NO: 583749 - DNA, 185 bp, Homo sapiens
  misc_feature (165)..(165): n is a, c, g, or t
gggctccggcaaccgctccggcaacgcaaccagctccgctgcgcgcaggctcgggctgcaggctctcggctgcagcgctgggctggtgtgcagtggtgcgaccacggctcacggcagcctcagccacccagatgtaagcgatctggttcccacctcagcctcccngagtagtggatctaggatct

SEQ ID NO: 583750 - DNA, 704 bp, Homo sapiens
  misc_feature (441)..(441): n is a, c, g, or t
  misc_feature (446)..(446): n is a, c, g, or t
  misc_feature (453)..(453): n is a, c, g, or t
  misc_feature (463)..(463): n is a, c, g, or t
  misc_feature (475)..(475): n is a, c, g, or t
  misc_feature (676)..(676): n is a, c, g, or t
  misc_feature (688)..(688): n is a, c, g, or t
tttaattcagccctctttgacaattaagtttttttactttgactatttttttgcatttttattaacctaaaatatttctcctgcctatttagtggagaaaaagccaaagcataggaaggctttcgcctctgcttctgaaactggaagatgtatgttaacccctgaaagaatcatttaagagtcatagtttttctgctaccttgacagtgcagatgtcattctcctctttggacagacaaagaagatacatctaaagaagggaaataactagtccaagtcttcatagatggctagaggccgagtctggacaagggcctgggtctactgcctccctgtatgtccatgatggcatgaacatttgtatccagacctgggaggcctttcccaggactcagttgccctgtggggagcacagcataacggattgggacaggccaactnagggnggcaggnttcttccccnttcccctcccangtttcctgtcttttccagttgggggattggggaactcaacccccgaggggatgcccaagattcctttgcaaaaccgcttattaacagaaaaccctaaaccattggattgtttgaaaaccaaaacaagcttgggctcaaaggtcaaggacacctttaatggcaacctgcccttcctcttcaagtgctctagttgaaacaccnctgtccatccangcacaccctaacaagg

SEQ ID NO: 583751 - DNA, 1115 bp, Homo sapiens
ggtacttcgccgtccctcgccgtccttcgccatcgcaacgaccaccgtgaccccgatctctcgaaatctgcagacatcttgatattttacccacgcatagtctgtcagagtcatcctgcacgcccactcgacgccagggcgccgggtgacgtccacatcacgggcgcatggtcggctcctactcgtcaccatcgggggaaactgacgacccggggcaaggcggcagagcaggtccggccctgtccttgcgtgcacgtgtctcggtcctctttgccgcgacgctgagccccccaggacttcgcgctgtccgcgggaacagacactggctaggccttgtgggcctgtgctgcatcctcggacggtttcgcaccgagccagttgcccatctcgtctccgtgcagacacctctagatctgcacccccgtgaggggcttccacatgtccgcggggctgagaatggccctgggagcatgtgacactaatgacgcagcagcacaccaaggggcgtcgtagacaacacgcgctaccctcttcgtggacgcacgaaccaggcgacactcgagcagcgccccccgacgatattcgacacagagacactagtagaccacccgcggtcgccacacctcgagccccaccatcgcatccccgacctcactccaaccgaccgcacggatacaccctcgacacacccagcccaagaaaacccagactccagtgcatgcactagcatcccatatgaggagccactacgcgattccacaactgcacaaccgagccaaacgcagacaccggacatacaacggtccgacaaaccaacaccaccaaatcaactacacaactatcaaactaccgagaccaatacatgacaccgacgccacaaacgaccgaccgacagaaccactctcaacctcatggatagtgcccaagccccaagcacaccacaagaagacaacgaaacgacagaacacccggcaaacaaccgccccaagcacggatgggctcgaaccatgcgcactagacgcctcctcctaacgctattacaactcctgacacccgaaaacaccaacaacaaacgcagcagccacctcaacccgcgacacgtacggcaacgccgt

SEQ ID NO: 583752 - DNA, 155 bp, Homo sapiens
gtacgatgaggcaggcccataccattgtccaccgcaaatgctttctaagatgccttctctctccatctaccttccagtaaggatgacggtattatggttcttggaggtctccaaccaccttccctaattttaataaataattgtcaagtttgttt

SEQ ID NO: 583753 - DNA, 374 bp, Homo sapiens
tttgccttgcagaagctctgcaattatatgaggtcccatttgtcgattctcgatcttacagcagaagccattgctgttctattcaggaatttttccccccatatccatatctttgaggcttttccctactttctcctctataagtttcagtgtctctggttttatgtggagttccttaatccacttagatttaaccttagtacaaggacatagaaatggatcaattcgcaatcttctacatgatagcagccagttgtgccagcaccatttcttgaaaatgctgtcttttttccactggatggcttagctcccttgtcaaagatcaagtgatgattagtgtgtgggttcatctctggggcttcaattgtcgacgc

SEQ ID NO: 583754 - DNA, 793 bp, Homo sapiens
agcggactggggcaggagaatcgcttgaacccaggaggtggaggttgtggtgagctgagattgcccatcggcactccagcctgggcaacagagtgagactccatctctcacacacacaagacacacacacacacgacacgcaaaagaaaggtgaatgtgacttaagtgacagcaaaattgtatgcttaaacaatggttaggatagtacatatgatgtgtgttataccacagtgaaaaagattattgctaaaaatacctagccggaccatggtaacgtgggcaggtcatttgtcaaatgtgagagacggagatggcggggaaaaggacacatttaacacttgatgcaagaattatgatcaaaattgtcttagcctgttcacgctactcttataaaatgccatagtactgtgcaggcataaaacagactgatattctggccgggcacagtggctcatgcctgtaatcccagacactttgggaggctgaggtagggtggatcaggagttcgagaacatcctggccaaatatggtgaaaccccgatctctacaaaaaatacaaaaattagcaaggtaactacaggccatgttgcgcacacaacggtcacggctagtaccagtgtatatattatgaagagatggggatcccccccaagggtgagactctaactcctggtcgacaagagaatctgggctgcctcggtctccccagagtgctagggatgacaagtgtgagctacacaagcacggactaaacatgatgattaagagctcagccagaagacagagaaagcac

SEQ ID NO: 583755 - DNA, 488 bp, Homo sapiens
gtgcagggggggtagggggggttggagtctcagctctgccatcaccatagctaggtatcctcagtgctcccacctataaaatagaaggggccgtgcccatcttttaggactatgatgatggaatgcactgataactttaagttacttggtgtagggccgggtgtaaaggatgtatacggtaatgggggatggtaaatgaaatctaggttaaaaagataatcagggcagtaccccatcctcctaccaccctatcaaggttggccattctagagtttcaagcaacttttagaaaccacacggggctttagtgcatctggtcactagagggattggctagttggcaggattctagagggctccaaactcagatcagggtggggtccgtgacaaggagaaaagctgggttatatgcaagagcgtaacaaaatttccccatttcttttctttttttcctttttttgtgggggcgccggcaattggggtaattt

SEQ ID NO: 583756 - DNA, 219 bp, Homo sapiens
gctcggccgttattcacgtggtatgatttttcatttcctgaataattgtgatattgggcatcttttcacatgcttgttggccatgtgtattgtcttctttggggaaatgtctattaaagtcctgtgcccatttaaaaaatcaggtcgtttgctttttgtttttgagttataggagttttgttttttttttttttgaaatgggattttggctttttcccc

SEQ ID NO: 583757 - DNA, 303 bp, Homo sapiens
aaatggctctatcccatcgtgtaacaggacacacaggattgaaagatttccatgccttccgcattgtatagagacaccaaggcatgagctctaggcgaagctcattagacctgtctctgcaatgagaagttgtggaataggagactggcagcaatgtgacgacaactaccattgacatgttctgcccttggaacacattaaagaagtgcggcatgtcgtcgtcattacattgtcatcgcctcgatgatccagggaagtctgtcgtggattgtagcaacatactcattggaaggtcagaacaca

SEQ ID NO: 583758 - DNA, 580 bp, Homo sapiens
  misc_feature (115)..(115): n is a, c, g, or t
caggaattcggcccgagggaaggccaaaaaatgaaatggaaaatccttttttgctcagcatctgtaaaaaacaatttgaccctcgcagcctaaaagccctcaggagggattcccnggccaaaaaaggcagattgtttttttaatgataagggtaatgtggggaacccccagcttccccctgatttggggccaggggtcacatccttgcgggccccgagaactcccccccccaaattgctgttgcagggacacaagcacttttggggttatcaacccttttttttttttttcagcaaaaaggcttttgcccccaaaaaaataaaaccaatggggggaaaaggaagctatgcctctttccccaaagccaagcttgttttattataacatgatccccagcttttgatttccacttaagggatgagatttggaattatttcaaaagtatgattgattttgatcaggggaaaatattttaaaaaaagggaattatttcttaggggacttaatttaaccccccttaaagatttttgcccaaacatgtaatcatagggttagactaaaaaaaaataataaaaatgta

SEQ ID NO: 583759 - DNA, 606 bp, Homo sapiens
  misc_feature (603)..(603): n is a, c, g, or t
cggcgggcagggctgggcaccggcctgagtctcaccggactgtccaccgggagttgagtcggagtggcgagctggcagtacgggctctggagcagtttgccactgtgggggaggccaagctgataaaaccaaaaaggggattgtcaatgaacagtttttgctgcaacgggtggcagacggggccatcgacctctatgccatggtggtggttctttcaagggcctcaagatccctgagtgagggccccccccgggcccagcatgagaaaatgctttgtgacacctggtgtattgaggctgcagctcggatcccaaaggggatggccgccctgcagtttgacccctggcagcaagaggtttaccgcaacttcaaaagcatctccaaggccttggtggagcggggtggtgtggtcaccaacaacccacttgggttttgaatactcccggccagggcctgtcccagttatgggccttccctcaagccaaaaccgaagcccctttccttaaggccctggtttgtcccgaaggggcctagtgttcccagccctgggcctgctttcaagagccctttctgcctcgcaaataataaaaatttttagcccgncca

SEQ ID NO: 583760 - DNA, 122 bp, Homo sapiens
tgtgagcatcgtccgcatttgctggccatttggagttgtggcccacctgtttcttctgaactgtagtcacagaccactggttagttcacccccacaatggccaaaagctacaaacagcttaa

SEQ ID NO: 583761 - DNA, 503 bp, Homo sapiens
  misc_feature (94)..(94): n is a, c, g, or t
  misc_feature (113)..(113): n is a, c, g, or t
  misc_feature (137)..(137): n is a, c, g, or t
  misc_feature (402)..(402): n is a, c, g, or t
gggaaaaaaaaacaaacaaccccaggtgtctttttttaatctggtttccgaaaaaactttcaggccctgttggaggagcacaattttagtgggncaagggccctaaatacctnagggccttggggggaccccctttngggccccagggccccttttgtgttgtttgtgggttcccatccccccacacctgtgtaaaatggggggcccggtattgcattgtgggctgtttggggaccccccaggaaaccaggggttttaagtggattgtgtgggcctgggcattcccaaaaaggaagggcccctgtgccctgcccggcctttaaaaaaacaaaatttttttccccaaagcaggggggggtttttttggaccaagggaggagccgttcattccccccacaaaantgtgttttttttgccaggaaagaccaccctcctttttgggaattttttggcaggtggggtgggcccccccgtgttgtttaaataaaaagccttgggccgga

SEQ ID NO: 583762 - DNA, 369 bp, Homo sapiens
  misc_feature (10)..(10): n is a, c, g, or t
  misc_feature (27)..(27): n is a, c, g, or t
  misc_feature (78)..(78): n is a, c, g, or t
  misc_feature (315)..(315): n is a, c, g, or t
  misc_feature (333)..(333): n is a, c, g, or t
  misc_feature (364)..(364): n is a, c, g, or t
aaaattaaanccccctatatgtgttanccctgggaaaatatgatgaatgggtatgtgtcccacggcaaaaactgcatnccctaatacctatcctagccagctccccaaagcaaaagtataggtaaggttttcagagaaaattattgctataaaatctgaagcttaaagaaggcaatgactttgttttcctatatgaaagaagcacagtacgtatcattgatgagtcattatcaaaaccaattttgggcttggtatggtggttcacaccggtaatcccagcactttgggaggctgaggcagaaggactgcttgagnccaggagttttaggccancctgggcaacaatgcaagacctccatctganccaaa

SEQ ID NO: 583763 - DNA, 265 bp, Homo sapiens
gacaccgcatggagaaacgaataacatgcatacagaacagccagaaacagcgaaagcaaaaagaggaacaataacaacagcaacacaacaaacaaccacacaaacgccacgacacaaaacaacgcgaacgaacagaaacaacacagaaacagaagcatacacacaccacggcaaacagcacgccaacagcgaacagccaacccagacaccaagagaaggaaagaaccgaaaaccacaacccaaaacgaaacaaaagacaaaacaa

SEQ ID NO: 583764 - DNA, 157 bp, Homo sapiens
acagcgtcagggacaggaggataggaacaaataactgtagtccgggcgaccaatacagttattcacccaggggcagtgatgatcaacatacctccacacagttgtcacagacactgcagtgggaacatcgagggggacggtaaaagcggcagtgtgg

SEQ ID NO: 583765 - DNA, 783 bp, Homo sapiens
  misc_feature (783)..(783): n is a, c, g, or t
cccaggagcaagatgcgtctgagtcccgccaatgcgcggctgcactggccctcggtagtgtatgtgccctgaagtgacgtacgcgcgtatagacaggaaaaggttaagaagttcttgacataggatgttctaccaggaatgattgatagctcgtggatattgaatgcacgttcaacgtatgggtaacctagctattggattcaggtttgtgcctccaatcgtgcgacagcagtgcttggcgtcttgatcattgtagtgcatcctgttgactggagcggtagacacgggagggaattgaaccacactgtatgatttgggcttggggagcttccaagtatgggggttgaagatgactagtcgcgaaggtcaggtcgtaacctggccgcaaaggggccttgcgtattattggacttggtactgtgaccgtggattagccagaaggaagggccttggggctgggtctccgtgccggaaggttgaaaccaaatgtgggtaagggaaggggggggaaccaaggttcggggattaaggacattttaacacaacggaacgttagggtcctccgagttcgggggaccctcgggatttagtctctacacgcaagtttgctgttggaagacatgcccgacgttcatggggggcccttttaacacagctttggaaggatatggatgcaattccaactatgcactagggggaaagatgattcatgaggggcaaaacacaccctagttgagcgactcgcaacctttggtggtatccccgtaggactaacaggcgcgn

SEQ ID NO: 583766 - DNA, 568 bp, Homo sapiens
  misc_feature (264)..(264): n is a, c, g, or t
cgaatgccaatccaaggttcccaaatcagcccgcacatccactatagcgctactttatatcgtcttcttgccgtagtcgggaacgggaaggaaagtctcttttaaagcgttatagttattttgacgagagagagggagagtagggtgcgcttcaattttctcttggggagtacgtatgtcgtgcatactttggacggatcgtataaccggacctgacgtcgtaagaccgagggatgtgaccttactatctatctgcgtcgtagntatgtgggttagtgtgtctgcgtaggttgtgagggcttgaggatagtctttgttcgatcttgtggtttttgcgtaggaggtcttgaacctgaagaagaggggtagttttctttctgttgcctggctgagttaaaacgtgtttctagtgggagcccgcctctgatagagttcgtcttttttatttatatagctgtgttccgtgagaggagggagtaaagtgactcggcttcgttgtgtgccgggacggggcgcgtaccgggtagtagctgcgttttgccgggcgtgtttgagcagatgttcttag

SEQ ID NO: 583767 - DNA, 302 bp, Homo sapiens
  misc_feature (5)..(5): n is a, c, g, or t
  misc_feature (8)..(8): n is a, c, g, or t
  misc_feature (210)..(210): n is a, c, g, or t
aaccntcntgcctcccaggttcaagcgattgtcctgcctcagcctcccaagtagctggggttacaggcgcccaccaccatgcctggctaattttttatatttttagtagagatgggatttcactgtgttggccaggctggtctcgaacgcctgacctcatgatctacctgcctcggcctcccaaagtgctgggattacaggcgtgacacncaatacccacccacctaatttctactttttatttttatttattcatttatttatttttgagacaaagtctcactgtgtcacccaggctggag

SEQ ID NO: 583768 - DNA, 292 bp, Homo sapiens
aaaaaaattaatccccttttttccctggttttcttatttcaaaaatcccagcccttgggtaaactttggatggcaatgttagggggtcctttttaacaagctttgggttgggctttgcttttcccctccccttagccctagtgggtggccattaggccaacccttttttttttaggggaaacatggggatatggacaatgtccaaaaccccctgaatattaggaaatcctttacgatattttgtgtagccccttttgtttgcgggtgagggaataaagtttttccccagtga

SEQ ID NO: 583769 - DNA, 195 bp, Homo sapiens
tgctagaggatcccggtgggaaaagcctgggaactggacagagaaaatggggcgggggctacctttctcaagtgttttcgttcagatggcaattcctctggttgtcggcaccaataaccttatcattctcatccacaacaagcagcgcttggaggaaacgctgatggtggtggatgagaatgataaggttatggg

SEQ ID NO: 583770 - DNA, 1331 bp, Homo sapiens
agttcatggagggggacaagggagtgcgtggtaaactgtcttgagccccaccctacacctgcctgtgctggcaaccaggtggacctagaccatgatgtgaagatctggtgcacccgacagctgaagctatccactgatgctgacagggttacaaagatgtgattaacgaagaacaacgcggcgagcgggatgaagatagcttgcaccaacactgacctgtcttgaatagctcacatgctgtggtatccttactgcactcacctgagtacagagacgccatcaccggcgctggcgagaacctggggtctggggccacagacgcggactcgtgagtgcagtctcccagaatcctcagacaacactcaggacgaggaggagggacctgaccggagatgcagcagcatgcccatcttgaggccatcataccaggccctacatacagcaacaaaaacgcacctaggacctagcaaagccatgaaagaataaaacgacagaacatccccagcgacgaagagaccaagccagaacggagtgaaaccaaacgcaagagtcccctacgacgaagtgggccgcccgcagccacaggcaaccggccgcctccacggcaagcaggcagcaataggacccacgcgccacgcaatgcgccaacaaccaccaaccgacccccgcaccccccaccacgcagcaacgcacagaccaccacacgccaaccccgcgcacagggcacaccggcgccccgcggagcaacccacccacacaccacaccacaccaccccccagcacgacagcgaacgaagaggaaatgaaggcacaccacgcgacccacccccgcaacacacaggagagcaacaaaagaacgcgcccagacagtgcgaacaaacgcaagagagcaaacgcacagacccacagaaccacaagaccagcaaagcgacaaagcacagcacccccacaaccacgcaccaacaccacacccacacgggacgagcggccgaggggcacgccgggacgacgcgccgagcgccgagggccaaaacggaagcacgacaacagcgacgagggcacacaacatcacagcccccagggcggcagggccgccgacgcgcagcgcgccgcgccgagacaccaccgggacgcgcacgacgacgagaaagagaaagagacgggacggactaggcagcgagagaagaagtcaggaagagcacggcaagagaaacgcaaaaagcgaccgggaggcgcacagcgcggcgacacacccgccgcccgagccacgccacgccgcacgcccgcccgcccgccgaccccgacgacaggcaggggaggcagacgacaag

SEQ ID NO: 583771 - DNA, 425 bp, Homo sapiens
ctgccacaaagactgggctcagaggcgacactgaggaatgtatcacaggcaggaggcctggtgttctcagatgtattctttgtattgttagtgccctcttttgggcttcctacgtccagctgtgtctgagtaaaccgtccgtcttttccgctgttacctctggtgttgcttaactacgtgatctaaacagaattcgagtcattgagggccacatagatatacacctagaccgtgactattaagtcaataaaactaaaataataacgagcatacatcgccaaaacaaaaaaaacaaaacaaaacaacaacaaaaacacacaaccatcaacacatacaaaacacatcaaaaactaacaacactcaaaagacataaacacaccatcacacacctaccaaacccacaacaatcacaccaccgaccaaac

SEQ ID NO: 583772 - DNA, 289 bp, Homo sapiens
tagtcttcatgcaactaaaaatccctttttagatcatgggggggtacttcagatgctattctaatagaaataagaagtggctgctttaggaagcatactaaatgaagcacctccttaagggcactgtttacatgtgtactatctactaaatcatgccaaaagtaggaaaaaaagacactctggcatagttctcctagacattcaaaaggaaaaatatgttaccattcacaatcctaagtcaaaccgcttatatacgtttctgtaaaattgataaataggggggaacagg

SEQ ID NO: 583773 - DNA, 191 bp, Homo sapiens
ctgggatccagcctccatctggctaggaggcgtgccccgctacccggtatttatgccaaatgggccagtatcgaagaattcacaaaaaagaatagcctcatcatccccaccatcatagccaccatcaccttcattaacctctacttctaactacgcctatttacaccaaccccggcgttaggccgatctga

SEQ ID NO: 583774 - DNA, 128 bp, Homo sapiens
ggacacaccggtggacggaacggtaggactttgggtggatgacgagagggtgaggcagattctgaattttcttttgaactgagatttggccacctttgggcattccttatgccagtggtccgagcgga

SEQ ID NO: 583775 - DNA, 466 bp, Homo sapiens
  misc_feature (466)..(466): n is a, c, g, or t
tatggcagctctgaggtaaactttaatttctgggctgacaggacttccaaacccatgctccatcctgggcacctttttactcgtgcccaagcatggggcagcccagtccaaaagggtgccttgccagggcccaaggggggtggggagctcacttcacatttccaggcgtggaggagttgagaggactgggggagtacgtcctgtccacacgcccatttgccagcaagaggggccatgtgacttcaccttcaaccccaagttcctgtggattcccggggtgggaagggtgaccaatgtggcccttcctatcacacaagggttcctctcccaaagatacctgtaagagggcggggcgctcacagtggaacccagagaaacagaggggggctaagggcaccgcgagggcccccccagaggccctctccgagagtgggggaaaacgggtggggcccctccaaaggggggn

SEQ ID NO: 583776 - DNA, 562 bp, Homo sapiens
  misc_feature (207)..(207): n is a, c, g, or t
tacggtgttgttcagcattttggccagttccacccttattgcctatcaccagatcgcgggggtcggccaattccagtagcccccagagctttgcggggggcaagccccccttgtcttatgccagcgctttgggggcccctccaaagcccaggccccctcctgagcaggccaaaaaaagtaacgcccccctgtcttttttccaggaantgagcctagggggctcttttggcccccagggcttttcttcattttttaaaaaatccctttttttttccccccagggggaatgttttaatttctgtttggacccggaaaattaagggggttgggcttcctctttaaatgccccgttccctttgttttaatattaaatatgttcccccttaattgctttgctgctagccctccccctaatttttttaaaggatattccccttttttgccttttttatgggtccaacctttgcccgcttttttgtaaaataaaaaaattttttaatttgggttttgttccctttttttgcccccagctacccccccaagggttttttgtgccccttta

SEQ ID NO: 583777 - DNA, 129 bp, Homo sapiens
tcggtaccaatctgtcgattccaggtgaacgaggactgcgctcctggaccgcgcggacacggcggctcagatcacccagcgcaagtgggaggcggcccgtgaggcggagcagcggagagcctacctgga

SEQ ID NO: 583778 - DNA, 400 bp, Homo sapiens
gtgcactgatctgtggtcgcctcaggatccccgcttatcgagctactgctcatgggcgcagaaatactgatctgctgacgaaggctcacccgagatctccgcagtcttcagcgcattggaccgaaaaggcccagctatcgtgggctgggggagctccacgggcccttcagccaggtggaggacctggaacgcgtggagggcataacggggaaacagatggagtccttcctgaaggctaacatcctgggtctcgccgccggccagcgctgtggcgcctcctgaccgtcgtctcctcactccgccttttcaaatttttgtataagcccgtgttgtgtacatacagtttttgctccggatcgctccggatgagcgtgctccggatcaggagtaccgagctcga

SEQ ID NO: 583779 - DNA, 367 bp, Homo sapiens
caatttttgactcaatgccccggcccctgtagtgagttgaaccccctccagcagtcccctggcaaaagcccctggaaaacatgcaatgggaaccttcaccctgaggccaggccctttccatgctacccaacagtaaacaggacaccctgtgttgttggctgcacccgggttctgggattttggattccctggggcctggaaacccctttcagcacaaacaacccctgtgttccgaggtccagtcaactggccgggaaggaattcaacccaaccaaggacaaaggtccatattatgacgggtggatgctcgtgtgactttgctgaccttttatgttttttatgggcaataaaggccaaaaaagctcca

SEQ ID NO: 583780 - DNA, 718 bp, Homo sapiens
aagactgttaaaaccccttgtggttttttaaaacccatttgttgtctccccttggtccccatgtccctttacctttctccccaattttggggtggcctttctgaacttaatagagatggcccttatcaccgaacactttggctttaaaaggggtggtcaaaaaaaactcaatcctaattgtaacgctatggcttatccattctccccccttaaaaggaatcgttgcttggactttccagcagaatattaatcacgggaagaatttttccctcaatcaaagtcaatatgcttccatctctcaatagtgagtagcccccattctacttgaaacttagtattgaatttgagatcttgaacttatctgttaaacatcagatccttgggtcatagcacgaggccttttgcacaaaaacgctgcctgtctgttagtcatctgcgcaaaaagaacacccagcttgtaaagatgatttctacagaaagagtgcatgaattcaaacccttgtgctgttttgtgccactaaacatgcatatagttcataggtaaacaccatccccatgccccatatcccaggtataagctggatccgcatacgtattgagctcctctcagtctccatgtggggttcaattcattaaacgtacctgcgcatgccagttcagtgaacaccaacagtgttattaattaaacagcacgtctcattagccataaaaaaaaaaa

SEQ ID NO: 583781 - DNA, 321 bp, Homo sapiens
ggtctgcaggaactgaccggagatgttgatgccgttttcggcgaagaccttgttgatctcgctcatcacgcccggaatgttctcgtggatgtgcagcagacggtgcttgcccgggtgggctggcagcgccacttcagggaagttgaccgaggacaccgaggtgccgttgtcgctgtacttgaccagtttttctgccacttccaggccgatgttggcctgggcttcagcggtggaaccgccgatgtgcggggtcaggatcacgttgtccaggccgcgcagctcgctttcgaactgttcgtcgttggagcgcggctccaccgg

SEQ ID NO: 583782 - DNA, 421 bp, Homo sapiens
  misc_feature (98)..(98): n is a, c, g, or t
ggtgctctagaggatcctccgtatcccaccaaagccttttggagacagggtctgagaggagtcagggtcgtataaacttaacacattgtgttatccanaaaaccactaaaccctgttactctcggtctgtctgctatgtgaaaccaagggcgggtgttaaacgtttatcacccatggatatacaggatttgcgtggggacattctgggaatggggctcaagggggtctaaccttggaggtcaaggaagagggcaaggaatctttggttaagagggaagattggattgaacttgttggggggtcaggaacaagggggcaaggggttttggcttaagggggggaagattgggattgaacttggttgggacaattgttgggttggtaaaaatccattcccttcccccggttctttaacaattag

SEQ ID NO: 583783 - DNA, 271 bp, Homo sapiens
acctactagctgtattacagactggtagctacagttaggcaacatacatgcttgtttctcagaatcatactataagatacataaatctgccaaacgtctagaatatcagtattaaaatagtctgatagatgccttacaggatcatgaatgactaaggtgggatatgctttaaaaccaaatttaaaaattccaaaaagggcatctttatcttgttcaaccatgcattctggaaagggtcaatttcagaaattatttaaaggttaataagagt

SEQ ID NO: 583784 - DNA, 143 bp, Homo sapiens
taatcgagccgtacttcagctcatcatgtcctgcaagtgacataaagtccttttatggctgcatagtattccatggtgtatatgtgccacattttctttatccagtcatatcagtgatgggcgttaggcgttggctggaagtc

SEQ ID NO: 583785 - DNA, 126 bp, Homo sapiens
aggcctgagtggcaggagcactaaagctctgggcacagagtccatgagctcggggtccagccaacgacgtccgtgccacagactccacatagctccggggctctggctggatccgtcttctggtaa

SEQ ID NO: 583786 - DNA, 224 bp, Homo sapiens
ggtatgcagcctgctgagtgttaccagcctgctgaggtgtgatgccctaggcactactctctgcctcttctgttaattgtaaggggagtaggcagactccattagatcttgcctatcctttaggatggacgctcactcagatgtacgaaggcatctgccactggctcttaactctgtccttccagtgagaagcgtcaggagtccgacttcctcagcaggctgca

SEQ ID NO: 583787 - DNA, 1191 bp, Homo sapiens
tacaaggttcagtttccttataatgaccccaatttcccgtgaaagggcagggtgcaggcagctagggtgagtggcaagagagtgttcactttgaagattctgcccggatatgagggcttggcccacatgtgcgtggaaggcccccttcccaggaaaagtacctctcgaaccagcgtcgtgggtctcctcgtgtgccaggatccagttttccgccgagtggtgttttgactcgtagttccaccgtgccaatcgtggacttcaggggaaagaggcaagcctcgcgtggcctcgagaaagaacccgagaattccgagaaaagtggagccgtgctatgtggtgggtctccaaaagagagggattgcaccactgtggccggaaaagcgcgtattcttctcctctcagaggttgtgttcccgaggatccgctgtgggaaacatttctccgagtgtgtattgagagaaatgggcggaggtctctatgaagaggcttctgaaggtgaagtccctttcgaggggaaaagcccgaaaataatctgtgagaggtttacccagcagggggacaaccgagacgcggctccctttttaatcaagagtgttgctcctcgccgagaaaacatttagtgggcgaaggtgcccaaccaagaaagagagtgtgggtgtctccctttcagatgtgggaagccatacctgggtgccgcctctatatacatgatattatctaatttccccaagaacagagcaaaagaagggggtacaacctatctcttagaggaggagaccgaggatgattagaaaaagcacagaaaagacggggggggggacacctcatgtgtgggggaccttcttgttgggggggtctataaacaaggaacgaagtccaccgacggggtgcaccctcgtaggtacttacaaccatatttttccgatatgctacaaatttatttgaccatcttccctatacgaagggagagaccgagtggggtgcacgaagggcgccgtcacctcgtttttaattagcattccacttacatactttatacgacgatcattcaaagcacacatggggggggggagcgcttaatcagttggagattatccattactattgatacccacccgggtgtgaaaccaaccgccctttattaccttctatatatgtcccaggcgggtgggagagtgggttgtattgcca

SEQ ID NO: 583788 - DNA, 852 bp, Homo sapiens
ggtcatctggaggagatttgctttctttgttctccaaaaggggaggaaattgaaactgagtggcccacgatggcaagaggggaaagcccagggtacaggaggcctctgggtgaaggcagaggctaacatggggttcggagcgaccttggccgtgtgtcctgaccatctttgtgctgtctgtcgtcagtatcatcatctgcttcacctgctcctgctggtgcctttacaagacgtgccgccgaccacgtccggttgtcaacaccactcaatccaccactgtggtgcatgccccttatcctcgagctccaagtgtgccgccagctaccctggatcaagctaccatgggctaccatagcatgccgtctcatgccagggatgccagcagaaccctacccaatgcagtaccaccacttacccagtccagccgcatgggcccaaacgggcgtacatgagacctggttgaggaagcatgcgggccctaccccggcagcagctccttaaacccgggctaaatggatgcccgtaggggcctctgagcattccctggccttctctggtgccactcggggtcatgtctgtggtgtgtccgtggacttggtgtgcacggcccgggttccttaagccccattgtgtgctgtgtgtgtccaggccggttccttacgcccatgtgtggctgtggtgggtctcgcctgaatgtggggcactctgttgcggaccgtggggcgccacctgccgaggggccgggccaaactgtgtctcccccggggattgtcccaatcacgcgaccccacaaggggggggggcctctcggggcccaagagggccccgcagggggtccatcctgggagacga

SEQ ID NO: 583789 - DNA, 1655 bp, Homo sapiens
  misc_feature (155)..(155): n is a, c, g, or t
  misc_feature (364)..(364): n is a, c, g, or t
  misc_feature (1171)..(1171): n is a, c, g, or t
ggaggtgtgcggatgcatgaagtaccgtctgcgtgattaagtgtaaagatgctgtccgatgcgcgattgatgcggtcgtggatcctgtgcccattccatcgggcggagcgctgaactggttcctccaggaaagtgcattagcgcttcatcacatnttgcatgtgcatgacgatggaagcatgtccaatgaccgtcgtaatgcaactcaatcatgtacaggaacgtacgtgaggaactgacgtggagatgattcgctctatgtcgtatggaaaggagtcggtaatgttctgtgggagacattgtaataacgcatacgtagttatcgagtactgtagaacagtacaacttgtgagagagtttcttnatagctattaggttagagtggtaattggccccggcgatatcgatggggacttgaaggagattgtgtgcacaggccatggagaagaaagattggggtgaagagtttatttgcgtattcagggtcttatatatagcgggattagtagttcacttgtgatacaccttgttggggaaatcacttggatcagatagttttgggttgatatagttaccgctagttaaccggggacaaattgagtacaatactatagtttaagagggatacgggagcgatagtatgcttgagactatgagacacagagaagtcgacattggataggaatccgtgacgcaagatttaggggagagtcgaaggctaggtgagggggtacagtggtaagggtcatgattgggcgcgctttggcgtcacattggccttagctttggactcgcggcaacactggtggttccacaacatgtgggagttcacgagaagaacctgaccgctatgagcccgacaaggatcggcggtcatcggaaaagtgtcctacctcgcgggtatatccaatatcgctgtcgcacacatttttacaagagtgccgggcgaacaccctagcactgcaaggaaccctggggacaatatcacaaggggcactcggtgcgacactaacggctcattgggcaggcgcccaagatacagggggtcccgttgggggccaccagcgcggaggaaacaccacggagctctcaactacgggctagaaccccgaaccacgcgaacctggtcgggcaaacacaaaaacgctccagacaacaagggcgacgatcnagcacgcgaccaaaccagcacgacatcacaccgccagacacagaacagcgatcaccacacacgtcgagaccgggaacacccttcagcacgtgcccacccccgcacactaacaggcctggtaaccgcgtccaattctacatggtcgcgccccaccgaggggtcaaacaaagacaacgatgaacccaaccaacgtggtggacccaacacgaccggggtcaccaacagcaccaccatcacagacagagccaagatgcgcccatagcgcaacgaacacccccacaaacagtggagagactgaggcactagcaccgctgacgtgacgagcccgccaccagcgaaaaacagagagagccacaaccacaacgcacgagcacgagaggaagcaagcaataagtcataagacacaacgaagaacgagacaaggtcaaaagacagttccgcgaacgcctcacgcagcgcgcgtacaccagccccgactaggttt

SEQ ID NO: 583790 - DNA, 245 bp, Homo sapiens
gcatcaccaatcacctcaacaccaacagcgagcaccaccaccgtcatcatccctcatctaccatcagctatcacctctagggccaacaccagcaccaccatcatcatcataaccatcaccaccaccatcaccatcactaccatcaccatcaccaccatcacctcaacaccaacagcagcaactagcagcatcatcatcaccaggatcaccatgccacactctagcctgttcggtatgagcggcga

SEQ ID NO: 583791 - DNA, 120 bp, Homo sapiens
actgcagccagctcatactgaaaagtgacactaggggtagcatgtagtagcaaaattcaaatgatttagtcacactggaaaactactattcttccccttgcttgtttttatttttttttt

SEQ ID NO: 583792 - DNA, 177 bp, Homo sapiens
  misc_feature (32)..(32): n is a, c, g, or t
  misc_feature (53)..(53): n is a, c, g, or t
  misc_feature (59)..(59): n is a, c, g, or t
  misc_feature (69)..(69): n is a, c, g, or t
  misc_feature (71)..(71): n is a, c, g, or t
  misc_feature (73)..(73): n is a, c, g, or t
  misc_feature (80)..(80): n is a, c, g, or t
  misc_feature (82)..(82): n is a, c, g, or t
  misc_feature (122)..(122): n is a, c, g, or t
  misc_feature (154)..(154): n is a, c, g, or t
  misc_feature (156)..(156): n is a, c, g, or t
  misc_feature (174)..(174): n is a, c, g, or t
gaagcctaaattccaggagggtgagcgagttntgttctttcatgggcctcttntttatnaagcaaagtntntnaaggttncnataaaggacaaaaaatttaaatattttatacattatattngttttaataaaaatttggattaatttgttttngngagctgttttttcaaatnttt

SEQ ID NO: 583793 - DNA, 1855 bp, Homo sapiens
accccgccagccccggctccgccgtgccccccataccaccccggtcggccacaagcgcagaggctcctcgaggcatcagtggttgttgacctcctgtactggagagacataaaagaagactaggacgtggtagtactaggtagccacagcctaataacctagctagctattacatacaagacaagtatacacaagcatacgtagacgccgtacacacgcctaacataagcctataggaccatagatactactagtagaccatacagagctataacggatataaccacagcgcgtgctgaatacccaactctaactccgacatacacaatcacgcatgcaacggacacacccacactaaccaggcgaccactaatactagggacaactcccctgcaccagctaggccttcatacactcctctgaccgcaacccacggcgctctccacgaaacagctaaaccaagaccaccaactaactcaggcaacacctaagcagactcccaacaagactagaaaacccccaacagtccaaccaatcactacaatacgcgagacaacctactccacgaagagccgtaccacaacaaatatcacatctgaacgctacgcgacaatcgacagctattcaaacacatcatagcacacaaatcacataccaggcacaaatgaatcaagtggaccaagccagcgacacgagactacgcatagcgccactaagatgtaacaaccgcaaacaatgagtaagacaacgagacaccacttgctacattcacaacaactagcgccaaaacatgcaacaccatccataacacgtggaccaacactcaatgaacaccaacgcacatacaaatatacgctcaacacattcccaacttaccaagtgcaggtataaccccctaggcactatacacattagtctaccttgcaacacacgagcacacactacaagcgcgaccaccacaaccgaacaatcgacaaaatcacaacagcaccatccaaaaatgcaacacccatctgcacacaaccacatctcaacagcaaacacgagcaatacacacgacacgcatacatacccaaaaaagacgcccatacaaacgacatacctcccacactacccgaacacacacaatcaccaataacacaaatatcaacacagcaccccacaccacaacaacatctataacacagtacaaaaacagaaacctaaacaacaacaaacaacctatctaaatatccatacaaaactcaactactatcaaaaactaccctgacgaaccaagatccaccatcatagcagactacaatctactacccaatatcgaacacaacacataaacacgcaactacacaaccagcaaccaactatacacctatatacaacaaaaaagactattactatcaaaaacactaaatcacatacacaaaacaaataatctatataactacccaacaacaaccaactaaattacacaaacaaaaaaactatactacagaaacaacacaacatatacatacaacagtaactaatataaaccacaagaccatatcaccataccacacccgagcacataacatgactaccatactaacacaaccactccctcacactaggaaccactaaccacagcaataactcacacacgaactaagcaacatctacacgaacgaccaccagacgaacacagcacaagacacaagcaacaacacgagccacacgcacataacaacccagatacgctaaacatacaactataagacacaccgacaacacaatgcaggccgaatcaaacgagcaccacatcactactcagacaccactaacgtctcaaatatacaaccgcactatcatataccgg

SEQ ID NO: 583794 - DNA, 293 bp, Homo sapiens
aaaggttatggtttctactatgttctcccagctcactgcaagaatccaagtggggaaagccagttgccgtgatacaaggacacacaagcaaccctactgagaggcccatgtggtgaggcactgaggcatcctgccaacagccctatgagtgagccctttaaaagcagatcccctgctgggcgtggtggcccatgcctgtaatcccaacactttgggaggccaaggcgggtggatcacctgaggtcaagagtttgagtccagcctggcctcgatggtaaaaacatgtctctccc

SEQ ID NO: 583795 - DNA, 696 bp, Homo sapiens
tcgacaccagcttcggcaacatagtgagactctgtctctttaaaaaaaatcaaaattagccaggcgtggtggccgatgtctgtaatcttagctacttgggaggctgaggtgggcagattgcttgatcccagaaagttgaggctgcagtgagccattgatcatgccactgcactccagcctgagaccctgtctctaactaacttattttagtactgtgtgttttaagtaatacagatatttgaattgagtgttgtgaagaacagaaaggtggagctaattctatgagaggtttagaaaagatgatgtttgggtggatcttaaaagaataatattgtgaatttttttcttggttggcaggttgattgggaggtcgaagggttagagtaggtgaaaaacataattcatgctaacacaagggattatgaaagagcattgttttcaggaagtaataagtatggcatagagtgcagttaggaatataaatctatagtgattaaaatagtgtgatatttagaccgaaaagtacgtggaaaagagtagaaagcctagaaatgtgcccatacacgcaaaatgtcctatatctaaaggcgcatatttccaaccatgagggaaaggtggctatgggtattccgaattgtgtccttttccactggggtgtttttccctctcgaccggcttttccttaattccattttc

SEQ ID NO: 583796 - DNA, 100 bp, Homo sapiens
ccatggtgggcaaggcacgaggggtcttgacttgcattggttttctcctagattgtttgaccttctcccttgcatcagcctgttccagggggatccccta

SEQ ID NO: 583797 - DNA, 187 bp, Homo sapiens
  misc_feature (1)..(1): n is a, c, g, or t
ntgggtcagtgtcttcgagctgaaggacaataacggggagtagctgtcaggccctgggagtgtctgagtgtaagtggagatgggtttgaggtcactgagggaagtatgggagccatccctctatagatacaagtcattgggaaatagtctcgtgaggcctgtgagtgtccagggtaaccctgggctg

SEQ ID NO: 583798 - DNA, 436 bp, Homo sapiens
aggcaaacaaaaggaatttggaaaaaagtgaagtgtggaatggaaagacaaagtatcagagacttgagagagtgaggcaggaggaatgattaagcacagaaaagtgaggataaagtgagccatgattgcaacaatatgctagagagtataggggacagagtaagacagtatgtctgtaaaacaaacaagaatgaagatagggatctgtataagtgttagaggcatttgtatgtccttgattgtagagtgtcaggtgtaaacgttaaaatcacaggtgtggatgtgattgatacatatcagctggatggaacaatgaagtattaagccatgtcaaaaaaaaaggaaatctcagtctgagactagctctctctctcactctctctctctctctctctctactctactactctctctactactactctctctactcgtg

SEQ ID NO: 583799 - DNA, 114 bp, Homo sapiens
  misc_feature (7)..(7): n is a, c, g, or t
cccacantctgggcccaattacacagacttcactttagaactacagcattttttttttttaagccccccgcaatgattcagattagggtaccagagctcgaatatctccgcata

SEQ ID NO: 583800 - DNA, 544 bp, Homo sapiens
gattcttgggcacgtaaagaagttggtccatagtttctaaccagtcttgttggcacacgtctatgtgatcactgttttggttgtttcctttgagatagagtcgtcgttctgtcaccttaggctcagtgcaatggcacgtctcggctacgcgcaacctcagcctcctggttcaagcgattctcctgtgtcagcctcctacagtagctgggattacaggtgcatgtcaccatgcatagctaatttgtgtatttttagcttagagatatcggttttcaccatgttgccagttggtgtcgagctcctgacctcaagtgatccaccacccatcccaagtcttgggattacaggcgggagccaccacgtctggccttatcacagttgtttaacaaaattgagagataaagaatatgccataaaatcgttcctttttgaagttcagtggtttatagtatattcacgaggttgtacaatccatcagcatcatctgattccagaacttcaccaatctcctacccaagggagggccttttcccccaacaaaaca

SEQ ID NO: 583801 - DNA, 405 bp, Homo sapiens
ttcccttttcccatggagtgccacggaaaggtcatactctgccgttttgtctcttaatgcatttgcctgggaagttgcatctccctggcatctgcattcaattaacactttagtgccataggtgtggaccatcaggaaatggcgtctccctgaccctaggtgccaatgtatgacttttagagaggcaatgtgataactgctgagccatcacccaacattcctggtgggtgggagaagagccctttcctgccctgctcatgctgtctaatggcctgtgacagcatgactttagtaggctttgggaaatcaagagttttgaagattattggtaaaataaagacatttggttgaaattaggtcagacattaggtttgctaaatgctttaaggtaataaactgcttcta

SEQ ID NO: 583802 - DNA, 128 bp, Homo sapiens
  misc_feature (12)..(12): n is a, c, g, or t
tctactgccacnttctatctaccaacatatgggaagtctcagcagagtggtaaggaggtaaaaacagaccagatgctgacatctgataggaagagaacaaaacagaaaaggatagaatgactgtcagg

SEQ ID NO: 583803 - DNA, 138 bp, Homo sapiens
agaatctatttacagatagtagttcatacttcaatgacagtgtctagcttgcattatgaagcctggttatgtatccacgtactaacataggtgagttagattggtatttctagtacagtgtcttaccctaaagattgt

SEQ ID NO: 583804 - DNA, 1004 bp, Homo sapiens
  misc_feature (73)..(73): n is a, c, g, or t
  misc_feature (91)..(91): n is a, c, g, or t
gtcgccaaggcccaggagaaccccggtgagtccgtccagttagaggcagcaggctaactaatccttcacctanttcgacttcgagtcgccntgccagcgcatgaccccaagatctctgagtcagggagagcatccagtgtatcagggaacattgtcggcgctcctgtgctatttctcgtgtattgtaactgtctcgcgtgtcttatccgagatccctaatgtaatacgacttgtgtgacaatctgtctgtgccttacgaagagtgtctgtgcagctttgttatcctttttaaaagcaacttttaaaagtggatggggaggggggctagcatacgtggtagggttctagaaatctgtggtcatcgctgaaatcctttttgcatcatgtttgttgatgttggagtgactggaagcgttcagtgccccagattccctaggatcaggcaacttgagccgtgctgtactaggatgcgtatccaacgatcgacttgtccttctccttgcgtgacttcgagttcgtgtgatctcctccggatgcgattcgctaattcccttgtggggaatcccttgtacatttccttggttgtgctctcggcacttgggatccgttgccgttccggagacatcgggttcagctcgtggtctcccttgtgcgtccgttggcctcttcttcctggggattgcgtcgtctggctacacgcacccggtgccgcacctggcgctcacctgcctggcccctgcctcgactccgcgccgcttggctcctactcgcctggttttcctccaaccactcaccggtcctctggctggggctctcgctcctatgacggctcccagtcgtcccaacccgttgcgccccacgccccgcacccctcagacgttttcgtccccgccatctggggcccccctggacgcgccgtttccggcggcttcccccgcgtcgtttccctcgtggttgcccacccgtggggccccctctacatcggtgacgccaccctctctctg

SEQ ID NO: 583805 - DNA, 331 bp, Homo sapiens
gtggtcgtctagaggatcccgagcgagatcacatcaccaagactaagctttttggttggttggttggtttggttttttgagatgaagtttcactctggtttgcccagaatggagtacagtggtgtaacctcagctcacgtgcagcctctgcctcccaggttcaagcgattttcctgactcagcctcccaagtagctgggactacagatgtgtgccaccacacctggctaattttgtatttttagtagagacggggttttaccacttgggccaggctggtcttgaactcctgacctcaggtgatccactcgccttggcctcccaaagggctg

SEQ ID NO: 583806 - DNA, 447 bp, Homo sapiens
gtgtcgttctacaggatcccccatcatctatacttgtactgtcactaatgttccacctgatggttgtgatgtgaagtttacagaattgggaagaacttcacagacttatgagggtgtttttataggaacaaagtgtatggaataggtgagaaaatagatatatcctaacctctgtctttttatcaccctctaaatcctatgattccagttctgttcattctgcagtgaaaaataattagttattcacactctgacactaggtggcttaggaatgctgcggctgttttatatagattaaacaatctagaaggtcaggattccatgagcgtattccttactaaaaaagagaagagactgggagttacacattagcttgccatggctgtcctgaattccaggagcccctctggataacagagaatgtgcaccttctgctgaccaaggcag

SEQ ID NO: 583807 - DNA, 254 bp, Homo sapiens
acggcaagaataaggcaacttaaggaaaaacgcaggaagaccctgggtaggcaggtcatgcaaaagctgccaatggtgtcctgatgggagcaagatgcgccatcttgctcccatcagaaagcaggaaagatctaaaatgaacaccctgatatcacaattaaaagaactagagaaaaagagcaaacaaattcaaaagccagcagaagacaagaaataactaagttcagagcagaactgatgggacgaagactggc

SEQ ID NO: 583808 - DNA, 133 bp, Homo sapiens
  misc_feature (17)..(17): n is a, c, g, or t
  misc_feature (36)..(36): n is a, c, g, or t
tgagtatctcccttggnccctcctccatcctctcanaccctgtgctccattcctcagccgtttggacagggagtccgctgtcaccaaggagcccatgtgagacacactgctatgactgcctcttgttaatgtc

SEQ ID NO: 583809 - DNA, 141 bp, Homo sapiens
atctctgcacatcactgggtctgtaactgaccccacactttcctaaatgtggaacttcctttatagtctgcacaggtccaccatagaccctcaccacagagtcccaccatgaccctacgtaagactcacttttcctggcag

SEQ ID NO: 583810 - DNA, 1125 bp, Homo sapiens
gctacaatctgtggcctcagcccttgccaactctgcctcttcccccgctgactggggtatcagtttatggtgccctgcaggaagaccctcttgttcctgtgggtgggaaggttctggaatctcagcttgccctctctggagcttggggagacactaggcttttggaggacaagctttgcagagctggttcatgcgagctgaggtggctgggagatttctgaggtgcggtgcggcgcaactggagcaaactcagaaccaccccttggacgttgactctcaacgcccggctccagaactggctatcgaagcctctgcagcagcatgtgggcacgctggtcagcgatggccatcccgggctcagcacagcaacgcagccccagactcagactgggcgaacgcaaacaggggctgccacaggccaggacaagcctgccggacacgtgatccctgagcacgtgcggcagctcgctcgcagagcggcgaaggcacacggcagcccgtcgcgcgccctggcagcctcacttgccctcagaggaacctactgcacgccgagcctcgcccggagcgccctgggcgtcctgccgtgaaccacaaaaggctacctcggagcggctcactacatggccaacgagactacctaccgcgcggagaccaagaggtgccggcaccacccacaccgaccccgcagcgccacacgcacacgaccgcgacagccacagaccacgcgactcatcgacacaagacggcgcaagtcaacagtcacagcccctactacaggcactaccccaacccaaacctagcacccgaaacaaagaagacccatcctgaacaccagatgagaagcacgaacacactacggcacggaccgggcactctcgcacaccaagatcaggaggagagcaaaatcaatccagaaacgcaccatcgggtcaacaccctacgaacctagagaaggcacacagagcgagataatcacaccagacagaccgaacaacgaataaaaaccagaagcaaatacagacctaaccaccaacagcgaaccgaccacacaaccatggggccaccaaccaagggtaacaaaccacaaaagcaggcgaccacgcgcatagggaaagatgaacaccg

SEQ ID NO: 583811 - DNA, 577 bp, Homo sapiens
  misc_feature (335)..(335): n is a, c, g, or t
cgtaatctagaggatcccgggggcgacggggtctcaagggtgtctgatggactattttaaggtacataaaaggctttcctcggtggtctacagcatctcataatctatccgggggaattcagctgcctcccaggttgaatacaggtaataatccaaatgggtgtatgtcatcttggtaaatgtccaagaaaacaggtggccggcggaacaaggtgttttgggcgccttccatctggttcctctggaaatggatgggggggggagggagatcgcaaccgggtactacagttctggtaggggtgtgccgtaaccctcatccatatatcgatcaggtnactggtcagatgattggaatggataagctgatgtgctggtgaggtacaaaagtcaatagcaggtaagagtccggagggcagtggtggttaatgaataagcttcattcaatcctaataccttaaaataagtaattggcttccctttccaggtatcccggaggacggtctggctctatctaacggtaagtggtaacccgaatgcaatgggcctataatctaatagataacttagccattgtgat

SEQ ID NO: 583812 - DNA, 445 bp, Homo sapiens
  misc_feature (400)..(400): n is a, c, g, or t
aggcgcctgtataatcccagctgctcaggaggctgaggcagggagaatcgcttgaacccttggaggtggaggttgcagtgagccaagattgtgccattgcactccagcctgggtaacagagcaagactgtgccattgcactccagcctgggtaacagagcaagactctctcaaaaaaaaaaaaaaaaaaaaaaaaaaccatgatttgtagatgtgtgcaagacacagtactgctatggctaataatggtaagatgaccctaataatgtcctctccttgaatttttatataataatattttctgagtcataactaattttttaaataatgatttccaatctaattattaattagaattttgttgttgttgtttgagacagagtcactctgtcacccaagantcgtgccactgcactccagcctaggtgacagagtgaatccgtctc

SEQ ID NO: 583813 - DNA, 343 bp, Homo sapiens
aaaccattcacgtgtatggaatgtggcaaagccttaagtttcccacgtgtgttaaccttcacatgcggatccacactggagaaaaaccctacaaatgtaaacagtgtgggaaatccttcagttactccaattcgtttcagttacatgaacgtactcacactggagagaaccctattgatgttagggggttccggaaagcctgcagtcgtccagttccttcggaatcagtaagaggtcagtcggattatatgctgtcagcataggtaatgtggtaaacctaaggtgtcctcgtctctcctaggacatgtaacccactgggtggtacccattgtatagtatacag

SEQ ID NO: 583814 - DNA, 118 bp, Homo sapiens
  misc_feature (67)..(67): n is a, c, g, or t
aagcaatactaagctgaaagaacacgatgggacttcaaactacgagtgtacggctagagtcaccaancctagcatgctattcatacagaaaacagacacactagaccatattagaact

SEQ ID NO: 583815 - DNA, 418 bp, Homo sapiens
tttgtagaacgcatgcgtctccagcctgtgtgactctaggactgggtttgtgggtcgaacgcaatgcccagaaaattagatctgaaccggaactttccagacctggatacggatagtgtccgtgaatcataaagaaggtggtccaaattatcatctgttgaataatattaaggaaaattgtggatcaaaacatcataagcttgctcctgagacccaggctgtcattcattggacttatggatattccttttgtgctttctgccactcttcatggaggagaccttgtggccgattatccatatgatgagacgcgtagtggtagtgctcacgattactgctcctccccagatgacgcctttttccaaagcttggcccgggcatactcttctttcaacccggccctgtctgacccccatcg

SEQ ID NO: 583816 - DNA, 205 bp, Homo sapiens
  misc_feature (58)..(58): n is a, c, g, or t
gggggggggggtttccgccccccaagttcccccggcgggttttttaacgtttcccccncccccagattaaggtttccccttcccccccggggttttgggcggtgggcccaaaccccgttttcccccccgggggcccccccccttttttttgggggggggccccttcccgggggggcccccctttttttcgggggcccccccggga

SEQ ID NO: 583817 - DNA, 952 bp, Homo sapiens
ccaaaggcaacattcggcctgctttaggtacctggtgtcctttaccataaccttcgcattatgatacagtaccttgctagcgtggcttagtaattggaactctacagtatgcacgagtactatctacatatattgtgtatctgctctgaatccctttacgcatggttgatgtctacattgagtcgtgccgagtggcgtctgcaaactggcacgtaggaacacgggactaaatggcaagagcagcctagcaataggccgctagtagtaaaaagacacccaccgaacataatgatagacaagttcgccgcagtatgaagtccgatgagatcaacgatgagccaagtcatacttcagaagcatgtgtgctggaatgtctaaaatccatggtagcatttctgacatggacgggcacagtagggtaaaccgaaagattcgacgcgttgataaggtgaactagatgtgctgggtatgaaagcgacacggggtttccgtcttcgcgaattccataaccaggaatggttggaattggaacccgcccaggcacggacgcacaaggtgtggaccacccataatccttttaaaccaagggctctacaaaacacgggggtaaaaagtttggttcctttggaacgcctttcgaaactaaaccaattaattttaagggcccaccatttcgacttttctccctctaccaagggctttccctccacctttggaaacacccatgggtttaaacttcggtttgggggacaaaggactttactggctttaaaaagggcgaactccaatattttttatccccataagccaaaaagggggttcccacatatacaaagtgtggacctctcaattttgtggtggccgcaaccaccttattttcctcattaaagccccgtgataaccattgaaggctttaatggtagcacaattctctaaagatgggctatgccca

SEQ ID NO: 583818 - DNA, 1505 bp, Homo sapiens
gagcctgtgcgccgctcagatgtgaggtggtttcgtgcgggtgagtgctggctgcccgtaccatgagctgaagtgcggatcggagcatgcagacatgcgccggtccctggcgtgactgcaggatctgtcacacgacgactgatggccaaggaccccaggaaggctaaaggacgagcagactccgtttacgctggcaagagatttatcctgcagctgcaccttcgttgactgcgtggactgttgtcgtctcacctgattcgcccgtgtcttgagcagccagtgagtgcgtgcgtggcaactcgtcgctactacgagtccaccagccatcctcacgcattcgaaaggaacgcgcccgcactcttttgcattgggctcgttcctgcactccagaattacagacagcgtgctgacacgtgcacgaccacggcctgtcctgacacaactcaaccttgctcgcgacccgtgacgtcccatagacacactacttgcgggcatgtgactcgttcacatgtggaccaggccatcagtggcctgaggatcgataccacagcttgcacaaactgcgtcgcgaagtaccacggcacccaattgacaccggaactcatggaattccgaggacccttctgccaacacacccggacgcatgacatgcagcctcgctgctgagctgcgaggagcaccccccctgctagtataacttcccagttcaaccaacaggaccccaacagcagagaaaccttcatcactcaatgctgcagacccgcaactgccactaaccaacggggacacctacaattcgcgacacgctcccatataccactttgggaaacttcgctagcacgctcgcaacaccatgacttgcacatgataaccatcccacgcactaaacaccccccaaatatgcaaggcgcgcaccgtaacaccacatgtgcttcccttttagcgttagacacattgacctccatctaacagtgcaccccacttcaaggcgacatttgatataagggaaccaactcctaacccctccgactccggcacttccttaactcaggacaacatcgagccaaacccacccacgactgctctccatgtcgcactccatgacactaaccatctacacacacccacaacaactatatacatcacatcaatacagtaaactacactacaccctactcccacgcaccaacaccacaaccaacactacaattaggacaaccacaatacatatcaacccaacacttacaggaaacatactacgcatacgttgcaccaaaccccactcccctccaaaatataactaccatcaactactcgcccagacacataccaatctacacttatcgtacactattcaaaactaagcagaaacttaattaaataaaaacatacatacaccatcacaacacaaccagcactacacactaacaacatacaatgaacttaccacaccccaccactaatatgagcagtaagaacacatcaacaccatgcaccaaccacgg

SEQ ID NO: 583819 - DNA, 101 bp, Homo sapiens
tatctagaaatattgctcagccttgtgctgtgcacaacctggttctctttccagtgttatttatgtagctagagtgaccatcgttgggggatctcttagtc

SEQ ID NO: 583820 - DNA, 504 bp, Homo sapiens
  misc_feature (492)..(492): n is a, c, g, or t
gaatgcctctttctattccggttttcttgtcaaacacattggcttggcttgtttgtaaaaatgtacagttccgcccggccctatacccgggaatatttgtctggtcctctagttgcttcgtgcacctcccttcgaccccctcaactcgtccatcttggcgactcgcttcttgaactcgacgtactggcatttctcgtagctatgtcgctcatcctattcaatccctctagcgtaagcatggtgttttattgatattggcatcgatatctcggtaatgatcggctttttgttgggctgaagcttggctgggctgagctcggtgtagccgcggacttgggcttccttgggctcaagctctggaaaaaggtaattgacttaccgagcacttccaaggggcgtaccaagtatccttcggcacttgttgagaggaatcaagaggtgagcgcagctgtctcggtaggccagagggagtttggcatcgcgcatgctccntcgcgggtcgct

SEQ ID NO: 583821 - DNA, 226 bp, Homo sapiens
tgaatgggcggactgccccacctccttgttcgagtgagcactcatttgcctgacaggtgatcttgtgggagagactgttgccaggcaaccctggagtctggctcagtgcacaaatctgtccaggacagattggcgggccccctgtgggcttgtgcgttcgcctcctttatgatgcttgctgctgaagtgctctgccgtgacgtgctcccttggcccgtggggattg

SEQ ID NO: 583822 - DNA, 789 bp, Homo sapiens
  misc_feature (682)..(682): n is a, c, g, or t
  misc_feature (757)..(757): n is a, c, g, or t
  misc_feature (787)..(787): n is a, c, g, or t
gagttggtggaaccggtggctggattcatgttcccttaactgacaatcataagaagccaactcgtacactcatgatacagattgctgttctagccaatcaccagaatggaagagacacccatatgagacaaattaaaatatacacaccatgtagaaagagagctccatctggtaaatgttcctgagatgtacaacgtatacgatcttcatggatgtagtcgttcaactaacggtgacttttacaaatgagacggaaaatcatgtaaactgtatcctttagttttatcgctgtatcttaaataactatatcagtgtaccctttacttgaacataggcatcctgttatagtctaatatttagtatatgtcttaaaaatacttttattgcaactcttgacatataaattctggggtcatgttatctttattatctttaacctgcaacaaagctcacatattttacattactacaaatggaaaaaaaaaagacgaagtggcctcattgggctcagaggcggagctctgtcgacagtttttcttttgtgagggttatgtattgatcgtttcatcctgaatggattcattccgatgttggaatggttgggtcgtgatggtatcggtgcgtggggcgatacgcttaagatagatctaagataaacgcagaagtgaacagaacgaagatntgacgacccaccgactatatccacccggaatcagcatgtaccttttactaagacaacggccccaccatcagcttnttcaagcggcaagtgggacgacacaacgantg

SEQ ID NO: 583823 - DNA, 1922 bp, Homo sapiens
  misc_feature (330)..(330): n is a, c, g, or t
  misc_feature (579)..(579): n is a, c, g, or t
ccctgccacagatagttacccagactgccttgtgtcttgaccatgtatcggtaagcacgctcgcatgtgtggagtgcttatcgtgtcccttgtatcggctctgatacgagtctagagtaatccgcgtccctctcaacaccaaggtagtccgtctttctgagttacaatgtagagggcgattctacaatcgatgcgctggagagcacccttgcgagcgagacattactagatgggagacctcgtaacttggactagaaatcgtgtccgaatggcacgaagctcgttcgtgccagatgtagacagggggtgttcctggcgacctgacatganctgtcaagtactgactttgagtgactctacgcttgtcttacactctctacagaggacatgacttgctgaacaatcgtatctacctcatgcgataggagcggacctaatctcacggtgtgtagtctcgttagtacagtaaggtctggtggcttgcttctttgttgcataggaagacagaaaaattccatacgcacattccacaaagaggcattatcacgcatcaagccatcccttgaatccagtgcaatnctgacaaagtgggttatctttgccgcgaggcattagtgattgccaagttgtctctctcgaggctgaaccgataagaaggggaattgagccagtggtgactccacttcccactttgtgcaatggcgctttgttagctaccattgactattcccttccttagcacaactccgggtatatgaccccctggcttgaaattctccgggaaaagcgaacacaacgggggctcaggccactggtgattgtaacctgaaggacccaattttggcattacaagcccattaagccacgcgattagaacgagattcctggtctagagaggcctgctcggagacatttgtttggccgtggggaacctgaaatggggttgggggtttggacccttgtggtgtggccattcccacagggctggagccgaccatcggcggcgataggacgaacccaagcacggagaaaaagctctattggcgcaccaagtagccggctctggaacagaagcgacatgcaagagatgtgccaacactccccgagcccttggtgggttctgaacacccattatacacttgaggaggccgggtttaacccccccaaggtggccccccccaaaaggatatgtaagaaagcgcaccactaataacacatttgcgaggtaaggacccattatggggataggacaacagccgcaacgatcgacactgggtgagaggcaagccacacataataacacatatacacaccacgccatgtaggaccaaggagatgcacacagcacagacgcgagacatggtgagcaccccccacagccacagcgaagacgcgcacgaagtgacgaacaacaacagccgccgctcaactgccacaacgaaggagggtgacacccaacaacacgtgtcctgcgaaaacgaggccaacagctaggtcgaccacctatgtacatcgcctgctgaccacaatacgccgaaagccagaagatcgtcgctctactcgaacggtcacacacagatgcatcaactacagaaaagacgagatcaacccacacccaacacaatcataataatccatcaaatagtactacttaaaaaacaatcttcacaccgaaaccaaaccaaagcacaccctaaacagaccaacagcaaacacaatacatacatactacgaggagaacacgaccaaaacaataaaaacagacacaataataatacacactccatccacacaacacactaccaccaaccactaaaaaccaaatcaaataaatataacaatcatcacttcaaatacaactaccaaccataatgcacataaaccatagataagagacaatactataataaactacacatact

SEQ ID NO: 583824 - DNA, 812 bp, Homo sapiens
cagtgagccgagatgcaccatgcactccagcctgggcaacaagagcgaaacctcatctcaaaaaaaaaaaaaaaaatttctaaaaggcccctatgctttggttggtttagccacggtttttttaaggtcgggaattccaaaatggcacagtaagaggggttttaatcttagattatacaagaagaaaagatgacccaattttcatagctatagggcctcaatacacgggttttggccaaaagaggtgaagcagtcacatttaggctttttctaccacccaacccttaaagatcttagtggcagatttaagctggttttaaacgtgtaatcataattttacaacattttatatggtctacattttccggggttataacccttccagaatggactacgggccattagtaatacagggtatctttttttaataagtttctccaaatttatggggatttaatcgggcagaattcacctggtggaaattgggatgggctaccttggtttataaacactggggctaccttggtttgtaaacctcgtgccggtttaaaattgggatccccggggaattgcgctctaatccgtgggcgggccaggttaaaataaaggtatccagggctttactaaaccggtcagaaaacaaacacaacaaagaccgacaccacacaatgaacgacatatgaagcacaacacaaaaaaaaaattggtgggcgggccggcccagagagatataaaacaccgtgggggcccgcccaaaaatagaaacggccagggacaaaagcccgtgaaggggggtcccaaaaacgggggcg

SEQ ID NO: 583825 - DNA, 628 bp, Homo sapiens
ggcaggcaaacctgaggtcctcagacatggcgggcacaggcataggtaggctgtgagaggtagtggtggatgcagcatgccgttattttggatcaagggttatgaagccccatggtgtgcagggaagcaggattgcagtcgcatggatggaggagtgaaacatcgcagataccgacctactaagaactacctgagctacctgacagcacccaggattatactagcctttgaaactgacgtaactgagcaacatgaattcgaaagacactgtgctgtctcgacaaagcaacttgacatctgctcagtatgaaacgactactgagcttccagaccccctcctactggtcaacaatcacctgacattactcgcactggccccagcaatgtgtaaacaattctatggcccagttagagcactcacgacagaccagaattgcagaatctggaactaatgtacacagcatggatgtaaatgcctggacaagtatagcacatgcaccacatctagtagcatatgattgcaacacggcacagaaaggaacttacagacgttaagaaacacctattgcagcatataaactggacaagaaaagacacgtgcaactcacagaatggatctacattgaga

SEQ ID NO: 583826 - DNA, 128 bp, Homo sapiens
tctataggcgttgcagaggtccctgtggcaaggtacctctccacgtagacactcctcatggtgaaacggcgaaacgtctccttcggtgtggtcttaatcgagccatgttcagtctagctatcttgcct

SEQ ID NO: 583827 - DNA, 621 bp, Homo sapiens
ctaatagaggggggccagaaatccccactctagaatgcttgtagaatgttgggagacacccaggatgtgatgccaagtggacttttcttgtgaaggttgttttgtatcattggccccagccctgaatcccaggtgcaggtccccaagacttgttcttgcaaccatggtcctggaacatggagcgggacaggcgaggaggccttttgcccacccacatcgcaccggattcagcgctgcaacaggcgcccgaacgcaaaaggtgcaaccgcaacggcaacggccctgaggaggcagatccacaaattcccccgcccccgattaaccacggccgggctccacctgccgcgcaacttccggcaggcgcgcgcacacacaaccccccttcccgaccccacacggcaaaaccccgcctataaggccaaacagtttcgagggggtttccccaaagcacgcgccaccccgcgagcgggccagcccagtttacacgagaggccaccaggttccgacttcccgccgtgagcagcccccaccccacccagggggcgacacctcggggcccccccttcccagcacagggaaacacgcgagggaggcgcttccacacaccccggcttttccccg

SEQ ID NO: 583828 - DNA, 956 bp, Homo sapiens
agcggctgcggttgtgcagcgtgctgtggatgtgatgaagctggtgggtggagcctggaggaggaaggctggctggcgacgacgacgaggaagacgccgaggcctggtgccatggaacttggctgtgactgtgtggtgtgcgtgcagccagctcgcagggtgctgcctggagccatgaggagccatgtggacatccattgggtgtcacatgagaagtgtgtgggtgcagtgcggacgctcgggggcgtgctggccactggggcgcagacgtccccgaacccaatcgggtcctctaagaagagtggctgcctccacttctgcctttgtgttacggctggcgtggtaccctcgtagcaggacattggccttcaacccaaggcaggagaggtacggtgttggagagccgcggtccaacaacgtaagagaattaacgtgtctgaaggggtttactctttgcagacccgttccctttttatacactacttgattgaagagtgcggacgaaaggattgagagtgaccgaggagaaaaatttcgcagtaccagcgccgcaagaccaccggtacgcgaacagaaacctggtcgagaaggggacttacataggagtcgcatataaaaacatttatgggaacgacaccggtgcagaaagggaacgcctgttggatcagcgctacacatgtttgggggcgcaggagaaggggaggggcagacaccgcaggggcaatccgtcgaaggtcagcatgggagagaggggcaaagggggggaagagagacatcaaggacgacgaaggacagggaggggaaaggaacacaagggatacccggacatgaggggacggaccggttcatcgcgggatggaccacacacagacacccagagatcgagggggacataaaacggcggaggagaaggcgcggcagacacgtccagagggaacatgggaagtaggtagaaa

SEQ ID NO: 583829 - DNA, 180 bp, Homo sapiens
aataagagatagatatccagaatgtgtaaggaacttctacaggttcaagcactaagcaatgagcaatccccattaaaaaaggggcaaactgtaaactctgtacccactcataataacaaggtcacacattctatggattgtcgcgggatcctcttagcaggtcgaccagtcaggcgatgc

SEQ ID NO: 583830 - DNA, 384 bp, Homo sapiens
  misc_feature (9)..(9): n is a, c, g, or t
tcatatcantggtcgtggttgtagtccgtgcgagaataccgaaaaaaaaaaaaaaaaaaaaaaaaaaaaaattgggggcgcgccggcccggaaaaagctttcaagacaaccacatgcgcgggggggcgcgcgggggccccgagggggacaagggcaaacgggggcacaaggggggtcccaaaggagaaaccgggggccgaggaaaagaggggcggggaatttctccccaatatataaaaaagcgcccggggggaaacggcggagggtcttgggagaaaaatcccagaaggggaggtattagggggcgcattaaggggggctattttcacaaggggggcccaaggcggaccccgaatttcaaattacagccccggccggggggac

SEQ ID NO: 583831 - DNA, 136 bp, Homo sapiens
ttcgggtcttgggctccccagtgttgggattacaggtgtagccactgcgcctgggctagttttttttttcccccccttgtaggtgagtcttgatgtcgagccttggctgcagtgctgtggcgcaagctcggttcac

SEQ ID NO: 583832 - DNA, 149 bp, Homo sapiens
cgaacggagattaaatagcttcctatttaatcttagtggcgcacgggtgagtaatatatagttaatctgccccatagtggaggacaacagttagaaatgactgctaatactccatactccttcttatcataagttaagtcgggaaagtt

SEQ ID NO: 583833 - DNA, 277 bp, Homo sapiens
gtcgacctttccaattggaattatggaagagtgggggtgagaaaacgggggtcagtgtgatgattgttctctctttgtgtgtgtgtatgtgtgatgtgtgtattgtgtggtatgtgtggtgtgtgtgtatgtgtgtgtatgtattttgggggagaaagtaaggggatcttaatttggaattttgaaagtatcaggtgttgaacaaagactattctcactgtatttcagaagcaaagtggaaatgaataggtaaagcatacagttctggagtcgacgc

SEQ ID NO: 583834 - DNA, 178 bp, Homo sapiens
gatgcgaagtctagagcttacgatgtcacttgggagaattgagagttaaattgagaaatggagagaagaaactcaagaattagtgagcacattttggaggtgggagaggatttatttattgaatatgcttctaagtcgggagagatatttggtagcatattagaacaggtagttggca

SEQ ID NO: 583835 - DNA, 232 bp, Homo sapiens
  misc_feature (213)..(213): n is a, c, g, or t
  misc_feature (228)..(228): n is a, c, g, or t
tctagttgtccattcctgctctacgccatgttgttatttaaaaattatggtaaactctactttacatagaatttatcattttaatcctttttgagtgtacaattcagtggcattaagtacactgacgttgttgtgcaaccatcactactattcatctccagaaagttttcatgatcccaaaatgaaatgctgcacatattaaacagtaacgtnccattactccctggnaatt

SEQ ID NO: 583836 - DNA, 570 bp, Homo sapiens
gaaaggaagatccgaaaactggaaaaggctactcaagagctaattcctattgaagattttattacccctctaaagttctgggataaagcaagagagcggtctcaggtggacgctgcatccttctgaggagactgacgaggagagctctgctgtctgacaggaagtggtcctgtgtacaaggcatgcaacgacgcgtaacgatggagagggacatccatctaggggctatgctagaaggccagcaggaagctctggaggaactggaactggaatccccgaagctccatgctgaggccagtcaagcgggatcctaactctgttcccctttgagaaggaaggggcacattacacaccaccgatccctaaggtaccaacctcgcctgtaaggcaggtacaatgtacatcaccaaggtgtacacacaagtggagtttaagagatagagttgcaggctgctatccttaacatgctggccctgagacgtaggaatgaccagggttcaagtctgctttccacagaatcaggcatgctgttaataaatactggtttaatcgaatagactgagggaaaac

SEQ ID NO: 583837 - DNA, 138 bp, Homo sapiens
aaacatctgcatgccaaactcggcggaatgtgattaactactactagggacaagagcaagggatgagatgaggattagaggtgaggttgtagaaaactgcttcttgaaagtcattttaagagcctggtctgaaacaaa

SEQ ID NO: 583838 - DNA, 601 bp, Homo sapiens
  misc_feature (16)..(16): n is a, c, g, or t
  misc_feature (84)..(84): n is a, c, g, or t
  misc_feature (145)..(145): n is a, c, g, or t
  misc_feature (157)..(157): n is a, c, g, or t
  misc_feature (168)..(168): n is a, c, g, or t
  misc_feature (186)..(186): n is a, c, g, or t
  misc_feature (207)..(207): n is a, c, g, or t
  misc_feature (210)..(210): n is a, c, g, or t
  misc_feature (212)..(212): n is a, c, g, or t
  misc_feature (217)..(217): n is a, c, g, or t
  misc_feature (225)..(225): n is a, c, g, or t
  misc_feature (234)..(234): n is a, c, g, or t
  misc_feature (254)..(254): n is a, c, g, or t
  misc_feature (268)..(268): n is a, c, g, or t
  misc_feature (282)..(282): n is a, c, g, or t
  misc_feature (331)..(331): n is a, c, g, or t
  misc_feature (342)..(342): n is a, c, g, or t
  misc_feature (386)..(386): n is a, c, g, or t
  misc_feature (390)..(390): n is a, c, g, or t
  misc_feature (441)..(441): n is a, c, g, or t
  misc_feature (472)..(472): n is a, c, g, or t
  misc_feature (527)..(527): n is a, c, g, or t
  misc_feature (535)..(535): n is a, c, g, or t
  misc_feature (538)..(538): n is a, c, g, or t
  misc_feature (574)..(574): n is a, c, g, or t
ctggtggttgccaccnccaaaaggatgccccacaggattaaaggccacaccccgtactcgtggccagcggtccctctttgcctnaaatttgtggaacgcccggccagccttcaagaagggtttgtcaatccggccaccaccagcnaccacaccaacnacagccctgtnggctgaggagaaaacctnctaggagcaggagggcagcancanangggtntactaggnctaagggtngtgggaaaaaacggtggcanaataccctgaagcncgggccaacatgcnaaggtctccaggcttctccaccaggaagcacaagaatatacccacaggnatggagcccanagggagcacaaagccaatatagaacagggcctactagccgcaanaaanaaacaggcccgtataaatacacaggcggcaataaacaacaccgtacgcttntaaaaccgaaaaggataccggaagaacaccnaggcgaggagcgccagcggcccgggtcgtggattatgttcttcacgatgcccttnatgtagcngtnccgctcagcgaaatccacggcgcgcagcccccgctntttacggtgctttacgtgcgctcggta

SEQ ID NO: 583839 - DNA, 382 bp, Homo sapiens
tctgaggatcctcatacgggttcgagtcgcaacacgacaactttcccttttgtctggtgggactctttcagactgatgtcacctattagccgtggaaccaaggtttttccacaaactgtaggagcacatattattgtggtttcctttcatagccaggcaaggcagctctaattggtaatttcttggtttaaatgggctgtaccagtttgtatcagacacttctggaataccaaagggagcaaattaccaaaaagttcctggtctgaggaatcacggcaatagctacagtctaatgtccacaaattctgactccaggcaagcacgatcctcattggcagaaagtttagaatcctttctcatggtaaccaattctagccttttc

SEQ ID NO: 583840 - DNA, 639 bp, Homo sapiens
  misc_feature (318)..(318): n is a, c, g, or t
tggaggtgtgttatctcgactgcagatgagatttaaaaattctatgttagtcatatactgctctctcgtgactggtgctcaggaaactagattcctctctctcctgccaaagcagaatacgcgagggcacatgaggctgtcccttcccagaaattatatctagaggctgccacatctgtcaggagctcccagacgcagcatcgacaaatgtaactcctccgctcaatggtcaccgcgagtagaaggtgacacatgccagagctgtctttgctaactgcagggatgtaaaaataccctcctagcattgtggtctgatanccatttgtggtcatagcccagtacagaagtagatcgacctggagacaccacccacaccggtttcttcgtacaatgtgatcaaaaatagcctgtaagcgcatctccatggcttgcccccaatgcatgttaaggttctcaaagggaccagcccggatctggtgctcaagatatgtcagttaatgtttccaagtccatgtgtgctcctagagttcacatacccaattcttgcaaaatatgtttcaatgtccatgatccctttggccagcacccaggatctaggctgaatgcaatcctctcgctgccaaggtgtgtaataaagtg

SEQ ID NO: 583841 - DNA, 145 bp, Homo sapiens
caaaactaacggagcatcatggctgcatgcctgtaatcccagctactcgagaggctcgaggcaggagaactgctttgacccgagaggtcatagttgcagtgaggtgagatgcgccctaacccaggccggcataagcaactcccgt

SEQ ID NO: 583842 - DNA, 673 bp, Homo sapiens
  misc_feature (193)..(193): n is a, c, g, or t
  misc_feature (197)..(197): n is a, c, g, or t
  misc_feature (271)..(271): n is a, c, g, or t
  misc_feature (273)..(273): n is a, c, g, or t
  misc_feature (311)..(311): n is a, c, g, or t
  misc_feature (433)..(433): n is a, c, g, or t
  misc_feature (456)..(456): n is a, c, g, or t
  misc_feature (462)..(462): n is a, c, g, or t
aatttatacccgggaggagagtacgccgagagtctagatagtctctcgttacggtgcttaggatccatttccatcgtatcctttcatccggtcgttgaactccagtcctcaggcatggtgatgcagcatccataagtccaagaactgcatttgcgagcgcaagccatggcgaacgcttgcctaaggtgaatgnaacntatgatcgttaagatctgactatctctagaccgacgctgagtgtgtgtgtgtgccttgtcaatcattgaattcnantgaccttatatcatctctccattactcacatcctctangacataggtattacccatagagctgaagtattctcccctttagaatagataccgagtgtcgcgcacttggaacttagttgcgagggtaattgctctcgcgcttactagaagctgattgaatnagatcatatacttgcacttgctnctaaancattctcccctacgttcttcctttacatcacatgggggtaacgacaaatacgtggtcgtgagttaggataagtgtatgcgctcggggaaggccccagagtaaaacgggagatataggcatctggataacgtccacccctactctcatattgcgacctttgagcacattaattcaatcgtctctctctgtgaagaaccatcactgatcacca

SEQ ID NO: 583843 - DNA, 117 bp, Homo sapiens
tctgcggacttactggatagaacgtactgggattatgaacgtcctgatgaggaacgtcactgggatgaggaacgtcactgggacgttcctcatcccagtaacgtacctcatcccagg

SEQ ID NO: 583844 - DNA, 1006 bp, Homo sapiens
tggggattcacaaaattagagcctcttttgggtttaaaaaaaaaaaaaaaaaaaaaaaagggaaaaaccccaagggaaaaaattttcaaaacggggacccgcggggtcccccagagacccccccggcgggggagagggggcaaggccctttgggcgagaggaggtgcggggggcggcccaaaaagagatggacgccctctctcaggcggcgccggggaattgggggggaggagggcgccgagggcaaggaccacatattcggggcggctctcggcggcgccaacgagctcctctctggcgcgtgccggcagaaggggcatgcgctgaaagaaggggggcaggagcaaatatgaggagacaaactcagaaagcgcgcgaacgagcatcagcagcccacggcgtgtgcggtggtggtcgcccccgggagacaacgccgcgcatctaacgagagagggcggggccgccaccagcgcgaggggggcggcgccgacgggctctgaggagaccgccctgggaggagagggcagcgagcccctgtggggggaggagaaggcgccagtggatccacacgccctgcggggacttgggaggacttctccgggaagcagggccggcggacagctggtcccccaaggacaacactcctcggggaagaaaacagcacgcctggagccagtgggcaacgggcggctgggggacgaaaaagattccccccctcttgagggggaccaggcgaaaagtagtaaaagcgccacagtcacggagccaccgggggaacgacaattcggggtctcccgagggggggcggtccaccacgagagagaccttcggggaaggggcgtccgcggcacctcgccaagggagtagacgccatggtgggcacgggcaccggaaggggcgccagagggggggcggacggaaaaagatggtaagccacgaaataagcgagagatgaactgcagcccaccaggggtgcgggccccaacaggagggaacaccagggggc

SEQ ID NO: 583845 - DNA, 278 bp, Homo sapiens
tcaatttctacactcatgggagggagggataatttcttaaagaactcccagattgatgtacatgtgtactttgttctttctatagagctatatttggcaaactttttctgtaaagggccagatagtaagtgtcttatgcttggtgaggcatatagtgtttgtggcaactgctgaagtctgcaaaaaagaagccttagataactggaaaatgaatggatgtggcggtgtttcaacaaaactttatttacaaaaataggaggtggggtgtagaaattgaa

SEQ ID NO: 583846 - DNA, 603 bp, Homo sapiens
  misc_feature (38)..(38): n is a, c, g, or t
ggagaaaaaaaaaaagttcccctttgcccttggaaggntgctgaaaagtcaagtcacaaaaggcatagaaataggagaaaaggcatacaaataaatgtatttgaccatagtttcatgtgacacaggagccttcagaatgaacctaatccctcagtggggtgcaaaagcctatataccatcttgaggttacagaaagaatttaggctcagagtgcagcccaaaacaggttatggtagtaaatcaggttatggtggcaagacaggtcctgggagagaaagaagaggagacctggccagcaaaggtggtcttgttatgtagatgaaacttcacaggtagcaatcttcagagagaatagacggtcaatgcttcttttcaggcctttacaggtatcagactcttagtctttcctagattcaggcaagggaagttccggctgcatcaatgcagattctctgcagatgcaaatctccccacaaaagacagctttgcagggccacttctgtttgctggccctctgacacccagctcaaaatatgtcaaagaaatatatttggagataaaatatttttatttcctccagttcctactttgaaaaaaaaaaaa

SEQ ID NO: 583847 - DNA, 120 bp, Homo sapiens
tccctctcatacaaaaaagaactgtaaacaataaaactctaaaggaatatggagagaaactacagcatattagcagaggataggtcgctctaccgaggagtaccgcagtggagtccgttg

SEQ ID NO: 583848 - DNA, 150 bp, Homo sapiens
caataaatcagcacacggtttaccaaacttttgttacacactcacatactcaaggataaactccctcgttccatttcgagaacaaagacttcttcctcttcctttcttaggacaactgatataggtcccgaataacctagacttctctcc

SEQ ID NO: 583849 - DNA, 125 bp, Homo sapiens
  misc_feature (1)..(1): n is a, c, g, or t
ngacggacgcatcaggagatacagggcaggtttctgtggttctggagaaggaacaggcgcaagtttctgagactcacaaacagggactgatttgggaggttcaggagaagaaacagaggcaggtt

SEQ ID NO: 583850 - DNA, 287 bp, Homo sapiens
ccttggagaggcgggttaggaagagtggagacttcttcacggactctgaaccatgaacatatttgatcgaaagatcaactttgatgcgcttttaaaattttctcatataaccccgtcaacgcagcagcacctcaaggaggtgttattcaagttttgccccttgtatattttttggcggctgcaggggctatatccacatagtcactcatatcatacagagctggctcctgtcttccctctggctcccccatatatatgatatcgctcatggcacacatcatagcgac

SEQ ID NO: 583851 - DNA, 225 bp, Homo sapiens
ctagaggaccccggtcatttgtctacacagatatttgtcacgaagacctagtttagatcgtcccatctacttatgaatagcgaacagtatacccgcgattccgctacgagcaagtcatacacctcctatgaaaaaacttcgctaactagtcaccctagcattacttatatgatatgtctccatacccattacaatctccggatcccagcctgtgtagagatggaa

SEQ ID NO: 583852 - DNA, 833 bp, Homo sapiens
  misc_feature (833)..(833): n is a, c, g, or t
cagacttaatgttggccaaccatgcatcctccctagaaatgcatttgaatttgatttactaatcttttatttaggaaatttacatttttacattagtgagattggtcttttgggctatgtacttttttttttttttttggagatgggatgtcttggctctctcacccaggctgggatgttgcagtatgtggcaatcttgggcccactggcaacctctgcctccggggctcgagtgattctcttgcctcagccttccaatgtacgctggggactacgggctttgttggccaccgcacctgggctaattttgggtgttttaagtaaagatggggtttggctatgtgggccaggcgggctcttgaatttcctgacctcaggtgactccaccttacctcggccttcccaaaggtgctagaatttccggggtgtgagccaccatgcccagccgggttatggtatttggaatatggggatttggctagctctctaaagtaaaataggataccggtatatctttcctggtgctttaagcagttataactggggaatgattggtccatgaacgggtttgaaagtctggtccttacagaactttctgagtccacagggctttccgtggaaatacttccttatataacctgtcagttccctttggtcgactattattgtccctaattctaaactttcaagcaacctttacattttacacacactctggtttttcaaaaatattttcctcccttattgtcattagaacattcagggtcatggaatctctcaagcaactcattttctttgtggtccaactttaccctttgttgtagcgaagttcn

SEQ ID NO: 583853 - DNA, 115 bp, Homo sapiens
ttctagcctatataactgcaggctgagccactctcttccctttcaccagcatcactccccatggaagagatattgttttccacccataatcctttctgccacccgcttacactcg

SEQ ID NO: 583854 - DNA, 301 bp, Homo sapiens
acgtgagagagagatagagcgagagagagagatagagcgcgagagagagagtgagtgagtagacagatagagagagagagatatggagacagagttatcctgcttgcgatatagtgatactactgacctactacaatgaatcagtacgtcttccttatacagtggtcggatatatgctcgaagagctcgtgcagttttggcgttactactctctggttctgtgcgtaactttggatggatgtccattacttcatacgattgtctacttggtatcggtgactccagattctctggccttcgt

SEQ ID NO: 583855 - DNA, 773 bp, Homo sapiens
ctttagttaggatgtcgtgatgggaccgagctcagcgtaaccctctggccgacgtgggccgaggtgggcctggcccgggtctgctgtgtgcccagacgagcggagagtgctgtgagcggcttctggtgccagctgctaacgagccctggcagtgctgcacctctggtgccatgtgtctgcccctgcctcctggggtagaatcctgccccagccctcctgtggccgtgggacctggtgtgctggcctgctttctgccatgtcctgtcctggcctgttcctgcattagtgtccgtggataactagtgtggagtatgtgtgtgctgtgccctgcctgcctggacatgccctgctctgctgtttctttaatgccccctgactgcgtcttcactgtgccctctccctgttcttgctggaaagctgactgttgggtgcaatcctgttcatgaccctccatggagaagttttgggatgaatttctggtgggcgtgcctgatgcaagaaggacttgctggagactatagagacccagaagaagcagcttctccagtaccaggcacaggctcaaggatgtggtccgtgcctataaaagcctgctgaaggagaaagaggcattagaggccagcattcaaggtgctgtcggtatcccacgaggccagatgtgggctcgcaggttgtccagcttccaggactcaccttactgactctgtggatgacggttgcccactcaagcgaggattaactgggacgcataactggatatgggcagtcacaga

SEQ ID NO: 583856 - DNA, 266 bp, Homo sapiens
cctcggtggaaggtaccatcggtctttaaaccctgcgtggcaatccctgacgcaccgccgtgatgcccagggaggacaggccgacctggaggtccacctacttcttaggatcatccacctattggatgattatcgaaatgtttcattgttggagcagacattgtgggctccagcagatgcagcagatccgcatgtccttcgcggaaggctgtggtgctgatgggcagacacatgatgcgaaggccatccgaggcactggaaacacc

SEQ ID NO: 583857 - DNA, 557 bp, Homo sapiens
  misc_feature (345)..(345): n is a, c, g, or t
gcacaaagcatgccatagtgagtacctgcgaccggtagtttcgtctcgcatcaaccgtgaattcctggtagcaaaggtacatgaagtgatcatcagccagcactcaagtaatcacgactcgaatcgcgatcatcggctggtcctgaggaagcgctgacgagctcagcagtgcgcagctttgtttcatgcattgccccccagtcatcgggtggcacaaacaacctgatcaaggcacgcacacaaatcgtcacgaagttgctcggctgcctgtccgatatcggtaccaagcggggccgtcgcatcagtgtggatccacggactccgaggcacaatctccccgagcgngcattccgaccgcctcaatcgtgccgcggatccgcgttacacaaccgatgatcggatgccggacgttctcgaccctccacccgtgcctcagcaagcaggacgccacagtgtcgacaaggaaaggacggtcccccgtcacgatctgaacagaattatctgcccgtttgaccacgggggatcgacgatgacgtcacgcggagcggcccagtcgc

SEQ ID NO: 583858 - DNA, 362 bp, Homo sapiens
atgctcggcatgaacacaaagcatggacacacagcacagcccagcaccaagtagtagccaatcttcccaaagagcaggcccatgaggaccccaccaatcatcctgcggggaagagggggaggctggtctgagtgaagaggcctgagggctggggactggcaggcgggagcagagggggtactcacccaacatatttatagcccaagaaggccaccaggtcgatagtggtgaggtctgtgttgacagtgacaaggtagaggctgagcaggatggccagcacctccagtgtcagccaggccaacgccgagctcgcctgtagccccaggagatctggggagaacctgccggcaccccgagcaagc

SEQ ID NO: 583859 - DNA, 620 bp, Homo sapiens
gacacccctatcccaccagaagagccggtattctctattcccgttaagccaacgcctagtgacatttcagtgcgtcagggtaaatacaataggctgcaaacacacacccctggccagttttctttgatgaaatctccccacgccctctgtgaagttcctcagatttaagtcacatttgacattaccgccaatgggatagtacatgtttttgctaaatataaaggcacaggacgtgaccaccaaattgtaatccagtcttctggtggattaagcaaagatgattttgaaaatatggttaaaaatgcagagaaatatgctgaaaaagcccggcgaaaaaaggaacaagttgaagcagttaatatggctgaaggaatcattcccgcccagaacccaagatggaagaattcaagggccattcccctgtttatgagtgcccccagcttaaaaaaaaatttttccaaaatgagggggctcctggctagaaaagccagcgaaacaggaaaaaatattagccaggcggcatccttttttcaccaggcatcattgaagctgttcaaaatggcatacaaaaaaatggcatttgagcgagaaggctttggaagttttggccctggggacca

SEQ ID NO: 583860 - DNA, 1025 bp, Homo sapiens
gtacacatcgaagatgtgcgttatccggctgcctgtggctcttggattgtgtgatctcctgtccatgtatcctgccgcttcttcgagtgctgcttgcacgtattcttggacccgcacggcgccgtatgtctgccttgtgttgatcttgagtcatcgtggatcgtgcgatgacacgctcgttgcaatacctcttcatacgtcatggcgtagcttatgtagacataatatggtgtgacgaagactatacctgggaattgtacgctacttgagtcttgtcactaggacttcgtgagcatagatccctctgaattgtgcacgagacagctgtgatgagacatgacgtatcttatcgtttagcaattgatcatatttacccctaacgttcaaacaaagccatgatgtggttcaagtgccgactctgacatcaaagggaattcctttaacattatcgccacgtcgaaacgggtgtaacttattgcataatagggcattacttcactcatgggaaatgggcccaaattttttcctggacagggggccaggttggtgactttcagtagacattgtctccttttccatctcttccacctaattgtagtgcaaattactggcaatcattcgaagattagggcggaggacctaatcaatacgccatggtttgctcccatatagggcacttccccttcgaattagccccccacgtgaagaacgaaggcctcttccaacaatttcttgatggaacctcttcaattctcggacataacaatcaacttggaaatggcctgggcgagcggttacttcgcaagaggataagtctccaagtgaaaccgcgccttcgttggccaaaggcccggaaattacctgggcaattgaaccccccacttaaaacgggacggacttgtcgttattcaggcaaaatccactcagggaatttctttcctttggggcgagaattatgttaaaattccaggtgaagccggggggttattcacacatttggaggttccctacacaaagaacacacc

SEQ ID NO: 583861 - DNA, 780 bp, Homo sapiens
atctcgctctcttgtccagctggaggcaatggcgcgatctggggctcacagcaacctcccgcctcctggttcaggcaattctcctgcctgcctcctgagtacatgggattaacaggcgtgtgtcaccacgctcggctaaattttgtaattttagtgggagacacgggtgttcaccacagtcaggctggtcttggactcctcgacgtcgtgatccaacccgccttggcctccccaaagattactggggattacaggcggtgagcccacatgtgcctggctgagattttctttaaagatgagcttaattttctgaacatctttagtggatatcataataataggtacaataaaatctgtgatccccatattcttgattgccacccattccagggaccacattttataataaaatagggatggcgtttttatattcataattatatagtgagtatcactgggtcccattacaggcgcttattaacaatcataacaattgtcatatagtctttgagagaaaaaataatagtgaaaaataataatagtggtgaacacaggggaatttttctttctaaagcaagggctttaaaatatttttgggaaagtttgaccaaagcataaccaccatgaatatccagatttacctcaatgctaagaattatgtttagttagggaaaagggaagtcattttgacctcaggtaggaaaatagattgctttgagttttaagtagctttagacttttaaaagttaggatttattctgtaacttaaaattatttgga

SEQ ID NO: 583862 - DNA, 536 bp, Homo sapiens
ttaagtccattacaatggaaatgggctgaccgcaaaggaaccatgatatgaattggtttaagtcatttggtgcatccaaaataagagtataagaacattccagaccaatcagagaaaaacatgattccatgataaaaataatacaaatgtcgggtgacatttaacatgtatccgcaatcccttcctccccctttggcaagtctaacacttcaggccatacacataatggcaaaacaggaaaattaaaactagccacttggactatgtcagatttaataacacttttaaaaacggtacaaagagcacatgtgcttgagtcaaaaaccacgggaatggtagagggtcaaaaaagaattacaaaataaatctgagacatgaaccaaaaaattcccatccggtgattggaaataaaagggtatctggcttactaaaaaggtgttcctccaatatatcacgtctttggataaggaatacagcacaagactttctccacctattggtaaacacatcaggctcagtctcactgaagagaggat

SEQ ID NO: 583863 - DNA, 408 bp, Homo sapiens
cggtgccgccgggctttaacattggagattctcggaggcatggaacacggggttcaaatgttcagcctgttaaccctggaacaaggttgctcccttggtgcagaccagaggaactgtatcacgtagggtgagccgccgggcctggggaataccttcggcagcttgaaccaactgttgcaacgtaactgccgctcccttttcgtccgcaccccgccgtggggctccaggaggggcaccccaggtcttctgagccataccgaccatcgtgcagccctcgtacgcagatgctgtcaactggcagagtcacagccctcggggatcatcagcgtttccagggaccgttgccacaccaatcagagagcctagaacatgcactgggcaaagtggatggcccagcaaggcaggcaa

SEQ ID NO: 583864 - DNA, 204 bp, Homo sapiens
gtatctcgactcctgcggatatcgtggcttctgagtgataagagagctcctctggacatattgtgtatgccatcgaccaggagacagtagtttgcaactctcatcaatcaacatgcttgcagattgttacaatcttgccgttttaccatccatgataatcgcatgggtgtatctgatgtgccaattcactgagttgtattgctc

SEQ ID NO: 583865 - DNA, 523 bp, Homo sapiens
  misc_feature (5)..(5): n is a, c, g, or t
  misc_feature (50)..(50): n is a, c, g, or t
  misc_feature (128)..(128): n is a, c, g, or t
  misc_feature (182)..(182): n is a, c, g, or t
  misc_feature (254)..(254): n is a, c, g, or t
  misc_feature (263)..(263): n is a, c, g, or t
  misc_feature (292)..(292): n is a, c, g, or t
  misc_feature (376)..(376): n is a, c, g, or t
  misc_feature (413)..(413): n is a, c, g, or t
  misc_feature (432)..(432): n is a, c, g, or t
  misc_feature (488)..(489): n is a, c, g, or t
  misc_feature (505)..(505): n is a, c, g, or t
tgganatgggatcttactctcttgcccaggcgggagtgcaggggcacaanatcacggctcacggcaacctcggcctccggggttcaagcaattcttctgcctcagccacccaagcagcggggattacnggtgtgtgccactacacccagctaattttggtgttttaagtagagatggggttncaccatgtgggccaggcctgtctcaaacggctgacttcaggtgatcctctcgcctcaacctcccaaagtgcngggattacnggcgtgagccaacgcgcccggcatggatnccagtccttagggggtgtgtgattaccgaaaagatgttttaggaacacctttttttggtagctccagtttaagggaacactatnctggggggaaaaaatttagcaaatatgcgtagattanctttttagagagttcccantcggttaaaagcttagggatcaaatccagttttcttacatagaatacattgggctnntaatatgggaatattnccttaaatcatttctgag

SEQ ID NO: 583866 - DNA, 621 bp, Homo sapiens
  misc_feature (1)..(1): n is a, c, g, or t
  misc_feature (6)..(6): n is a, c, g, or t
  misc_feature (40)..(40): n is a, c, g, or t
  misc_feature (42)..(42): n is a, c, g, or t
  misc_feature (65)..(65): n is a, c, g, or t
  misc_feature (86)..(86): n is a, c, g, or t
  misc_feature (213)..(213): n is a, c, g, or t
  misc_feature (447)..(447): n is a, c, g, or t
  misc_feature (474)..(474): n is a, c, g, or t
  misc_feature (484)..(484): n is a, c, g, or t
  misc_feature (491)..(491): n is a, c, g, or t
  misc_feature (494)..(494): n is a, c, g, or t
  misc_feature (508)..(508): n is a, c, g, or t
  misc_feature (517)..(517): n is a, c, g, or t
  misc_feature (536)..(536): n is a, c, g, or t
  misc_feature (548)..(548): n is a, c, g, or t
  misc_feature (551)..(551): n is a, c, g, or t
  misc_feature (560)..(560): n is a, c, g, or t
  misc_feature (564)..(564): n is a, c, g, or t
  misc_feature (566)..(566): n is a, c, g, or t
  misc_feature (575)..(575): n is a, c, g, or t
  misc_feature (585)..(585): n is a, c, g, or t
  misc_feature (589)..(589): n is a, c, g, or t
  misc_feature (591)..(591): n is a, c, g, or t
  misc_feature (598)..(598): n is a, c, g, or t
nacaantacgaactcggtaccaattacatcaaacgtcagngncatgattccgagcgaacctgaanaccgtttgagggcttatccangccaagaagacgcgtagcagccaagcgcgaagtgcttgacgatccaaaatacggaagccaaatcctggccaagttcatgaaccacgtaatggaaagcggcaagaaagccgttgccgagcgtatcgtntatggcgcgctggaaaaggttaaagaacgcaagaacagcgacccctggaaatcttcgagaaagctctcgacgccatcgctccgctggtcgaagtgaagtcgcgccgtgtaggcggtgctacttaccaggttccggttgaagttcgcccgtcccgtcgtaacgctttggcaatgcgctggttggtagacttcgcccgtaagcgcggcgagaagtctatggccctgcgtttggctngcgaactgttggacgctgctgaaggtnaaggtgctgntgttaanaancgtgaagacgtgcnccgtatggntgaagccaacaaagctttntcgcactaccgnttntaattctancttnantaattttgngagggctttntggntngtactantccgattagccgctaccgtaaca

SEQ ID NO: 583867 - DNA, 550 bp, Homo sapiens
tagccttgaccataatttgacaggaaatacatctaatgcaggaattcctaatttaaatggagcaatattttgtggatacccagttatattatactgttgcttattctcctgcttttgatcttttttttctgatacggcagcatctgcaacatgatatttattagtctggtggtcttgtatatttttcaccgactgagcaataaaggttcccttagcacctttagccaccagcaatccttcactaatcagcaactgatatgcgagttctatcgttcctcgagccacatttaattcactcgcaagagctcgtattgaaggaatacgctggaaagcctgtagctgcccattatttattccttcatgaaaacgttgataaacttgcaaataaagtggtgtattagctgctgtatcaatttgtagaaacatttttaacacatcttgtcctagtgatattttttattcttgcccctttattataggccaagatgctttaatatgcgctacagttatttaaatgtgctaaaacagagtcgacgcggccgcgaattta

SEQ ID NO: 583868 - DNA, 325 bp, Homo sapiens
  misc_feature (178)..(178): n is a, c, g, or t
  misc_feature (193)..(193): n is a, c, g, or t
ctagaggatcctgaagttaagggctaccaacacggaatctgacaattcctcaatcactttcatataaaaagttttttctgatagccgatagtctttcgagccaaaggaataagtcaagactctaggacatagtctttagataaactgggaccatcttcttggtgaaggccctgctatnaaaggaaagaccctnagagtaaagaaacttccctcgtttaaactttaccaatacagtctacaccttctattgcatattcctctattcaattccttttatttcatggccattcccttttttacctcaaaaattgggggaaaaaaacgg

SEQ ID NO: 583869 - DNA, 368 bp, Homo sapiens
  misc_feature (201)..(201): n is a, c, g, or t
  misc_feature (261)..(261): n is a, c, g, or t
  misc_feature (264)..(264): n is a, c, g, or t
  misc_feature (296)..(296): n is a, c, g, or t
tggtcaggaattaccaccttgattatacatatgaaatctgtggttcagtcaagcatctgatgtgattagtcagttgcagaggtgattgattcttgctagttattctaaccgtatgctctatcccagaaaatgtttgaaggtttagtaaaacagttttaagttgctaaccttaaagccaatacatattttagaaattatgangtccactgtacagatcaagaaactggtacttaggaggactaaacagcttagcttaactgntgntgggacataacccatgaccagaaccagactgntcataaaatggctttttcaggtatttcaaaaatgtcaatataggtataaattaactaattataatattttta

SEQ ID NO: 583870 - DNA, 442 bp, Homo sapiens
tgcagcgagggcggagattagccagatgccaaaatcaggcgacgggtggtgatgactgtcagacacacacaaggtcgccagtgaacttcacacacacctcatgtgagcaaccctagcctattttatagtgtgtcctatttcatacctgtacacacttcctcgtataagtaatgagatttacttacacccaaacagatcctgaaagaaagcttcaagttttctcagatgatggatatcttatccactgtattcaataactgacggatgtaaggtgcacgtttcctgatgctgtgacgcactgtattccagctggtactcaagtctgggaacagccgtaacaggtcaaccttgtggagccatcgcgagttagagggtgaaagatggcagaaaaaaaagtcttgtgtgtgagtgtgtttttgagtttgcatcaatcttaatgtct

SEQ ID NO: 583871 - DNA, 1359 bp, Homo sapiens
  misc_feature (215)..(215): n is a, c, g, or t
  misc_feature (327)..(327): n is a, c, g, or t
  misc_feature (1359)..(1359): n is a, c, g, or t
agcgggacagggactgagttgctgggactctgggctggggctggggagaaatgagagcaaactcatcctttgtgcccctctcatggcgtcctggtccagagtccccgcctagatacgggtactggcgacaacgtccatggcgtccgctcgggaggaccatgctcactggtgcacgtgcgaaatagatggtgagtggtggctcggaggagacaagnggagctagaggcagcagtaggaccaggtgtatgtgcatatataccctgccatgcattcttagcgcttcgccatcctgctcgatctagcatcctcagcgactagggtgaaaanctgaacgaacgccccaaaagttcggagcctatatcatcgcagaatgggtctgagaagacagcctattcattaaactgctactcatgagcaacaatgtagcgagaggttgagagactcttgaggggcatagactagtgcctgcagcgatagagctcggggaggaatcgatcgcctagtgtgactagcgtggctagacagcttgcctttgtgttcagtagtgttgcctcgtcagccacttgcccgcgtgggtctgtgcgtgcgcgatagtctgctaccttaaccacctggggctgcagcccgttagtttgccgtatccgttcgtgagaccttttgctgtggtgcgggggaccccggcgattaccattgcatttgccggagtttttgcggcgcgtttgcttgtgtggccgaaccctcttgtcgcgagctcccttggtggcgtagttgtgccccagcctttagctgcgctttggggaggccccctggccgcctcaaatggcgcgacaggcactgccttgcagccttctccactttacgtccccgactctgtcttctttgtcgtagactcggtgcccctggcctagggtcgcctgcggagattggggccctgtcccaacctagtgtcgctggagggaaacttcttaacccaggtgcttctagtcaggttgcgaggcgccctgtgttgcctggggccccagatgtcattcggacggggtctcagacccgttccgtggaggtcctcgcagtagacttctcccccgagcccgttgattgggggcctcgcaaggccgtgggaactgtgctttgtgtgggggcagtattcatccccgtggggttccgtgccccagcccgtgcccagtaacctggggccccgcttgtctcctgtggatcggctagcttccgcgtcgcttgagcttgggtggcgcttccggtggccctttccgggggctggcttcgttggcgccccctgtggttgacgcttttcggcggccatggcccgacccctcccttgcgttggtccgggtgcgcctaacn

SEQ ID NO: 583872 - DNA, 172 bp, Homo sapiens
cccgactagcctgacgggctcacgtaggctttcgatggctcgggctcccgcgctgcggtgcgggggggatggcagaagccactgtgatgctgcggcccgtgcgccccgcgagctcagcacgtagttggggtccgggtcgtcgccgccctgcagactgtcgggctagtcgggg

SEQ ID NO: 583873 - DNA, 146 bp, Homo sapiens
cacgagggaggccacacaaacatttgcccaaatcacagattctacacagtaaggacacccccacctcaatttcatttctgaagcaatgaagctatgactgacatgagacgtttaactgatagttacactttataccctcactaaca

SEQ ID NO: 583874 - DNA, 889 bp, Homo sapiens
  misc_feature (453)..(453): n is a, c, g, or t
tggtatttaacctattttttaaacagacaaggcctaacagatcttatattttctttctgggacacacccacggtgcggccacggcggccaggggtctgggtggtgctgggcctcggacacaaaggccccagaaagtgacgcagccctctatggcgcccagaatcttcttcagccgcatccagggtcttcacgggacgcttggtggtccaagaccattgggctagagacctggagctggtatttcccatctcttaaacatccttctggtctggtccaagagaaccagttctgggggatccttggtacctgggctgtggagatatcctgcgcataaactgggtgagatccaccactgtatcccacctctaacatactctacaggatggactgtttctcccgcgctcctatctatggggagaagtgtacaaatggtactgagcatatacctctccnaaaacatccacactatgagatcgctatatatttctatacggggcccaaacaaccctctgtaagatcggggcctgtgagatggcgccaaaaagagctaaatatattccccgcgcccgtgccccatcagatgtgtacgcggtgcgtttcgcgactagtcatctcccggcacaaaatttatgcgcctgggagacaaccctctcttctccagggggagcatctccatcttaagagacacgaacctcttggggttttagccagagacacaacaaacggcgaggcgggggaaaacgaatacaactaaatgatcgccccccggggcgagaaatcagcgccaggctatcgcacgccacggagacctttataagacaacccacgtctggggccgcccacccaacacgctttgaaacccctggtgtgtggggacaacacaggtccg

SEQ ID NO: 583875 - DNA, 127 bp, Homo sapiens
agctctgaacagagactctgctctgacgcgacttgactgagagcacaggtcaggacacagctctgatctggcctgaccaacacaacagcgcaggaaagggcactgctctggcccggctcccaataca

SEQ ID NO: 583876 - DNA, 523 bp, Homo sapiens
ctcaaggctttatactccttaatccttgattattattcatgatctcctgtgttgatcaactgcccgtagctttctgtgcttgtgtaattgcttttaggaaagcacagatgcaagcacacatccttcagctagctacaggtggacacatcagaggactttgcaagagtgagaaccactcttactttcactcttacagagtgagacctcacctgctctctctagttggactctggtgagccttctgcctggagtaggtatgcttggtaagtggcactgagtgcccatgctcctcgggggcccatgatgcctgggactgactgaaaaactgggtggttgggatccttctgctgcagccagtgaggagggagccctgacacggcccctactccctggatgcccctcagactgcactatatagagcagggtggctgctgctcgggcctcccagggaaaatacgtaggaagcccactgcttcccatggcccagtgctttcacagtgaggagaaggggacacagaagagg

SEQ ID NO: 583877 - DNA, 447 bp, Homo sapiens
gtggcatgatcagggctcactgcagccttgacttcctggtttcaaggggattcttctgccttagtcccccaagtagctgggactacaggcatgtaccaccatgcccagctaatttttttgaattttacgtagagacaatgtctcgctatgttgccaaggctggtcttgaaatcttggctcaagcgaacctcctgcctcagcctcttgagcagctgggattacagatgcacaccaccatgcctggctaattttttatttttttaaattatttttattttgttcccaccacttgctgcctgttgataattttttattaacattttatttttgtttttggtagacagcacgggaattgcgctcatgttgcccaggaccagatctcgaacatccgtggcctcaaggtgatccttccgtgcctcgagcttcccaaaggtgcgggcaattacg

SEQ ID NO: 583878 - DNA, 385 bp, Homo sapiens
tcgatcacgtgcattgtgccaaagtcactttgttttttggtatttttgtttgtttttggggggttttttgaagacagtgtctcactctgtcacccaggctggaatgtagtggtacagtcttgggtcaatggaaactctggctcctgggttcaggcggttctcctggctcaacctcccaagtagcttgaaattacaggcgcgcgccaccatggccgaactcaatttttggatttctcggtagaggcagagtttcaccattggtcaggctggtctggaactcctgaacttcagtgatctgcccttgcccttggcctcccaaagtgctgggattacaggcgtgagccaccgtgcccggcccccaaagtcactttcccacaatggcacg

SEQ ID NO: 583879 - DNA, 659 bp, Homo sapiens
aacttggacttacctgtttgagatctagcatgtctgaatcatgctcatttctggcaggagcgtggctcatttcttttaggcaacaaaataacatgcctgcctgtctgctgaaactactgtgtttcgacagcatttatatatttatttatttgagacacgagccttgctgtcaccctggctggagtgcaatggtgctgacttggctcacagaaacttccgcctcccaggttcaagcaattctcctgtcttagcctcccgagtagctgggaatacaggcatgtgccaccacgcgtggctaattttttagtagatagggggtttcgccctgttggccgggctgttctctaactcctgacctcaggtgatccacctgctgcagccttcgaaagtgctgggattacaggcctgaggcactgtgcccagccgaaaagttagtagttctaaaaggagggaaggaactaaccatatggagatactacttatgtgtcagacgctactaggtaatttattagctaggtgaatcttcacacagatgtggttattgtttattagagaagactccttaccgctgaagaaattatagctcagcaaggacagtgaattcccagggcctgtggtcctagagtagaatcaacctgaactgagagagtaataagcta

SEQ ID NO: 583880 - DNA, 522 bp, Homo sapiens
aaagatttatctgtagcttgcgatgctgtttggtatgatagcgttcacccacacaagaacttctttcaaaattgggaatgcatcctctcaaaccctgctttggttttatcaactgattttactgatattcgaagtcctttgttgtcatttcaacgatgttcacagcatctttgccagcagtagatttcatctcaagaaaccactttctgtatccacccatatgaagcaaatcctcatctgttcaagtttaatcatgagactgcagcaattcagtcagatcttcaggctccaccacttctagttatctagctatttctaccacatttgtagttacttcctccactgaagtcttgaagtcaaatcaagactcagttatctgtgaaggttggaatcaatttcttccaaactcctgttaatgctgacattttaacgtcctcccatgaagcatgatgttcttaaatggcatctagaatggtgaaccctttcagctacagacttaagaatatatttcttctttttttt

SEQ ID NO: 583881 - DNA, 434 bp, Homo sapiens
  misc_feature (417)..(417): n is a, c, g, or t
ctagaggatccctacagtaatatgtaacattctaaatcctttttacatcatcttcactagaattaggtccatctcaaggaaccactttcttgctcatccataagatgcaactcctcattgttaaacttttaccatgaaatagttatttcttccactgaagtcttgaacccttcaaaatcatccatgagggttggaatcaacttcttccaaacttctgttaatgctgatatttttatctcctcccatgaatcatgaatattctgaatcgcatttagaatggtgaatactgtccagaaagttttccattgattttgcccagatccatcagaggaatcactatgtatggcagctacagtcttatgaaatgtgatgaaatgtgtttcttaaataagaagacttaaaagtcatccatgggtngcggaatggatactatg

SEQ ID NO: 583882 - DNA, 1702 bp, Homo sapiens
ccacgcgtcgcccacgcgtccgggccgcccttttatttttttttttacaatggagaaaagatatttaataaatcatggtcaattttataatgttagcaagcccagttcgttgggtggatagcctccacatttatattggttaagtcatgggtggcgtggtgtctcttacctactgacattatgttgttatatcccttcattggtggatctaaagaatgtcgcaaaaggttcattccgtgtaccccaactacagattcactctcctttagcgtgcctttttctagcaccaattagtgcttttacaaaaaaagagtgcgcatacacaaccaagcaggtgacagcggccaattccttcgaatgtgtccacgattaataacgggtacgcagtgctaaagaagagggtcgtggtgctaaatagcgtggcagagtggtatatggtccagagtccagcataaaattatttcctttcggagcattccctccattcccctaacccgaatacatgcatgagaatgtagcaaaacccttcggaaacctctcttagccaacggcaaacttatctgtggccacaagtgcaagggggtcggatgtgaaccagtatatcacacagctctttagccacttcagtggtgaacaggaacccatcgggaaaaattcctagtatacccatcagtcggctcacttataataacggataacggacgtgcacttataaccagtgataagtccttgagcacagattactggccgcacaacttctctggaccggtcaccggggttggaacaatgtggcaaatgtcatggatagcgcacttcgtcaaaagagcctagacgggccgccaccgagtgcgtcgctcgcttgttcagtcgtatattatgtcacatccaacgacctaacaagtgcaagccccacgacagcaccaccgtcacgacggacaagcctatcccccacatcatcaccagacccacgacgcgacagacacacgacgcgagtgcgaatgcagcactcaaagcactacataccgaccagccgcacgaaaaggagcagaatgcaaggagggagcggaggagtgcgcgacggaacggatgcgcgaggagagaggcgaccaggagcgaacagggacgctaaaggatggtcagatggagcagtaggtcgagacaggatggtcagggaaaaggaaacgggcagggaaccgcggaggttagaggaaggtcgggtggggatacggcaggaccgatattacaatgcaagaaatagcagatagggacaaaacaaaaacgcaaccaaaacaaacaaaacagaaaacacaccagagcaaaacgaacggcaaaacaagccaagtcacaacgaacagggccgacaggcaagagcacgaccgacacagcggaaggagaagaaacgacaagaaaagcgcaaacagagggaagcaatagcaaaccacaacacccgccgacaaagggacacaaaacgacaaccccaaagacaaaaggcacgaagcgacgacatacgaacgcaccacaaggagcgagcagaggcgcgccacaacagcacgagcgacaaacaaaacacaaagaggaggaagcagagcaaaaccggagaaaggcaacagaaagaaacagaaacacgaagcaaagaaaaaagaccacggaacagcgagagccaaaaacaaaacacagaatcaaggacgacagccccagagaa

SEQ ID NO: 583883 - DNA, 742 bp, Homo sapiens
ggggtgctgaagatccaagacgttggcgtggagacaatcacaaccatcgcctgcgcagtttgtaatagttggtgctcgtgggcctcccctgtcgccctgtaatgtccagtatgccccgccgtagcacgtgagtggtccggataaatcaatgcccccatttcctcgaggattcaatctgcgaaatctcggtcacgcgctccaatgtgacttctacaaggccagccatccccatagagtaaggtccatcctctctactgggcgagataccaatgtgcgacgcgcttcgtaggtgtgcattataagagacacgcgcgagcgtagagaattctctcgaactccaatcctctcgccagatacgcatgacttggtgaaggttacaggctgactggggtgaatcatactctcaatagcgacatgacaggcggtgccaaagggcctggatcaccatgaagtgctgtagttgcacccacgtgaagtgcgtcgggcgtgctagtccgatgcacgcccacgggcgcgggatccataggtagaattggaggggagagagcagtgcaaaaacccctgaatcctgtcgaagaagcggacaggcgccaatccactttcctcggttgtttcctagctacgagccgtgtggtcctgacgtagcggacattaaatgccatagattccattcgcacctaagacaagagacagaagaaccatgagactgggaaggcagtgtgaaagggtcctaaactactca

SEQ ID NO: 583884 - DNA, 140 bp, Homo sapiens
gaggatcccgaagcgcacgatggcgcgcccacgagcccttctctgtgactgaggattacccgctccatccatccaagatagaaactcagctcgtggtgggggcttgcttggcaagggtggcgaccatgcacattgaccca

SEQ ID NO: 583885 - DNA, 402 bp, Homo sapiens
tctgtaaaggcagtgtttcactatattttccaggctggtttccaactcctgggcatacctgattctcatgacttaggcttccctacatatccgtcgatctccctggcccctctcttacccggcttccctgctctagaaccactgcaccgcgatctatccgatgcctcacctgcctcctccacagtcccctccttccaagccgcccctttctcgccctcttctgctccacgccctcctcctgcgcggctgctcatctttccacgccctgcccagctctgtctcttcctccagccggcctgccctgatcacctccccttctccaccagcccgcccttgcccacgtacccttccccctccgtcctctctcctctcagccgaccccactctcctttcctctccttt

SEQ ID NO: 583886 - DNA, 231 bp, Homo sapiens
catttggttggacgaagggaaaagggacaccttggtaccagtactcaaagacacaaggattgagctggtgagggactagtttggggattccagaaaagatgctgggcccaagaatcttgtacaagtgggagcaggcagcaagtcttccccttgtgcgcttacccagccacttataattgtgcaacagttgatcatttggcaacacagagcagtccacagcatttgtcaaca

SEQ ID NO: 583887 - DNA, 207 bp, Homo sapiens
tggacaacaagagcgaaactcaatctcaaacaaacaaacataaatgaaaaggctgggtgcagtggctcacacccgtaatcccaatgctttgggaggccaaggaaggaggatcacttgagctcaggagtttgaggctatggtgaactatgattgtgccattgcactccaacctgggcaacaagagtgagatcaagagtgagacctctt

SEQ ID NO: 583888 - DNA, 375 bp, Homo sapiens
agtagcgagtgcacagactacagcatctgcagcgttgatgaggtcaggcatggatcgatgacacaccgctagcgtgaactgatccagccacgtccacccgtaccatagtgctggtgttgcaggcatgagccaccagtcccgtcctgctttttgtatcagaagacaggactaatgtctcctcctcccgacctctaaacctgcgtgtgttgctgtgcaccgctcgtttgtagcgtcacctctggtctggtgaagtctgtgctggcatctcctcattgtcgccttcatcatagctgtttcctttgatgacagaaagactctcgttctttctagatggtgggatcaggggcctttgctgtgtttcccgtggtatggatg

SEQ ID NO: 583889 - DNA, 120 bp, Homo sapiens
atacagcacagcttagtgctgcagcgtgacagcccaggctctgatgtgtctctcacagcttgtaaagtgtgagacatgctgccttgttgtgggactgagggacgaacaccactctcttca

SEQ ID NO: 583890 - DNA, 150 bp, Homo sapiens
  misc_feature (63)..(63): n is a, c, g, or t
caggatcacgtgtggtatatgataataagtgatttatcaacaagagtgatattttgctagggnttccaaagtttacgcggttttctagcctcatggaatactgttgaacctatagcgtagtcttgattcttttgttgtctctgccttgta

SEQ ID NO: 583891 - DNA, 1240 bp, Homo sapiens
tccagttgcgtagcccgcgcgttgggccgctggcgccagggggttctcctgcgggttgtatgcctcgcggggattgcccctgttatcctcgcgatgcgtctggggatacgtgctttccgcggttgtgctctctcccctgggcgcgtgccggtgcgagcgctcttgctgtggccagccggcagtgctcaccgcatgaggtgtccttgtccgggtcgcaccccagggcgttccgtgtttggcatggtcgcgccacgttgagccctgggtgtaacccttgtccgggcccgtgcccctcgtgtgtgactggcgccgcgccgagatgtgttcctacggccaagcctgtccgatgcgaagggcttgcccagggggcacaatggcaaagcggcgatccaggttcaaagccttcgatgccatggctagggcgccttggccgcctaggcaaccagtcgagccaagttggagcgttgcaatgcccccgatcgaccgcggctggcgaccaggtgggcgcgcgtgccgtgcactcagcgaaggcacttacgtgaccagctctacacgtgtaagcaaggaacagccgaccaacgcacactgttaggagaaccctgcggattcagaagaggacgcacccagtggctgcacgaccacttctgagaccctctcggagacatcccctcagctctcgtccctcctcagccgctgcaccatgtaggccatgccagcccccagagtccatatgagcgcgtgctgggcttcaggcttgcacgggccaatcgcgccacgccatgggaccagagacgtctggtccgtgtgtagcggtacgcgggaccaagagcacgcaagggcccaagggaccccgaatgtatggtgaatgccagaacggatgcggagaagagatgcgccgcagagaaatgcgggagagcagcaatagcggcctacaggaatcattgcgatccaaggtgctctcctgtccttatccccgtccctcgcatgttttcttcctgccaccccatggcgcctaaccccctagtggacgctgcgctgcccactcaccctggcccacagttgcgtgtgattatttcatctgttagatgtggctgttttgcgtagcatgcgtgtgccacacctgccctctaccccgatacctgtgccgcgcgccccctctgcaatgtatgcccctgccccttccccagcactaatgaatttatatatataaatatatctacgagtgcgtaacaaacatccc

SEQ ID NO: 583892 - DNA, 380 bp, Homo sapiens
ttgaatctgggcattgggcgctcgtaatacccggatgtgactggcgcccagccgggcgtagaaacccgcattgcgtcgggcacgctgaccgccaaggaatcggtgctgccgcagctgggcctgggcttcaagctcaacgccaacaatgagctgttcgcttcctatgccgagaacatcgccgccttcgtcggcggtggcagcggcggcccgttgcaggtatcgccggaatcgttcgcggccagcgccggcctggagccggagaagtccaagagcctggaagcccggcttccgtaccttcggcgagcagtaccaggcgtcgatcgcggcctacaacgtcaagttcgacaaccgcctgctgtcgctgaacccgtgctcgagca

SEQ ID NO: 583893 - DNA, 449 bp, Homo sapiens
  misc_feature (137)..(137): n is a, c, g, or t
  misc_feature (145)..(145): n is a, c, g, or t
  misc_feature (204)..(204): n is a, c, g, or t
  misc_feature (226)..(226): n is a, c, g, or t
  misc_feature (236)..(236): n is a, c, g, or t
  misc_feature (247)..(247): n is a, c, g, or t
  misc_feature (259)..(259): n is a, c, g, or t
  misc_feature (262)..(262): n is a, c, g, or t
  misc_feature (279)..(280): n is a, c, g, or t
  misc_feature (287)..(287): n is a, c, g, or t
tccccaatggggggggggggggggcggggggggggttttttaaacccagcttttttttttaaccccccgattccctggggggcccccccccccttttttttcccccctttaaaaccccgggggcggttccccccccnggtttttnccttgggcccggggggggttaccttttttccccggggacccctttttccctttggcccnttttgggggccccttttaaccngttttttccnaaaaaccgggnggggccgggccnggntttcccgggtttttttnnccccccnggcccccccccgggcccccccccgggtccctttttttccccggcttttgggggggtggggggggggggtcccttttggccccgggttttttgccccccctggcccccttttttggcccccttttttcccaaaatttacccctttaaaaaaatttttttggga

SEQ ID NO: 583894 - DNA, 284 bp, Homo sapiens
ccccgactagcccgacagacagactcgcattctccttctccacaggccgtaggtctccagccgggcctccggccctgtcgtcaagggcctgactgttcccatccggacttatggaagtggaggagggaattttgagtccaagctggggttttgagatcctcaactttaccaacatctcccctaatctcaccagacttaggaaacacttggccttcagcaaacttaagagtaactgatccaaatacagatgccccccactgtcgggctagtcgggggggtaccga

SEQ ID NO: 583895 - DNA, 1681 bp, Homo sapiens
  misc_feature (1)..(1): n is a, c, g, or t
  misc_feature (941)..(941): n is a, c, g, or t
nttgttgttgtacgtcgctctctctgtgcatctaccgccctgttgagtgatgtggtcgagtgtgctcgacgctgggttggttgtctcgtagccgcctggtggtgttattgtgcagctcactggtagttattcccccgccccgtggtgggagacggcagcggactatgttgtcgccggccactagttaacgctcaggaggtgtcgtgtggttcctccttctaccgcaaatgttgtgcacattcctcgttgcagggcccccaccaatgggccgggtggatataatacgccccctaaaatttttccgggggggcccccctctgctggggtggtggatcgccctgttcggctggacccctcgggttggaccccgcaggatattctcgcggggagcgcgtgtcttccaagaaagagagagaattgtcccccgccagacaggaggtgttacacacccgcgtcgcccagaacttctcccggagattgtggtggacaccgggggccctcttctccgtaaaagacgcaccagagtgtgttgctcgtgaaaccagccccttcggtgggggcaacccgggggagatctcctctccgcagccattataaatccgcggtcctcgggggatgccaacacaccccgtcgcaactggggaaccttgtaagggcccccccagaagggccgccccccctcgtggggggccgcccaacatttccgccgcgccacagtggtgcaaggaggttgtggtgtgtcgccgcctgtgtgtcctttaatagcgttgttggtgttgtaggcgtgcaacatcttaagagctgttatggctaggcttcgctgtgttttgtttgtttcgcgttgttcgagagcggcgaaaatgcggggagggccctaatatggagagatggctcgctcggtgtattctgtctgcggttatatgtgagactctacactttcncaccagggtgttctacccgcctggggcgccacacacagaggtgggcaccccccgtttgtgccacacacacgcccctgtgtagacacatgtgcccccacggagggcctcacaaggggagagttttatacaggtgtcttggccacagtgttatacacaggcgcacaagtgttctgaccacaggcgtctgtcacacatctcttatagagagaagaggacacacagggtctacacccgcttgcaacagggcccctgcgcttgtcacagggagaatatgagagatctcacagccacgtgccacaacttctgagatatctcccccctataggggcttcacaggcgaccttgagagggcctcgtgggacacacagtggaggacacataatgggtgtggagagaacacgattggagagggtatccctcatatgttatcacacctgagagtcacagccacaagccacctgagatgggagaataataacacgaatttataggctgcttataaccacctttaattttccaccggagatgaggtcaccacaatctgagaaggaatcaaaacttccacatcctgaaaaatctaataatgtttccaaaaccaccttgccaatcgctgttagagttgccaggttcctgggagaccacggcctcaagactgtgaagatatatatcctccagcattcagtccacgggggaaccccgggaaccatgtttttgcttatagcccttaaaatcagagatga

SEQ ID NO: 583896 - DNA, 913 bp, Homo sapiens
tgcgtggacccggttgtcccatcgctggctgttctggcgcgcccctggtcgcgtgcgctttttgccttgttcctgtgcatgtccccaggttgcaggacgcggtggctgagtgtcgtggacctccgggtgatggttggccatgagtgcttggctaggcccgaggcgttcttcgtggaagggagactgtggtcatctgtgctggccggtctgggcggccctggctcgggcctttcttccgaacacgccatgcgtcttgttcctgtgtccgtgatggaccccggagcccctcgtctcagcccgtgtccccaccccggttcaccccagcccatccattaggccagcaacgcttgtagaactcactgctgggctgtaatcgtggcactggtaggttgggaacaccagggaagaagatcaacgcctcactgaaacttggctgtgtttgcagcctgctctagtgggagcatgcccagagcctggctgcccatcatgctggccccatccaatcaagggaagaaggaggtatgttggactggaggccctggagccatgttggcaatgagggtgacagttttcctttcctctgtgtcgtatctctgtccagttcctttagaacaatatggatgcttccagatggactcccaaccctggcttggggtcaagatacagccagcaagagttaggggccttagggacacttcgggctagttgcttccattgaagccgactctggacctggcccttacttgcttctctagctctctaggcacttctcacagcttcgcacctgtccccaccctccactcagctgtcactgcacgcatacactccaccctccaccttccattttcccccactactgcagcacctccaggcctgtcgctatagagcgtacctgtatgtcatatcacgtgtc

SEQ ID NO: 583897 - DNA, 313 bp, Homo sapiens
ttctgatgtttgctggctctgcaattctgttttgaaagataaatgtccacttgtgtatctccttaaagctgtactaacctaaaatcggtagttccccgtgggcatttgccaggcatggtggcttctagaactttgagttgagtggagagaattaatttgcttaggtgataggttaagtttgattggattttattccaccttcaaaccgtgatggggacttcagaggaacctcttggggaagctaatgattcagggtattgaagactttagcttagaacattagtggttcttttggtttcagaagttcatggtg

SEQ ID NO: 583898 - DNA, 461 bp, Homo sapiens
tgagagaaaaggagcaggtagaggaatagtcaatgatatatttgtctcacgcccagtaaaccagctctttatataagataaggtgagcatagagtagctacctgtagagatatttaaccttttatctgtagctttctgcttaggaacaaaaggaagggtatcttcttgcatgaaagcgtccagcttattttttttcctttggcatagtaaattgaggcaccaagtttttattttccgttcacatttcttcccctcccgttttaaaaaaagtcttcagaaaatgcattttagaagaaaatgcgtctctagtcttggggttttgtctggtctcttgtgactaagacagtttatttctagacaggtcccacgtggttaggaaagctcatttttagcaggttgtaaagtctcatgacccatgaaggaaaaaataggtggaggaagagagagagaaacaaacaaac

SEQ ID NO: 583899 - DNA, 379 bp, Homo sapiens
gtcttcttggtaatcatggctctcatgagctctccctcttctagaattcttttctttttaagacaggatctagctctgtcacccagactggagtgcaatattgcgatcatggctcactgcagttttagacctcccgggctcaagcaatcctcccgccccagccttccgcatacctgggactacacttgtgtgccaccatgcctggctattgaaaaaaaatttattttttttaagtagagacaaggtcttgctatgttgtccaggctggtctccggctcctgggctcaagcaatcctcctacctcggcctcccgaagtactggcattatgggcatgagccacagcgccgagccccgattttttttttaatgctaaaagac

SEQ ID NO: 583900 - DNA, 766 bp, Homo sapiens
  misc_feature (217)..(217): n is a, c, g, or t
  misc_feature (219)..(219): n is a, c, g, or t
atgggttagaatgtctgttcaggttttatacttatcgagggagggggagttcaagcgaaaaatttttcaagatttccaagaagaaaccaaagaagactaccgaatctgggtcagcgtgtagtggactaggaaaagttttggggcttatttgaaatattctcaatctaagacacagtctattgacccaaaacttcacgaggggggggggacttttaananggtacaaaactaaacaagggatccccctattacggatgaattgtggaagagaaagacattcctctacttctgggggaggaggaggagccggctagacttcccctaattcctctacaaaggcgccagatgctggtaaagctacatcgtaccggggaggcttagggtgccagtaagactctcccagaatgagtattttccccggagggccgggggcccttgcacattagacagtggccggcctgcgcgcctgggggatccaggaaaggggcggaggcctcgcgaagtagacgcttctcaaaggcgcctgggcgccggggggaaccgtggggctgcggagttgttttccccgagatgctccggggcggctgttcgggggcgtcggaagagtggcgcggtgtggcggtgggtgcggtgtgtgtagccggatggttgtgttcaaggcgcccctgcgggcgcgggccggcggggggcgccgcggcggattgggaggggcgcgatcgggggcgtccgggcgcgtggtggtcggacgcctgcgtagggcccgtcg

SEQ ID NO: 583901 - DNA, 475 bp, Homo sapiens
ttttttttttttgtagaaggaagggctttattcagctgggagcatcggcaagctacagccttaaaatctgagctcctcaagtgcacaatttctgtcccttttaagggctcacaacactaaagatttcacatgaaagggtcgtgattgattgagcaatctaggggatatgtgacaggggtttcatgcactggtacagaacacaacagggagtttcacaatttttttatacaatgcttggaatctacggataacatcaggttctaagtcgtaagttgatttttaactactaggtttaggccaggcaggcccagggctggtttcaggcctggtgccgggctgcctgtctttgatttcacttccttgtttttttcttaaaacaggtactgagtataaaacattataaaacaatatgagaaggtctctctcttccctcaagagtgtatgactttgctgccccaggatgatcttgaactcc

SEQ ID NO: 583902 - DNA, 521 bp, Homo sapiens
caggtattttattatcttaattatctgtagcaaattttaaaggaacgttgctgggtgcagtggctcacacctgtaatctcagcactttgggaggccaaggcaggaggatcacttgaggccgggagttggagaccagcctgggcaacatagtgagaccccatctctttaaaaaaaaaatgtgtgtgtgtgtgtgtgtgtgtgtattttatttttttaattggccaggtatgatggtgtacacctatactcccagctacttgggagactgaggtgagatgatcacttaaggccagaagatcaaggctgcagtgagctatgattgttccactgctttctagacagggtgacagagcaagactctgactctaaaaaaataaataaggtaaaataaaaataagaagcccagcacagtggtttatgccagtaatcattcccaacatttcaggaggccaagcaggaggatcacttgagctgaggagttcaagactggcctgggcaagacagtaagaccatctctacaa

SEQ ID NO: 583903 - DNA, 265 bp, Homo sapiens
ccgtctatcatctgggaggtggaggtgcatgagccagatggcaccattgcactccaggctgggcaacaagagcaaaactccatctcaacaacaacaacaacaacaacaacaaaaaagatgagtgttagacaaattcagtcgaatgctggcttataacataattgggagaaaaattataattcctatcttaaaaagcaaaaactacttgaacaaaagttaaactgagttaaacaatgtttattagaaatcaagtatttatctgtaa

SEQ ID NO: 583904 - DNA, 956 bp, Homo sapiens
  misc_feature (320)..(320): n is a, c, g, or t
  misc_feature (328)..(328): n is a, c, g, or t
  misc_feature (333)..(333): n is a, c, g, or t
  misc_feature (356)..(356): n is a, c, g, or t
  misc_feature (397)..(397): n is a, c, g, or t
  misc_feature (406)..(406): n is a, c, g, or t
  misc_feature (413)..(413): n is a, c, g, or t
  misc_feature (434)..(434): n is a, c, g, or t
  misc_feature (436)..(436): n is a, c, g, or t
  misc_feature (441)..(441): n is a, c, g, or t
  misc_feature (445)..(445): n is a, c, g, or t
  misc_feature (468)..(468): n is a, c, g, or t
  misc_feature (471)..(471): n is a, c, g, or t
  misc_feature (483)..(483): n is a, c, g, or t
  misc_feature (485)..(485): n is a, c, g, or t
gaagcgccggccagagaagagtcaagggcacgagcatcggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtacccatcaggaagcagcgggataagctgataaaggaaggaaagtacncccctccncctcnccacattggcaagggggagcctnggcctgaacagagcagctgctgatgtctggaggctgaacanagcagctgntgatgtntggaggctgattttcctgttntntgttntccnctggaaaggttgtttacgacaanccnccttgtcaaagngngtaaaaataaaggattgctccatcctaaaaaaaaaaaacaaaacaaaaaaaaaaaaaaaaaaaaaaaaaacaaagagagaaaaaaaaaaaaaaaaacggagagaaataatgggggggaggaaaatcggcaaacaacggagaagtagaaaaaaggagagcgcaaggacggaggctcaggaaaaagaagaaaagaaagcgggcccacgaagagggaggagaaagaagaagagagagggagagggtaaagaacggaggacgcagagagggaccgaccccggggcgaggaggaagcagcggagagtcacaagggaaaggagagaagagccagtgaaggacagcaagaacgagcaggcagcgcgcgcaaggaagcagaggaagagacaaagaaagaacaggggcagagagggagaacagacgagagagaggcagaaaccatcggagcagccggcagacggacagtagagcgagcaa

SEQ ID NO: 583905 - DNA, 744 bp, Homo sapiens
gcccagcctgcccgagccatgccgagcggagccggagccccaatgccctgagtccgcgcggagaccgagcagagccctccagcctgctcaccccgcgtgcctaccccaggcgacctcagccgctctctgcccttctctcggccccgcgccctgcctcgctggccctctgcccaatgaaactggccgcgatgatcaagaagatgtgcccgagcgactcggagcttgagtatcccggtcaagaactgctatcgcatggtcatcctcggctcgtccaaggtgggcaagacggccatcgtgtcgcgcttccgtcaccggccgcgttcgtaggacgccgtacacgccgtacctagtcgaggacgttcctagcgcgtcgaacgttctacgtccatccgcggcgaggtctaccagctcggacatcctcgtacgacgtccgtgctaaccatcccgttccccgccatgcggggcctctccatcctcacaggagacgttttcatcctggtgttcagtctggacaaccgtcgactccttcgaggagagtgcacgcggtctcaggcagcagatcctcgacaccaatgtcttgcctcctagaacaaaaccaaggagaacgtggacgtgcccctggtcatctgcggtcaacaagggtgaccgcgacttctaccgggaggtggaccagcgcgagatcgagcagctggtgggcgatgacccccagcgctgcgccctacttcgagatctcggccaagaaga

SEQ ID NO: 583906 - DNA, 441 bp, Homo sapiens
tttcagaggtcatgcactctggagagagaacaccagacatgttagagggcgaaaccactccgtggtgacacactgtggagtcctggccaccagccggacacattcattcaaaattaaaaccttaaggcccaggtccagtccccctctttaaggaaaaggtgggaacggttcttagaatggaggggaatggatcccctttccaggccacccggtaggttttaatgggcaccactacttgccagaggttattgtaaacgggagttaactggtctttggtgccctttaccttaaaggaaaaagaaccctaaggttcgatctacaaaataaagagttggtacggtcttctttccggggccttcatttccttggcggtttggattctgtggtatttttctactaagttaaaaaccacgggttggattcaacagggttttgggtggt

SEQ ID NO: 583907 - DNA, 927 bp, Homo sapiens
  misc_feature (320)..(320): n is a, c, g, or t
  misc_feature (328)..(328): n is a, c, g, or t
  misc_feature (333)..(333): n is a, c, g, or t
  misc_feature (356)..(356): n is a, c, g, or t
  misc_feature (368)..(368): n is a, c, g, or t
  misc_feature (377)..(377): n is a, c, g, or t
  misc_feature (384)..(384): n is a, c, g, or t
  misc_feature (405)..(405): n is a, c, g, or t
  misc_feature (407)..(407): n is a, c, g, or t
  misc_feature (412)..(412): n is a, c, g, or t
  misc_feature (416)..(416): n is a, c, g, or t
  misc_feature (439)..(439): n is a, c, g, or t
  misc_feature (442)..(442): n is a, c, g, or t
  misc_feature (454)..(454): n is a, c, g, or t
  misc_feature (456)..(456): n is a, c, g, or t
gaagcgccggccagagaagagtcaagggcacgagcatcggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtacccatcaggaagcagcgggataagctgataaaggaaggaaagtacncccctccncctcnccacattggcaagggggagcctnggccctgaacanagcagctgntgatgtntggaggctgattttcctgttntntgttntccnctggaaaggttgtttacgacaanccnccttgtcaaagngngtaaaaataaaggattgctccatcctaaaaaaaaaaaacaaaacaaaaaaaaaaaaaaaaaaaaaaaaaacaaagagagaaaaaaaaaaaaaaaaacggagagaaataatgggggggaggaaaatcggcaaacaacggagaagtagaaaaaaggagagcgcaaggacggaggctcaggaaaaagaagaaaagaaagcgggcccacgaagagggaggagaaagaagaagagagagggagagggtaaagaacggaggacgcagagagggaccgaccccggggcgaggaggaagcagcggagagtcacaagggaaaggagagaagagccagtgaaggacagcaagaacgagcaggcagcgcgcgcaaggaagcagaggaagagacaaagaaagaacaggggcagagagggagaacagacgagagagaggcagaaaccatcggagcagccggcagacggacagtagagcgagcaa

SEQ ID NO: 583908 - DNA, 1186 bp, Homo sapiens
gcccattctaggatatacctgatgcttagcgtcagtcgagcacttgggaatccctgtattgtgccatggtgtctcaagtctcaggatgattacctcggagatttcagaccacatggagtcgttgtccctggctcgctgcccttgttgacgagggacacgcgggaccgaagttgctaggaccgaacgcagtatcacccagatcgagagaattgccgagttgcttatcgcacgcagaggctagacgtcggtgtccgctattgtacacaggctggtagcacagaatcagttgcacttgccgatcctagtctaactttaactgactagcgcatcccctgattcaggacatcatagatcactctggtggttccaccatcttcgttcacggaggttaggtctatctcgaccgaattggtctgcagattcgctagtgcaatagcccgttgctccgctggtacgcaacatatgtccgacggccgtaagacgtggaccttcgggacgcttaatcaattgtcccaatgcagaaccggtggggtcgtaaaaggtcgtgtcaccgaggaccgtaatagctgaatcgacacacggtccggttgatttgctgattaccaatagcggtagtttccaaaggtcatcttccaaatacgaattgcccccggttgccagcacgatgtgccatacttggggacaggaaacatagagcgattctggtcaaagcttcctacactttgtaaccctatggcacagaggatcgaaaagaggaggccgcttcacttagacgttctatggtagatgttggacaccactcctcgtccactacgcctttacatacacaggcgccgtcaccgacgagctaattcgaatcattcgggagaacccttttttggccttaagacaaaaatttcgactccaatagtattcggccgtagggacttggaagtttaaattcgcttaacacacttcaggccccctgtggtggtttacatcgtttgtgccatccactgttggaactactttttcgctcaaaggtgcccacacctatagcgatggcccagtagtaatacggaagctaaacaggcaatcactgtcatcacccgtgaaccttcatgtaaggcgcaatactcgtacattgaactccaagtgttttcgctacaacatggagtttcagatgaatccaccgttcttgaaaaac

SEQ ID NO: 583909 - DNA, 211 bp, Homo sapiens
tatatgtctggattgatccattattaaaggtttctcatttatatgcatagaggtgtttatagtattctctgatggtagtctgtacttctgcgggattggtggtgatatcccctatatctttttattttttttttattttttttttttttttttttttttaaaaaaaatttttggtttggccccccggggggggcgcaggggggggggaccc

SEQ ID NO: 583910 - DNA, 885 bp, Homo sapiens
gtaagctacagaaacctgtagcaacatggcacgacatatccaggctgctggctcccaatatacgcctgcactgcccatagtcttggaaacttgttggctttgatgtttccgggatccagcacgactggtcctaccccatcctcaggactattttccattcgtgaggaccggcctgaaagtacagcgtggtaggcccgttccgctgagtaaacttctaatcacgtgccaggaagctcagtatcagattcttcgtagaggtctgtgtacatgttgacacggtactatcttcgtcaagacgtacatcttttctgtatacatatggttcccctcatgctgatgactcgagtggctatactctactcactgactggcacttcttattctcctgtgggagtttgccaggccggatactaacattacatgtgcttcatctagcgcatctcaggcttactgcacctcaggtctccactttggagggcatactgactgaatccattcgcagtgactgagtgtctggactggtcagattgattcgtatgtaagtcttagaggagagtataaggctaatacatagaacgatcctcactgcagagaggtaacacactcgtttgtaaagaattctgtaaccaattaccaggatgttcacggctgtgagtctgggctccctgagtttcttgaagctagagacaatgttgtgtcttcccaaagcacactttgccattcccctagatccctctcatactcatgggatgcatatctgccggttcaaggagcctggttgtccactggatgggttcgacctttgccctggtgttcctttggtgcctggaggctttttggacaaaaaaggtttacttgacgttcaacacatcacaccacacgagg

SEQ ID NO: 583911 - DNA, 1527 bp, Homo sapiens
tatattgtttgtatatattattaatatatatattactcacaccactcggcagagagaagagagagaggagaggagaggaggaggagggagagagagagagagagagagagagagggagggcggacctctcatctggtaacaccccacaaaacaaaaacacaaccaacgccagcacgaaaacgaagaatagaagagaaagagagagagagagcgagcagccccacacgcccaagagagagagcacgacaaaaagagagagatgcggatgtgcgagcgtcactaagagagagagagagagagagagaaggagggcgagcgaagagcgcagagacgcgagcgcgagagagtggacgcgggagacgagacgaggaaagagagagtgaaaaaaacgcagaagaggagacaagagaagagagacgacgagagtcgaaagcacaacaacaacaccagacacgagagaggaagcgggaaaggaagaagggaagcacagcacccacgcgagaacagaagacagaagaacaagaagagaagaaaagcgagagcacgcacaccaacatgagagagagcagaaagaagcagaagagagtagagacagagggaagagcagcaggagccgcaacaaggaagtcagaaaagaacagagaacgaaagaccagcgaagaaaaggacacgagacacgagcagagaagagaagctaccaaacgctagcaggagacacagacgcagggaagagagaggagaagagacgaagagagagacgaaagcgaagagagagtggacaggagaaagagagaagaaaaaagacgagagaaaagaaagagaaagaagagacggaaagaaaccacaaacgaaagagagaaagaagagaacgacgaagaaaaaaaagaagagagaaaaagacaagcacaagaagaacaggagagagaacacgaaaaacaagaaccaaagcaacaaagaaagaaaacagaggcacgacaacaagtgacacaaagaggagaaacaaaagaagatgcacgagacagggacggaggaggagagagcgacacgaaagagagaaaggagcgagaaaacacaaggagaagaaagaacacaacacgaaacaacaacaagaaacaaaagacagaaaaaaaaagaacaaaacaacggataaaaaataaagagagaagagcaaaggacaacacaacaaggcagggcaacacaacagaagggaaagaggaacgaaaaagagagtagaggagacgaagtacaacacacaagaacaggaggacacaaaccagacggaagcaaacacaagacgcagaacgagaagagcacgcgaagaagaccaaacaaaaacgagccacacgaaaacaagagaaagaacacacgcgagagcaagactgagtaaagctcaccgacgaacgaaaagacaaagcaagaaaggaaaaaaagaaaaacgatacacgcagcgagaggcgcgaagggcgcgacgacacaaaaacaaaaagcacacggaagagagaacccaacaggatggggagcaaaaac

SEQ ID NO: 583912 - DNA, 102 bp, Homo sapiens
attgctcttacatgacattctggaaaacaggagaatgttatcagactatgctatggcagcccaacccgccgagtccttacctggctgtatgccagcctgatc

SEQ ID NO: 583913 - DNA, 135 bp, Homo sapiens
ttttggacattatcttggcaagaatggtaagtcttgaacttgataggaatggggggggttcaagcttttaaaatgttctttttatctaaggtgtgcagggtgtgtggatagcaagtttgagtgtgattctggccg

SEQ ID NO: 583914 - DNA, 513 bp, Homo sapiens
tctactgcatgtaacaatatcagccctactctgaagtgcgtgctgcctttatggttctacccagggtcagtgtaccatagtgaagtgtgtcatacctttctgtctctttgcactatgaaaaaatgctcaaagtattagatgtagccactgtatgttgtgtaagcatttgtggacataatgcaaaataaaagtaatacagtgcttctgttttagaaagaaagaaaaggccggcacggtggctcatgcctgtaatcccaatactttgggaggccaaaggtgggccaatcacttatggtcaggagttcaacaaccagcatggccaaccatggtgaaaccccttgtctctactagaaatataaaaattagctgggtgtggtggaacaacctgtaattcccagctacttggggaggctgcggccacgagaatcacttgaacctgggaggcagaggttgcagtgagccgagatcatgccattgcaaaccagcctgggcaacacagtgagactctgtctc

SEQ ID NO: 583915 - DNA, 454 bp, Homo sapiens
  misc_feature (30)..(30): n is a, c, g, or t
  misc_feature (34)..(34): n is a, c, g, or t
  misc_feature (90)..(90): n is a, c, g, or t
  misc_feature (334)..(334): n is a, c, g, or t
  misc_feature (336)..(336): n is a, c, g, or t
  misc_feature (453)..(453): n is a, c, g, or t
aatctccctgggaaaaaaattcccggaagnaagnaagggcccacccatctttgcctgtttgggcgaccttagctgttcccggcctccccngctttggaaaagccccacacccaacccaggggtggaaagcagtgcccccagcacagcacagctgatctgtgaaagcatggacagactgcttctttaagcagttccctgatcccgttcctcctgactgggtgagacctcccaacccagggtctccagccttgtcctgcaggcgcatttgggctggcaacaggtctgtacctcgctgggccggagctcccagaggaagaggcaggatgacatcttntntgtttcacagccttcactggtgatagctccaggtactggaaaatccaaggagactaggaactggagaagaagcccagcaaagtacagcagccctacagaaacatggccagactgttng

SEQ ID NO: 583916 - DNA, 104 bp, Homo sapiens
gcggagaggggagctagaaacggctaccacattcaaggaagcggcggggcggctgagaatgaacgtggagaagaagattgacaattacacagagttttgtcttg

SEQ ID NO: 583917 - DNA, 933 bp, Homo sapiens
tctgctcgcctaatgccgagcaacatggtgttcaggcgctacgtggaggtgtccgggtggcctatgtctcctttggacctcatgccgtaaaataggtcgcgctttgtagatgtatctcgatcagaacatgggcttcgggtcgatgggaccttgctcttcaacgtgagcgatgactaggcctattgcctttcaaggttgcattgcagctcagcttgtttgtcatcctcaagtttctgcacagtgtccaccaagaagttatgtccggataagcctggagggacgtgctgaacaatctaatgactaagaatggtgctgccaagtacgataggcccacctagagaattgaaggccaggacgaaaagggggtacccgatggatcgtaaagattcagtttcgaattaaaggttgtattgacatgggcccagggccaacatggaggaacagaactaaatccacgaatagagagtctaaggaagctgcaaacagggagttctccttgatagacttctgctcaaaagaaatgtactttggcaactcagaggtgtgtactggttgctggctagattgctaagtgctgctgagaagcattgattggttccgggttccctgagagggaaaagatcctcggcgatataagcatgttccagcccgattgttcctgcccgagagtcggaggtccagaaggtaagtggtgttcgaaaagcttagaggtggtcaatgggtcatgaccagaaatgagcagtgtccaaatggctttcgtaccacacgcatgggtggcctcattacccgtttacaggttctgctggcgtgcaaagagaatgggacaacacaaggggtctgtgggcgagcggcggaaatcaaacactgtgtggggggcccgggaaaaaagtgtatagttctgggaagcggggtgggggtttccacaagcgcggg

SEQ ID NO: 583918 - DNA, 576 bp, Homo sapiens
  misc_feature (48)..(48): n is a, c, g, or t
  misc_feature (72)..(72): n is a, c, g, or t
  misc_feature (125)..(125): n is a, c, g, or t
  misc_feature (134)..(134): n is a, c, g, or t
  misc_feature (142)..(142): n is a, c, g, or t
  misc_feature (194)..(194): n is a, c, g, or t
  misc_feature (212)..(212): n is a, c, g, or t
  misc_feature (229)..(229): n is a, c, g, or t
  misc_feature (290)..(290): n is a, c, g, or t
  misc_feature (293)..(293): n is a, c, g, or t
  misc_feature (298)..(298): n is a, c, g, or t
  misc_feature (328)..(328): n is a, c, g, or t
  misc_feature (330)..(330): n is a, c, g, or t
  misc_feature (334)..(334): n is a, c, g, or t
  misc_feature (340)..(340): n is a, c, g, or t
  misc_feature (361)..(361): n is a, c, g, or t
  misc_feature (380)..(380): n is a, c, g, or t
  misc_feature (392)..(392): n is a, c, g, or t
  misc_feature (430)..(430): n is a, c, g, or t
  misc_feature (445)..(445): n is a, c, g, or t
  misc_feature (459)..(459): n is a, c, g, or t
  misc_feature (534)..(534): n is a, c, g, or t
gctcctaactccttctagcagcccccgctgccaactccctccttcctnagggacccggggtttgcctcttgncaggaaggtagactctggcagtgtccactggctttagggagtcccctcccaancccatcttntgggttanggccctgccctatggcccgcacaggacagtcacaggacactggaaaacacancagggaacaccctaccangttaaggaaactgagtnatgagtaacaacaggggtggaacaccaaagcacaaagctcctcgggagcctcaggcagggnaancccgntccgtcctgggtccaatttcttcctcccanantcanggtcancatcgtggtcaaagggtgagngtcagccttgccctggtgnttccttcctgtnatctcctgggaatgtgctgggggattccggggaggagntgctcagagaagaanacacacagctccanaagaacaagcagccactggcctagatctacacagggaaagcagaggtggtgctcatgacgcgggacaccagtgancagagcctgggctcacaggaagctcacagcatgtgccttggg

SEQ ID NO: 583919 - DNA, 572 bp, Homo sapiens
ggtcagaaataggaaggtagtgattactcacagtttcaggaatctgatgatgcagatgaagatgatggaagagattcgggcgctcccactaagagaattcgatcatctccccgagaagctaaagaataagaggcgatctggaaagaatgcacaggacgatagtgaggactcagaagacaagatgtgaagaccaagaaggatgatctcactcagcagaggatagtgaagatgaaacagacagatcatgaaaatgtgcgccaacaacggcaggcggcatctggaagcaacgtgttctaaacggagagagatgctcatggaagatgtgggcagtgaggaagaacaagaagaggaggatgaggcagcaattccaggagaaagattccggcgagcgatgcacgattcctaagtggaagatgatgacgatggtgactatggcagttcgaagaaagataaacacaataatgactggttaagcaccgtccaccccctgagtactaatagatataaacatctcagccatcccttgtggggcgttgtgtgaaagatgggttgtgaggcgtgcgagttggcag

SEQ ID NO: 583920 - DNA, 489 bp, Homo sapiens
  misc_feature (94)..(94): n is a, c, g, or t
  misc_feature (196)..(196): n is a, c, g, or t
  misc_feature (204)..(204): n is a, c, g, or t
  misc_feature (290)..(290): n is a, c, g, or t
  misc_feature (328)..(329): n is a, c, g, or t
  misc_feature (371)..(371): n is a, c, g, or t
  misc_feature (375)..(375): n is a, c, g, or t
  misc_feature (399)..(399): n is a, c, g, or t
  misc_feature (404)..(404): n is a, c, g, or t
  misc_feature (429)..(429): n is a, c, g, or t
  misc_feature (485)..(485): n is a, c, g, or t
gtgcttgctttgccctccgcccccctcgtcgcccccgctctgcccgggggtccgcttctcggggccgtggctccccgctctgtggcccctcccnccgtcggccgcctccgtttcctcgactttctgggagactcatggggccttctcttctcccaccctcgggactttaccccagtgtgcaccacatagcttggcngagctgcnttgctggctcctgaatttgccaagaggaatgtctcgttgattgccctttcattagacagtgttgaggaccatcttgcctggagctnggatatcaatgcttacaattgtgaagagcccacagaanngttcccttttcccctcctcgctgataggaatcgggagcttgncctnctgttgggcctgctggatcctgcngaganggatgaaaagggcatgcctgtgacngctcgtgtggtgtttgtttctggccctggtctcaagctgctgctgtcttgtctctncccg

SEQ ID NO: 583921 - DNA, 392 bp, Homo sapiens
ttcggcaaagggaacccgggaggtggaaattacagtgagctgagattgcaccactactccagccgggagacagagtgagactcttgtcttaaaaaaaaaaaaaaaaaaagtttattttgtcaaggtttaggacacgtgcccctgacacagccttaggaagtcttgatgacgtgtgcccaaggtggtttgggcacagcttggttttatacattttaaggagacatgagaaataaatcaatatgtgtaagatgtacattggttccatcttgaaaggcaggacagcttaagcagggatagtgtttctaggtcacaggtacatgagagacaaactgctgcattcttttgagtttctgatttgtctgtccaaaggaggcaatcagataatcagatgt

SEQ ID NO: 583922 - DNA, 879 bp, Homo sapiens
ctggggagtttattgctttccacaggggattgcctgtcccccagcactctagttgttaagcctttagttaatgaatgtagcctgacttgtggcataccatgcaatgcacccagctactcacaaccgcctaatttcatggcaccacatctgtgctatacctccctccctctgatactctctgaaagtcatgcacattacctactggctgactttttacacatctcaccagctgtaaaatgctatgtctctatccatcagagatagtcatgtattctatttctgaaggcagcgaacaagacaaagcagatacacttgttgccgtgacgggatttgctgaaccatgtatctaatcctcccatttggacagtataggtgttttgctttgtttgttttctttttttaacgcaaaaaccttgtaacctttgacactgacagatgtgtttgcaaggatatcggctgcagtattacatgaatttccatgtgtatctggaagtatttttcaaatggcataccaaaatccagaagtttaaagatgcctataaaagtaaacaacatttatttaaaaagaactctgtatatgccttcttttgttgaactatgatatatcttcgagacatgggtgtttgttaataactaataagctggagtaagctacaggatctccaagaacagccctttttttacagtcatacgttctaggagtagacgcgaaactaattgccaaaatatccacttagaggcaaagaacaattttgttacttatctaaaaaggcttcagcacattgttgtggcaatattgtatctgtttacgcaaatgggcttttccgaaagcagacaaagataggttcctcagtgaccaattaacgaaatctatatttc

SEQ ID NO: 583923 - DNA, 792 bp, Homo sapiens
gccatttgccgttcttaaattgtcatcattggctaggggacctggctctccatataaatgagaggagaccattagtgcacatgagttggatggtgcagatctactactcaaatgaaggatattttggctcgcttgtgaccgatctctttgactttccagatcaggataatcaaataaaatgataagatacgaagagtgaatgtataacatggtcagcatatagttgatttactgcctaaggttgttatagtgtgttgaagaatgattcttgctactgagtataaattctgtggtacccgttcttagaggtcaactgtttatctatatgtgaatgctcaaggaatagttagaatagtctggaattggggaattgatagtagcaagctggaatttgggtcatggaaaatgctgtgtaaaccagtagcaagacgggccaatgcttggagtcaagccaggcccagatcattcaagctctatcttcttggtcttttctttctttctttcgtgcacttcctggactttcaactcacatggcgccttgggaagacaccttcactgtttgaacactgccttggagaaggcggaccgagcaccttcctggagctagagcatcataagcacttactttcgcgggcgacatcggcactggtggacacgggcttcccatcattttaagcccagagacaagctgggcttcccacaaatttctggcgaccaactcgctgatgtactcatcctcacgcgggtcccaatggtgggaaaatctcccattccacccgggcatcaatagca

SEQ ID NO: 583924 - DNA, 164 bp, Homo sapiens
tcctcagtggcccccttcagtcccactccagctggcaaggtcagcatcaggaaaggcacggagggctgggcctggcccaggacactcagaccaggaccctcttccctctggaccctgccccatcacttaccagccatgtctcttcattcgtttatccaagaagg

SEQ ID NO: 583925 - DNA, 934 bp, Homo sapiens
cgcggtggctcatgcatgtaatcccagcactttgagaggccgaggagggcggatcacaaggtcaggagatggagaccatcctggctaacatggtgaaaccctgtctactaaaaaatacaaaaaaaatttagccgggcgtggtggggggcgcctgtagtcccagctactcaggaagccgaggcaggagaatggcgtcaatccgggaggtggagcttgcagtgacccgagattgcgccacggcacgccagcctgggcaacagagcgagactccgtctcaaaaaaaaaaaaagaaatttacttcatgaccacgtggaatttaatcttggaatgcaaccgatggttcaaaattagaaacacaaacattcaccagaatacagcacatttaccagaataaggaccccaaaaaacttacttgacctacacactttgggtcacacacccttctgacaatcgtcaactaccttttcattgactgaaaagaaagacctcaacacactaggattacacacgagctccctgccacggtatgtgggctcacaccctgtatccagcacttggggcggccacggggcgacgactgctgagccccagggagtctggaaacacccccttggcaactgtcgacaatcttgctccaccagagacttacacaatttgccacgggttagggcgcacccggagaccagcactggcagctgagcggggaggactacctgacccaaggtctagacagccatgggaatggagccggccgtcaaaggtaaacacgagctggggcaacgcggacagcataggcagcagggggattgcgccgggagcgcgacaatcacgggcagcagagagagccgccatggggcggggaacacacgaggagacagcgctaaaaaggcggccacaagaaagagggcgcacaaaagcagacaagacacacctc

SEQ ID NO: 583926 - DNA, 358 bp, Homo sapiens
taggcggtcgcgccaagtcgtgaatgcgagacccaggaggagctgggactacaggcacccgccaccacacccggctatagagtagtagtatagtagtagtagtagtagtagtgtagtagtagtgtagtagtagtaatacaaacgcaaaagaacagggctgtccccagtagtatagatagagacagtacaaaaaaaaaaagacaagaataaacaacaaacataaaaaaacagcgaaacaaccgcataccacagtgaatgtgatatgatgtgatgagatgtgatgatgtggtagcaatgataaccacaaccaaaagacaaccacaacaacacagcgcatataaaccaaaccaaaaacagc

SEQ ID NO: 583927 - DNA, 197 bp, Homo sapiens
tgtattgagtggcatgtgatggcggtgaacagcagtgaaggatggtgagcgaaagctcagctcaagccaaaacaaacgtggaccagaagagtgtgcagttgcaagatttaatagagtgaaaacagagcttccatacatgtgggacggggaaccaagggtggtggcccatctccctgcctcaagatgcctggaggttt

SEQ ID NO: 583928 - DNA, 130 bp, Homo sapiens
ctcctgaatgcatgtgtctgggatttcatccatccgtacattgaagttgacttactgaagaatggagagagacttgaaaaagtggagcattcaggacatttgactttccattctcttgctggtggaaggg

SEQ ID NO: 583929 - DNA, 367 bp, Homo sapiens
atttttagtcccaaattttaataatttgtaaattgatctcttattccaagaatcctttgaacttgtagaacatttgggagtccccttccctgtcctcttcctgatccctgctttttggactgtttaaatcctctttgggatggatcaaaaagtttaaaaaggcccctcataggtccagctggtggcctcctgactttccaaagccttcactggaattggggcatttgctccagccctagctgtgaacatgaccaaagacattatttataattcagccctttaaaaaaaacctggactcaaaaagtcctggatatttttaaaaagttttatttttcaggtgaacaaaaaaacatcctaagaactttga

SEQ ID NO: 583930 - DNA, 326 bp, Homo sapiens
cccccatttttttttgggcccccggggggggggtttccccccctttttcgggggttttggggggccgggggggggcccccccccttggttttttttttggttccccttggggaaaaggggcggggggccccccttttaaaaaaccccccccctggggggggaatttttttttttttgctttttttgcaaatcccggccccggggggggggggcccccccggttttttcccccaaaatttttttggttttttttttttttggaaaaggggggggggggggggggaagtttgttttttttttttttttggccccccccctttttttta

SEQ ID NO: 583931 - DNA, 326 bp, Homo sapiens
aaggccccaaaaaccggagggaaacccccccccctttcgaggggaattacaaaaaccggaggagccccttttggcaaaaaaaaacctttaaacaggggagggcgggttttccgtcacaacttttttttgccccccttttgttcccctgttttcacattttagggtcagggtccaaccttggcagcctttcttttaaatggaggaacccattaatttttttctggccttttaaaacccttttgttcagtccccctttccccccatccgggataggccctgggggtacaactggttttgcctttttttataaaataaggttgggggga

SEQ ID NO: 583932 - DNA, 120 bp, Homo sapiens
attgatgctggtacccctagcacttcttacaagccacctgctccagaaggcacagcctgaccctcccaatgttgaatataaatgcccaatgtgccacatgaatgccatgtgtgactcctc

SEQ ID NO: 583933 - DNA, 354 bp, Homo sapiens
ctgcctgccgtattcgttacttggtgctacgaccgcttactgcctacattctcatgggaatgtctgaccatcctgacagacatcctacacctatgttctcccagagagcttcggaaccccactcccagacaccattgaccagatgctaagagtcacaggaatgaaacacagaaaaattccaagtcacacaaggactgtaaaagatggtcaacgaaaggaccacactccttaaaagcacagacatcttttatcgcttccagtaaaggcgcacactgcagcggcacagacagtcttgccagaaatggccagcttgtgcacgactccgaatcctatcgtgacaaaggcctacgctgc

SEQ ID NO: 583934 - DNA, 165 bp, Homo sapiens
ggtgaccgggatgttctcgacagaaccaagaagcatctccaggagcggctgatagagctgctcagggacaaggatgctctctggcagaagtcagatgccctggaataccagcagcagctcagtgctgagcgagagcatggcacggagccacagaggcaaaccact

SEQ ID NO: 583935 - DNA, 181 bp, Homo sapiens
gcgactcttacggttccttcataatattttaataatatccgacactttgatagaggaaaattcaaagctgtgccttcgacgcctatactatactgtgtatgtgtggaaataaaaatgtactgcactttaggagaaatttttgctggcatttatctgttagatttgtagaaacttgcgaggt

SEQ ID NO: 583936 - DNA, 565 bp, Homo sapiens
tctgagatggtcttctgggccatggagaatcctgtccctcatgctctgtgtctggaatcgcccaggccttctggattttgcaccatgttcttcgaggccatccttgcagcccttcacacgctccttgataatctgacgctccttgtcccggagcttgactcccggctggaacacaggtagattcttctctgctgctgtactcagtcccctttccccagctgcgctggtaggtctggatcttgctgctcaatgttgctcccggaaggagcgctcagaagtcttctgttgtcattgccaaccagctggatcagttcagacttatccagggccttgcggatgtcacttgtagtggtggtgcaggacgcatggcgctcagagctgggtcctcgtacaccttggacttgctcagcacagtcaacttgcaggtttgcccagcactttacagatatcggtgcttagcagccgattgctgcactcagagctgtagctggtggccgaagagctggtctcttgggaggccagcctggcgcctgcggtctcctggaggtccacacgctggtgcagg

SEQ ID NO: 583937 - DNA, 196 bp, Homo sapiens
aatagacaagtgaccgtgtggtgtgcgcggtggcactgcgctgcgaacatggccttggcgtcagacataaggagctcatcggcgaaatacgccatgcgagacctagtccacaggcttccaggagggaacaacagcgacaagactgcaagctaggccaattgtcggggtgacacacgtcgacagctggtctgcgtgc

SEQ ID NO: 583938 - DNA, 373 bp, Homo sapiens
  misc_feature (215)..(215): n is a, c, g, or t
  misc_feature (219)..(219): n is a, c, g, or t
  misc_feature (261)..(261): n is a, c, g, or t
  misc_feature (263)..(263): n is a, c, g, or t
  misc_feature (309)..(309): n is a, c, g, or t
  misc_feature (336)..(336): n is a, c, g, or t
tatcgccaactgctggaaccacgtttaaaagcaaccggccgttaatgtctgggtacaggatggcaaccgccgtggataaactgaccgctgaacagcgtgaacgttatttacaggccagcgccgattgccaaagtcccgcccctgccagcggcgttgtttatgaactttttgtcgccggcaaaggcaaaacctttacagcgaaaccgaaaccggangcanaaattgcctcgctgttagcgaaacgttcctcttgcggtaaananactctctatttctctctgcgctatttgcccgtcgcgcacggcattntcgagtattaaatctcctccaggtaantcgggtacgacctggcttacctctttcgctctcatta

SEQ ID NO: 583939 - DNA, 148 bp, Homo sapiens
gcggccgcctactactactactactgctcgaattcaagcttctaacgatgtacggggacatgctcttttgtcacctgctaattgccttactagtaatgaattctgatgcatgaaaccccaataaatatcctcattgacaaccaaaaaa

SEQ ID NO: 583940 - DNA, 817 bp, Homo sapiens
  misc_feature (19)..(19): n is a, c, g, or t
  misc_feature (81)..(81): n is a, c, g, or t
  misc_feature (85)..(85): n is a, c, g, or t
  misc_feature (87)..(87): n is a, c, g, or t
  misc_feature (123)..(123): n is a, c, g, or t
  misc_feature (129)..(129): n is a, c, g, or t
  misc_feature (204)..(204): n is a, c, g, or t
  misc_feature (250)..(250): n is a, c, g, or t
  misc_feature (274)..(274): n is a, c, g, or t
  misc_feature (311)..(311): n is a, c, g, or t
  misc_feature (320)..(320): n is a, c, g, or t
  misc_feature (329)..(329): n is a, c, g, or t
  misc_feature (347)..(347): n is a, c, g, or t
  misc_feature (392)..(392): n is a, c, g, or t
  misc_feature (405)..(405): n is a, c, g, or t
  misc_feature (444)..(444): n is a, c, g, or t
  misc_feature (497)..(497): n is a, c, g, or t
  misc_feature (502)..(502): n is a, c, g, or t
  misc_feature (529)..(529): n is a, c, g, or t
  misc_feature (591)..(591): n is a, c, g, or t
  misc_feature (600)..(600): n is a, c, g, or t
  misc_feature (602)..(603): n is a, c, g, or t
  misc_feature (609)..(610): n is a, c, g, or t
  misc_feature (615)..(615): n is a, c, g, or t
  misc_feature (626)..(626): n is a, c, g, or t
  misc_feature (629)..(630): n is a, c, g, or t
  misc_feature (635)..(635): n is a, c, g, or t
  misc_feature (653)..(653): n is a, c, g, or t
  misc_feature (656)..(656): n is a, c, g, or t
  misc_feature (741)..(742): n is a, c, g, or t
  misc_feature (784)..(784): n is a, c, g, or t
aaactgctccgcgcgcgcnggggaggaggaaccgcccggtcctttagggtccgggcccggccgggccatggattcaatgcntgancncgcgtcccgctgtcttctgcttcttcccttgctgangcagcngctgctgctgctgccggccccggagctgggcccgagccaggccggagctgaggagaacgactgggttcgcctgcncagcaaatgcgaagtgtgtaaataatgttgctgtggagctgaagtnagcctttgaggaaaccggcaagancaaggaggtgattggcacgggctatggcatcctggancagaaggcntctggagtnaaatacaccaagtcggantgcggttaaaagaaataaactgaaaacattgcaaaagctcctggnatataacctgcanaaggagaggacggcagcaatcgatttgccaagggatgtnagaagacctttgagacattacacaacataggtacacaaagggtcaagtggtgnatggnacatcccctatgagctgtggaccgagnctcctgcagaggtggctgacctcaagaagcagtgtgatgtgctggtgggaaaatttgaagcngtgatcgcngnntggtcnnagcanccaccagcagnaannctgtnctgaatcctctgcgccanccncgtgctgaagggaaaagacaccagttgcctggcagagcagtggtccggcaagaagggagacacagctgccctgggagggaagaanncaagaagaagagcagcagggccaaggcagcaggcggcaggantagcagcagcaaacaaaggaaggagtcgggtgg

SEQ ID NO: 583941 - DNA, 305 bp, Homo sapiens
atcgtaggagtaccatccctgtctacatgtatcaagacgaagataatgactgcgaacacttaatccgaatcatatttatttagagtcagaatggagcgatttgtagtaccagcaccatctgctctaaaccgttctaagactgctttgtatgtcactcccctggatcgagtcactgattttggcggtcagctgcattaagatagatgaaaactcttctgcacttcttgcactgtggttctgaatcatgtacgcgagtctgccattagtgaccacctctagtctaagattcttaccaagaggaaggc

SEQ ID NO: 583942 - DNA, 133 bp, Homo sapiens
acaaaatgtatgtgaggcgtatgtgccaaaatgtgacagactttaactggtggacatgtctacacactgacctgctttttaatatacttcatctgtttaaaagtatataataaacatgtttaatgtttgttta

SEQ ID NO: 583943 - DNA, 442 bp, Homo sapiens
tatctggtaagcccgggacagtaagcccagtggctggtggagtccgtattgttggtaatggtggaggaagaaaagcctttccccttaagcttgggtggggccgatccgtgttgcttgccttccaaaaaggtggggagtgaatgtgcacccttgggtgggcctgccaccattccacttaaagttacaaaaatgcttcatggaccgggggttggtactataatgttcctcatggccaacaaatggaacccggagacatggaatcccttgccagggtgaatcctaacattgcaggaggggaaaccctgcaagagagagcccgcctcaattgatgcctgcagattgaatttccagaggcttaggaggaggaagttctccaatgttctgtttccaggccttgctcaggaagccctgtattcaggaggctaccatttaaagtttgcac

SEQ ID NO: 583944 - DNA, 402 bp, Homo sapiens
  misc_feature (36)..(36): n is a, c, g, or t
ccctgttgcggtgccctttcccactcctcttggggntttatgttatgtgggaaatggactaaaagcattctttgtggtttttctatgctcttgttcagcccattcttacctgttaaagcagtctgtttagagaggaaaaagcagcaatattaggtctcattaacgtttctgactgtggcaaaagtcttaacatagaccacacttcagtatgtagttgcattcgttgaaagataacttgctttctcttaagccttgacaatatagtttaacaaactcctgtgttttataaagtgttctttaagtttggcagtttcttataaacatacacttaccctacatcccagcaatcccactcctagctatttctccaagaaaaatgaaaaacatttctctacaaaaaga

SEQ ID NO: 583945 - DNA, 664 bp, Homo sapiens
  misc_feature (90)..(90): n is a, c, g, or t
cagcccatcgatatcacagtagactacaactgctggttagcatcagagttctatcaaagtagagcccgctctgtttagctgccttattgnctatgtcttgactatctttgtcagtgatatcatggatatgcaccgtgtctatgcacggttgctgccactgtgctctaagctgggctgccttctcggtcaggttagcaatctttagagactatgaattagatatctcctgcgtagatcgcacacttgagtcatgtgtcaacatcgatgcttcatgtgccagaatctattccaacattatcctggacttcacagtagcagcgtctatcatatctggctctgatgattcctcagcattatgagtgagttggtcagccttgatcagctgtttgacttctaatgctctgttgtggacttgatgtatcatgtcctgcgttagaccgtagatccctgtggaccgtggtgtaataagtaacgagcagtcagtcaacgccacatggtagctgaacgatagctcatgaatctctcatttaagatgcatcagttgtctctggtaacgtcatgtgctccccatgttgaatagatggatccatgagcatcgccgtagcgagtttcattccgctcatgcaaggcccatctcatcatgtctaagtgtgcctagccccgt

SEQ ID NO: 583946 - DNA, 602 bp, Homo sapiens
gaagccgcgagagcgcggacggtgggctgctgctgggcggcgcggggcagggagggcgccggactccggtccccgccgtccccgtccccgttctccttagcccctgccggtccccgtgctggagcgggccattggggccaccgggggcgcgttggccggggaccggtgtgggcccgtgagggattggaggacgggttggggagaacgcgagaggggggaaccaggaaaggcgccgggaaaggcccccttgtctgggagcacacgacagcgggacgccgccggcggagactcaaccgagagaacgccctggcacaggggacgcaggagaggctggctaggttggggaggtcgcctccccagaaggggttgacagggcacaaccgccttggggaaagaaacccgcgcccaaaatgctcgccttggaacgccttagaaccgggttgacaggtagtgcacccaagggggtttggatccaatgacaggggaccacgggacgcagcaggagcacacgcagcaaagcaagtcctgcacagagagtggggaaaacatccaccggtggcatcggccgtcgacggtcgaacaagcggttgcgggaccccgtg

SEQ ID NO: 583947 - DNA, 166 bp, Homo sapiens
  misc_feature (88)..(88): n is a, c, g, or t
ttcacctgagacaacttgtacatagaggagcaacgaattcgactacccatcggtgggcagctgcgcacaacgtgtgtgaaaacaacantcagcccatcttcgcggtgaccagtagcatggtgaagacctacgagaaactcaccgatatcatccccaagtcagccgt

SEQ ID NO: 583948 - DNA, 879 bp, Homo sapiens
  misc_feature (242)..(242): n is a, c, g, or t
gtctgcatcagcaaatggacatgtccaggatttcttcctatggaagccttgacagtttctttgtatctttcctaacacggtaacaacttcttccccagggttgagaggagaggtggaagaatctacttaacccagcaaaatgttttcctagccagattttcttcagtgtgaaaatgtttattgagtcagtgattccactgggtagggttggtgacatcagagccacttcccccatttaacgntataaataataaatggtgacactgaaagtctgttggatagctgcatggtttctgtggatgatggtgtctggggagttgagatgcttgttttaaaaatggaagtacagtagcataaatatggaggcagcttaatgtttgctgtcctttgcataattcacagaactggacttctctagcattcttgaaaactaggagggaaaaaaagaaactgatagtttttgatttttgcatgcgtgtgtgtgtgtgtgtgtgtgtgtgtgtgcacgtggggttgtttcaaagggatgtcacatagtgagtgatttttccttttcagcataatttatcatacttgtagtcaagtgtgggtattctgtaactttgtagtgggttatcgggttaactatcttaaatcgactaagtatattacatattcttaagagtgtacacaccgcggcgtgtacttaccacagaagttacttcatatcgaaaaatgtcactggcggcccttggaaatgggggtcccgtcctcaattctattccttaaaaatagcaaatgttttttccagatttagcacctcttgtcccccgctcggttggtccactcaaaaaaaacctggcatcctgctccaaaaaaaacaaaaaacacaaaaggggc

SEQ ID NO: 583949 - DNA, 746 bp, Homo sapiens
  misc_feature (245)..(245): n is a, c, g, or t
cgcctgtgatcgtgtcttctcgagagcaatgacgtggtgaaagcggaaacgacgcaataaggagtgagtgagtcaacgagtctcactgataaagtctggtggtgcgagtctcactcattgcatcaggaaattgctatgtgtgaaacgagcacaccgagtatcgctggcgatctagagattatcatcgtacattagggacccgctcattggccagcactgaataacagaccagtgcttcatgtagnccacctgaagtggttagccgcagataggaaagtagctttggttgacaaggattttgaagtaccttgtatgaattgaccggcttattagtcatgtaacaggcggtagtcttgactcgaaggcacagtcaaagaggtgaacggaatggccttgcacattaacatttcctgtgagagacgttgtcattagtccgagcaacatttgtgtgattccgctaggggagtgtggcccatggggtggtgcgacattgactatggttgccatgaagatcagaattctcatgaagaaaagtgtgtgagggtcgggccatatagcattgagaggaagattgagtatctggaaaagaggtgcttgcccctgggagtgtggtagcaaggtttcatggaagaagtaaaggttggtgatgtcgggatgatgtcgcgtggatgattgaacccgatggagtgtgaaccatctgactcttcacgcactggccgatgactgacccaaaaagcatgcacaca

SEQ ID NO: 583950 - DNA, 701 bp, Homo sapiens
taggggccgtgtccatagcggtggtgggaatgtgtcgcgccgggaaacttcctggttcccgggtgtcggttcgccgggatcctcttggaagggaaacaatggggcggagggcactgcggtagccgccgccgccgcgcgccggccgagccggatctgctcggcgcccgggatcgccagctctgtccgttgcccacaggctagcagtcgggaccgtactgaggacatgtattcctctgagaaaccttggacagcagatttgggttaatatctgattgggacaacattcagacccatttccagtcatgaacggagtcttgcccctgtgacccaggctggagtgcagtggcgcaatctcggcatcacttgcaagctccgactcctaggttgacaccattcctcctgcctcagtctcccaagtagctgggacctacaggaacccgcacagccacagataatctggggtcattttgagtagcagacatggtttccacccatgtttagccaggcatggtctcgatctccgtgaactcgtgatcacccgcctcggctctcaaagtgcttgagatattaggtgtgagcaaataagccgggctggatgctccgttcttaacaggattgtgattaatctggaacttgcttaagaagtaatccggcaatgttcttgattggtacaagtagatcatactgtggcttataggaaa

SEQ ID NO: 583951 - DNA, 351 bp, Homo sapiens
aaagattcttcccttcgggctggtggtgacttgcagaacttgctgttgcatgggtcaaagtactgtcaccccacagcttcttcatcatgtcctctactttcttgagcctgtcgcaaggccccaagtggccctcccccttggcggcgaacttggacacatacatctcggcaaaattgattcagggtgaaggcccaccctgtgaaggccagacccaaagcccacggtaccgagaaccaggatcgctcatgatgttgcccatggggcggctctcgcactcgctgtaggtggagatgctgccgtacacgttctccatgatgcgctggaaaagctggtagacgctcctcgggctcc

SEQ ID NO: 583952 - DNA, 294 bp, Homo sapiens
aggatcctgatcaggagttgagacagcatggccaatatggtgaaacccatctctactacaaatacaaaaattaggtgggcatggtggtgtgcacctgtaatcccagctactcgggagactgagacaggagaatcacttgaacctgggaggcggaggttacagtgagctgagatcacgccactgcactccagactggatgacaaggcgagactctgtactggattctgctggggccgcagcgggggcaaactttctaggcccttctcccaagcagtaacagccattgcacttcgg

SEQ ID NO: 583953 - DNA, 328 bp, Homo sapiens
  misc_feature (95)..(95): n is a, c, g, or t
  misc_feature (189)..(189): n is a, c, g, or t
  misc_feature (200)..(200): n is a, c, g, or t
  misc_feature (272)..(272): n is a, c, g, or t
  misc_feature (290)..(290): n is a, c, g, or t
  misc_feature (292)..(292): n is a, c, g, or t
  misc_feature (295)..(295): n is a, c, g, or t
  misc_feature (301)..(301): n is a, c, g, or t
attaaaaaaccaaaatcccccatatcccagacatgaagatatcagttccaccaatactgtagttaaaaggctaactctccccttggatgggaacnacctttccctcttgggtttccggaaaaaaagcgcacttccccgaaatattttttcagccaaacccctgggaacatttttactaaatctttttgnaacccttaaanaattccctcattcattaccctacagggtaaacaggagtttaatttggatcaaaactatgttttgggtgtaanattcagttccctcccccnanggncaaccnatgaaataaaaaaagccttttaaagga

SEQ ID NO: 583954 - DNA, 304 bp, Homo sapiens
  misc_feature (1)..(1): n is a, c, g, or t
  misc_feature (52)..(52): n is a, c, g, or t
  misc_feature (123)..(123): n is a, c, g, or t
  misc_feature (203)..(203): n is a, c, g, or t
  misc_feature (229)..(229): n is a, c, g, or t
  misc_feature (252)..(252): n is a, c, g, or t
  misc_feature (266)..(266): n is a, c, g, or t
  misc_feature (272)..(272): n is a, c, g, or t
ngtcgtagtgtcgctgtttgcgggtctcccgctgggaccggggcgcacgggngtcgctgaggcacgggtgtcatgtcagacaacgaggacaattttgatggcgacgactttgatgatgtggangaggatgaagggctagatgacttggagaatgccgaagaggaaggccaggagaatgtcgagatcctcccctcttcgagcanaccgcagccaaccagaagcgaataanctcaccatacatgaccaagtacnatcgagcccgcgtngctggnaccccgagcgctccagattgcgatgtgtgccc

SEQ ID NO: 583955 - DNA, 114 bp, Homo sapiens
gagttgcagagagaatggtggctactggagaatgaatgaaatgcctgaatataagtgaatctcagaccatttctcatatgcgatgtgcaaaagttgtctaatgtctctaagtat

SEQ ID NO: 583956 - DNA, 424 bp, Homo sapiens
  misc_feature (132)..(132): n is a, c, g, or t
  misc_feature (140)..(140): n is a, c, g, or t
  misc_feature (160)..(160): n is a, c, g, or t
tcagaaaaccacatgttatctgcggctcagttttgtaatcccccatttacaaggatgttgactggaaaacaatattcaaaagagccccaccagggaggataatgacgtcaaactatgtcacttaaaaaaaanaaggtccntgggggtggtggctcacgtntgtaatcccagcactttgggaggccggggcaggtggatggcttgagctcaggaattcaataccagcctgggcaatatagcaaaaccccatctctacaaaaaattttaaaattagcaaggtgtagtggtgcaaacctgtgatcccagctacttgggaggctgaggtgggaggatcgcttgagcctaggaggcaaaggctgcagtgaagaaccatgatcatgccactgcacttcagcctgggtgacagagcgagaccctgtgttta

SEQ ID NO: 583957 - DNA, 133 bp, Homo sapiens
agaaggtgtattagagatcaaggaaggaatcatccttccttgtatgtatatacagcctttgggtacaaagtgtgtggtttcttgaggatcggactcttgatggtatttctatttttatataactatatagtaa

SEQ ID NO: 583958 - DNA, 252 bp, Homo sapiens
gtatggacttcagtttgacagtctccagatcaccctacagtgggtgcaggctgtgtttcacatacactagaaaatgtggccaactagaagtggactacagtcctatctgacatgcaggactccagtttatcacataagataccacctatggaggagccgtcctacacccaagataatgatctttctgagctcatctcagtatctcaggtagaggcctccccgtccacctcttctgctcataccccttctcag

SEQ ID NO: 583959 - DNA, 182 bp, Homo sapiens
ccccgagacctatccccaacacccaaggggagttcccacggacgcttctgctcatgttccaaggctgtgacgtgcgctcattctcgccctcttttttcctctctcctcctgccccctccaagaagtactgactggtctcctctatcgtgtttgctgatccacagtgttgggcgataacatca

SEQ ID NO: 583960 - DNA, 148 bp, Homo sapiens
gcccgggaaaccccgtcgttccctttcccctggcttgcagcgcggaggccgcacgatgccttgagttactgtaaaagacgtgaaccagcaggagttcgtcagaactcttgcagccttcctcaaaaaagtcccggaaggtgaaagtccc

SEQ ID NO: 583961 - DNA, 97 bp, Homo sapiens
gatcctttggcactttgtccagacccaaatcagaacactggaccactcgaagatggcattgacagcggaaggggcacactgggcctagggagggctc

SEQ ID NO: 583962 - DNA, 211 bp, Homo sapiens
cagagacctcgcaggccccgagaactgtcgcccttccacgatgtggctccgtgcctttaatcctggcactctctctgcttccgcggcttgggggaatccgtcctcgcaacctgtgggacaaccgtgaatggaaagtcttgggaagtcgtagcttagaggatttgacagctgtgcattttctggatcctttgcaagccgctttgaccctagg

SEQ ID NO: 583963 - DNA, 1150 bp, Homo sapiens
gctataagccaaaatgggagaggaaaagactcatactcaacattgtcgtcatatggacacgtagattcgggcaagtccactcactactggccaatcttgatctataaatgcggtggcctcgagccggacgacaccatttgatagaaagtttgatgacatggaggcctgctgagactgggaaagggctcctacaagtatgcctgggtctaggataaactgacaagctagatggcgtggaaacgctggtaatcaaccattgatatgctccttgtggaagataccgaggaaccagtcaagctactagtgatgaactagtcattgcactgaccccaaggaccagcagcacgtacctgtgtatcaagagaaccactgatttacatgggagcactctcacggggtgagctggtgctgatccgtgagtcgtcggctgctggatgtgtgggtgaacattgtgaaaggctggtatctccaagaatgggcagacccgagagcatgcccttctggcttacacactgggtgtgaaacaactaaattgtcggtgttaacaaaatggcattccacatgagccaccctacagccagaagagatatgaggacctcgttacaggaaagtcagacacttacattcaagaacaattggctacaaacccgaaaacagtaacacataagtgccaaatatactgcgtagcgaatggtgacaacaatgctgggaacaaagtgctacaacattgccttgggtccaagggactcgtcaacagaacaccccgtacagggactggcacacggccaagtgggcaaaccaaggcacgccatggaggagctctagagaactgcaataccgaaccaaccaagaccaggacgcaacagggacaaacgcactagacgcctggccctacctgaccaggggaagtggcaacaacgaaaaaaactgggcgccgaaaccacggtaacctggcacaggagacggggcccgaaactggacaaacaggagcggtaccaaccacaaaacccgaggcaatacggagcgcacacacacacggctccccagacgaaaaaaggttcacaaacagagcgaagcacaaacaaatccgggcggcaaacggcaccacggaacagctaggggatgcaacagcatcatgacacggggaaac

SEQ ID NO: 583964 - DNA, 604 bp, Homo sapiens
acttgaccagaaggcagaggtggcagtgagccgagatggcaccactgcactacagccggggtgacagagaaagaccctgtccaaaggaaaaataaaaaaggacataatattacattttaggtagaatataacacaaggtagaggagcagcttagtggacaagtagaattggtgggttggaagtcagttcagaagagagtttcatagaggggagtagcagcagaatcaatgaacgtgaatgagcatgcggcgaaagaggaagacaaagagaacaaggacgcaaaaaaggcaggttggagaaggggtatgcaggtcgtggtggctcacacctgtaattccagcacttggaaagactgaagcaggtggatcacttgaggtcaggggttcgagaccagcctggccaacatggtgaaacctggtctctgctaaaaatacaaaaattagccaagcatgggggagggcgcctgcaatcccagctacttgggaggctgaggcacacgaatctcttgaacccaggagatggcggttgctgtgtgctaaggtcacaccaatgcactccagcctgggcacagagcaagaatcatcttaaaaaaaaacaaaaacca

SEQ ID NO: 583965 - DNA, 260 bp, Homo sapiens
gatttgataactagcccccctccttaaatcactttatcgaggtataattgatatataaaaagctgtacatatttacatgtttaatgtatacatcttgatgagtttgaggataagtatacactcatgaaaccatcaccatcattaaggcataaacattcattaccttctaaagtttcctcctactctattgtgtgtgtgtgtgtgtgtgtgtgtgtgtgtgtgtgtgtgtgtgtgtgtgttctcgtgtgtgcgtggtgtgg

SEQ ID NO: 583966 - DNA, 152 bp, Homo sapiens
taaacttttcaggagcaataatgaactctgcacttaacggaaataatagcaaatgaataacacaaaatcctaacaagtgaattaacgctctgtcatcagacaccactggctatgcaataatcacaacgattccacagtcacgtccttcaatc

SEQ ID NO: 583967 - DNA, 938 bp, Homo sapiens
  misc_feature (275)..(275): n is a, c, g, or t
tttctgtcgttcgcgtgcccgtcgttggccctggctgctgtcccagcggtttcccctggtgcggttgcgcgcgcgcttgttaacggttgccccccgtgtttcaattgcgcctgtgtgccccacaatgttgggggtgcgcgttccccaccaggtgaatattttgtcgggcgggtacgctatccatgtcggctttatcttgcccgggtgtctggattatctgttgggtcccctcgtgtttgagagtccccaccgttaattgtaccgccgtggctttntgctggcaccagctgactatatgtccacgtctctcgcgggagtcaacgcaccacccggaaatttcctcccctgttgggcttgtacacgacatgtaagagtgtatacgatctcacgatcttgtggggaagcacgtcgctattatccgttatgccggttgttctcggctacaaccagtggtttcacccactcaacgctcgggttacgacggtggatgtgtaacatataccttttctgcgttaaagtaacctggggagcacaacccacaagtagggggaaacacacgtcaaggtgaaaacctcttctgccgcgtgcgtccacgggtcgggcactattaaggggcttctctagcagtaacattgtggggcccgacagcagcaacgacgccgccggacgacggatcgagcactctccaattgtgccaccacacctggggctgtgcggccctcccaacccacaggaggggcgagaagaaacgagtttgtgtagtacggcggtctatccacgtaagcggagtatgtccctccgcgtaaagggccaaaggaggcccgaggcccaaaggaggagaaaggccccagcgtgggcagccagcgactgcgcggtgaatgcccaaggccccctgaaggggagagaagaacaaaaacaaatttcttgcaaacataaca

SEQ ID NO: 583968 - DNA, 826 bp, Homo sapiens
ttgtcgcgtccccccgatgccgggtgccggtgagggcgtgcgcccgattggggtgtcccgcccgtcgtggtgaaggtccgggccgcagcgtgtgcatggaaactggtgttttcggctgggcgccttctcctcgggagtctttcaacggggttgagattcccgccgggtgtgtctctgcccagattgtctccacacagaggaagtgctgttcatcggctgctcgcatcctactggacggggttctctccttgccccgttgtgggaacagtcttccccacagtgcctatgagtttgtcttaacagtcccgtaaaccccatgtcagatttgagagcggacccctgttaaaagtcatcctctgttgaggggcgccctggctcttccgcacgagtttgtgggaacccccctctgtcaaacactattgaatcaatacgggcctctctttcttacagggataaactagataaatctcgttcgggcctttctgggaacacctctacatcaccacgggctaggaagatattgtcccgcttcacaagcaccccgtgcagcatcaatctggtagccccccccttgtcaaacttacccccgtgtctccgcctcagttcgtgcttttcttaacctcccgctccattctacacgcttgggggcccccattttggcattgtacttatcattgggtggctaggccatagccccagggggcagaacccggttgatgagtagtaccccaccggtgtccgcacgcctggtacgtgtgtcgcgtgttcttgcagaatccgggccccggggcaacaaaaacatccaaaatccccttgcccacaaaca

SEQ ID NO: 583969 - DNA, 207 bp, Homo sapiens
  misc_feature (106)..(106): n is a, c, g, or t
  misc_feature (109)..(109): n is a, c, g, or t
  misc_feature (141)..(141): n is a, c, g, or t
  misc_feature (149)..(149): n is a, c, g, or t
  misc_feature (191)..(191): n is a, c, g, or t
cctccacactccagggtgagcccagggccccacgccaccctcgggtactgaggtcacctggcagaggtgccctgctggatgaggtggctcggagcactgctgccanagngaaggctgtgcacccttctcaactttgatganctgctgancgcagcaccttctgtgaccagagaagtggaaggggagcctgntgcccccagacccaac

SEQ ID NO: 583970 - DNA, 299 bp, Homo sapiens
taccccacatctgcgcatatgacataactcaaatgccataacaggtccaacgaccggaaaatgcctctagtttcctttccgatgactagaacaatatatatccctctattttattagcttatcagcatgtatgcaatgcctgacataaatacatttaagtaaaagacacaataagaccttatgtttatctaaaaaacaaaattaaagaggaaaaacgaacaggaagtaacataaagaaaaaaacgtagcaattccacaaatatttctgaatcccagccatgtacaaggtacttgtctta

SEQ ID NO: 583971 - DNA, 1194 bp, Homo sapiens
tgcacactcccgcgtcgagaacatatcaggcatagatgcagcgcctggtatagagcttttgatgatcctcctatgtcatacgtccagaagctagacaaggcccggacaagcagtgggtggtgctagggacccaccaatcctgctatcaatggcagtgcaccccgggacctgtatgacatgaagcccttcgaagatgctcattcgcagtgcctccaactccccagatcggatgtccatggctgagcagctccgaggggagaccctggattccatggagaagctgagccggcgggaggctgaggcactgctgcagctcaatggggacttcctggtacgggagagcacgaacacacctggccagatatgatgctcactggcttgccgagtgggcagcctaagcattatgctactggtggaacctgagggtgtgagtacggactaaggatcaacgatattgaaagtgtaaagtcaccttatcagttaccacatggaacaatacactatgcccatacatctctgcgggcagcgaactgtagtctacagcaaaccatgtggagcggaaactgagatctgacctagacgctctcttccagaagatgccctccaaacctttaccacctattactctaaactatagggagctcgtattggagagtgtactagtgaagataggactatgtgtacaaaaatgagagataacatggaatacatgagaaaataatacagttgatagaaaggagtagcgtataaagaactgggtgagaattcatgacataaaacggaaagattaaaaaacaatagaataaagtgtaaagaagtggacacaaaactgggacatatacgtggcatattgtatgcacatacaaaagacgtgaatgtagaaaaggaaatgactggaaaaaagaaagttgaaagaaaatatgagaagaggacaataatataggaagagaataaataaaaaaagaaaacaaagataaaaaataataaaatagaaagaaaagaaatattactgaatatataaaatctaaatataaaaaggaaaaaagaagagaaggcaatgtgttaagaagaatagaggtgtggaaagattagggaaattgataagaaagaaagaaaaataaaaataagaatgaagaaatcaaaaaaaagaagaagtgaagtggagagataaagtatgaagaaaatataataaaa

SEQ ID NO: 583972 - DNA, 258 bp, Homo sapiens
tgggtgatctagaggatccctgtatatgctgtctcaaaaatatttatcagtaggaaatgcaggagggcacagtggctcatgcctgtaatgccaacgctctgggaggccaaggcaggaggatcactggagtgccaggagttcaagaccagcctgggcaacatagtgagaccccatctctacaaaaaaaaatttatccagggcagggtggtacatgcctataggtcccagctactcagtgtggccaagggcaagggggat

SEQ ID NO: 583973 - DNA, 766 bp, Homo sapiens
agcggtggggttgggccagataagagaatataagcaggctgcccgagccagcagtggcaacgcgctcgggtccccttccacactgtggaggctttgtcctttcgctctttgcaataactcttgctactgctcactctttgggttcacactgcctttatgagctgtaacactcaccgcgaaggtctgcagcttcactcctgaagccagcgagaccacgaacccaccagaaggaagaaactccaaacacatctgaacatcagaaggaacaaactccggacacgccgcctttaagaactgtaacactcaccgcgagggtccgcggcttcattcttgaagtcgacagagtcttgctctgtcgcccaggctggagtgatgaggcgcgatcatcactccacctgggctcactgcacctccgcctcccgggttcaagcgattctcctgcttcagcctcctgagcagctgggattacagagtccctgtcatccagactggagtgcagtggtacaatcccggctcactgcaacctccacctcctgggttcaagcgattctcctgtctcagcctctcaagtacctggaattacagggaatacaaccaacctcttcatcacctgaagacatttttttcatgctttcccatgttcctgaaatgccctccccctaggagccttcctccaatttatctactctttccacattcaagacagagttgaactcacgatgtctaaggtctctggagagttcaggtatcttgtaacgaggacgaa

SEQ ID NO: 583974 - DNA, 375 bp, Homo sapiens
catctcttgtttttcctttcttttcttgtattactttctcttgatcaatagagctgccatagccttcccagacataaataatcagcttccttggaagtactcagaatgtgaacagctgtagccacttagacctggttttagattctcaccccttgttgtgtattgtaattatctagggaacttaaaaggtactgaggcatgggccccaatggaatcattatccctggggggtggggtgggccctagacctggtattttcaaaaactttcaaaaattattctaacacatacgcagattaaactggttgcagacattcaggaagcaaaaatatggcccaattacccttagagtggagttaaataagcttaaggctca

SEQ ID NO: 583975 - DNA, 203 bp, Homo sapiens
ttgttggcgcgcgcgacacagccccgacgtgaatggatgtgtctctgatgcctcagtgtgacatatgccttcctctccacccagctcagacacccccaaaacactccgcacgccagccacgccgctgcctggggcagcctccagctcctgtcatttagctgcgggatgctgggaggagctgctgttctgagtcgcgcccacaa

SEQ ID NO: 583976 - DNA, 345 bp, Homo sapiens
tgcaagtgttctcacagagccacagcctcctcaatgctctgtgaatggtgcttgtgcatctgggtctgtgtctccctgaagtgaatctctggcttcagccatagatgccataattcttgaagtttgctgacagcctcacggggtccacttgcttcatcatagtgtgaaattccgaaagtgccacgcaagagctctataggatcgacacagtccatttgaggagattttttcctctgaccgagagctctctctcgcgaggcccctgtgtgtctcccacaaagccctgatctgagggtccaagtacacagccactctcatatctaccatcctcattgtgctatagca

SEQ ID NO: 583977 - DNA, 432 bp, Homo sapiens
tccattttctttctgacaactttcacatttcccccttttaattgagatctttctccaaaagcatagctgaccagtcatcctgcagtcaggctttgattgccccttggtgctgggatggcgctgtcccagtttggtgtggtctggttccacatcatcaggaagtgactggtgaccaggagtcagtgtcagagctcatttagccacatttgagcaaccagggaggtgtggagggagtggccctcaggcgcagtctacctgagtccactgttaagtacggttttgtctgttccatgggtgttggcatcatctcaacgcgctgggccagcacgatctgttaggagttgtacttctgcagagacttaagcaacagataaaaaatttattaagggaaaatgcagagtgaaattaataataatatgacaatcctagttg

SEQ ID NO: 583978 - DNA, 359 bp, Homo sapiens
tggtgtactcgtaagtacagtaaccattggtggacattgatttgatggtaagggaggtaatcgttgacctcgtttgttatgtaaatggatgcgtagggatgggagggcgatgaggactagagatgatgacgggcaggatagttcagacggtttctatttcctgagcgtctgagatgttagaatatagttagttttgtagtgagtgttaggaaaagggcatacaggactaggaagcagataaggaaaatgattatgagggcgtgatcatgaaaggtgataagctcttctatgatagggggaagtagcgtcttgtagacctacttgcgctgattgtcccatgcgggtagccttttaagggt

SEQ ID NO: 583979 - DNA, 529 bp, Homo sapiens
gacgcggtggtcgagggcgtgttcacggtgccgggcgacgggtgcgtcgactacaaggcgctcctcgcggtcctgcgcgacgggggctactcgggctggctggtcgtggaggcggagcaagacccgaagaaggcccacccgctcacctacgggcgcatgggcttcgcccacatgagccgcttgctcgccgacctccggatgtagccggcgcggcgaggcgcctcgcggggacaccggcccgccctcgcccgcccctcgttgacagcggggcgggccggcgaagcttctgggtagggcgctagttggacagccccttcttcacgactgcgaccttgtgggcctggtccgactcgtcgacatcggcggtcttggcctccttgagctcgatcgtgaccttgccgatcttaccggtgaacctgaacggtaccttgtaggcctcgctgaccgcggtgccctcatccgcgcccacatccgcgccttcgtccgccgagtagaagcagcactgggtctgctcgatccgtgcggccgc

SEQ ID NO: 583980 - DNA, 767 bp, Homo sapiens
ggggggcttcgaagttggggttgaacaccccagatctcagtggaacccccgccccctgcctttccctctcccctagaaaagtgggtggtgcctgtctcaccccctgatgaccttgggacacccctccaaaagcatgatacatcgcgatgaccatatccgccccaaagacgcgtagcacgaagaagctgaggagttcgagagagccaagtgagtcatgagagtgtcctgatggtgaggacatgagagataggatttatcgtatgagaaaaatagatgctgtgacttcagtgaggaacttccatgtgcgtccacgtaacgcacctaagaaattgatagacgccttcacatgattggaaagcaagcccactcacagataagcgtaccctgagtaaagtggagagacgacagcagtgtagatagcaatggagcctgtgtggaactcccagtatggggagtcccacacgattcgaattaaatgacaaacgtaatattaggagggtatatatgaaccaccatgcgccaattaagcagaaaaaaaaccgatacatagaatttagattagccaccatagcaccacacatggaaaacacaaacattaggcgccaacatgagagcacaccacctagaagtggattacattaatggcaccaagtggtgagccgcgagtattattggcaaagcgagaagtttgcaaacggacaaacagtattagaagagtggtgcacaatttccataccactggggcaacctatatgacgcattagtgg

SEQ ID NO: 583981 - DNA, 355 bp, Homo sapiens
tctgagtgcatataaaagttatgtttatattacactgtagccaattaagtgtgtaataccattttgtcttaaaaaaacccaatgtacatataccttaattaaatatacattattcacttgcagaccaaagaatattaagttacaaaaaaagaaaaaaaatatatttttactaaaaactgctaataatcatttgagcctttagtgagttgtaatctttttgctggtggagggtcttaccttgatatggaaggctgctgaccgattagggtggtggttgctgaaggttgggggccaggggtctctggcaatttcttaaaataagacaaaataaagttttccacattaattgactcta

SEQ ID NO: 583982 - DNA, 980 bp, Homo sapiens
agcgggtcactgaggcagtagccggacgggtgaggagggcggttgccggcgcggcgcggcgcggcgcggcgcgggtggggcgggggttccgcccggcttccagtcccctttcccggccggccggctgccgccaccggcctctccgcggagctcgccccggagcggagtcctccggcggctagtgctgacggccagcggaactgagccgtagtagctggcagcttcgagtcacagcagcaggtaatggctggccatggaaacacaagtgtctaatgggccaagcttgcaataacacagccaagtggtccaaccaccataaacaacaactgttcgtcaccagtgtgactctgggaacacagaagacagcaagaccaagttaatagtcaactaccttcctcagaacatgacacaggaggaactaaagagtctctttgggagcattggtgaactagagtcctgtaaggcttgtacagagacaaaattaagcagggcagagcttgggatatggctttgtgaacctacattgaccccaaggatgcagagaaagctatcaagaccgtgaatggctggaggacttcaaagcaaaacaataaaagtttcctatgctcgccccaagtcgagttctatcagagatgcaaatttatatgtcagggacttccaaaaggaattgacccagaaggagtgggaacaggtttggcacgaatatggacgcattattattctcggatcctggtcgaccagggtcggtgcgcatatccagggggtgtcagcggataactcgcacattgcgcaacgcgcaaattggagggcaccaacaaacgctcattcacaagcccctacaaggcgcccgcaaccctccccgggtgtccaccgcagaccaagcctcgggtaaagactgggaaatagagcccaacgacagcaaagcaccacacgcgcccacccgttgcacggagtgccacgtgtgcacaagcaacaggtta

SEQ ID NO: 583983 - DNA, 249 bp, Homo sapiens
  misc_feature (9)..(9): n is a, c, g, or t
tcttccttnacttcccctctccgcccttttttgagatgggggtctgtgctctcttgcccaggctggagtgcgatggcacgatcatggcacactgcagcctttacttcccaggcccaagcaatcctcccaccccagctactcgggaggctgaggcaggagaatggtgtgaacccagaaggtggagcctgcagtgagccaagatcacgccattgcactccagcctgggcaacagagcgagactctgtctca

SEQ ID NO: 583984 - DNA, 318 bp, Homo sapiens
atcaggttataaagaagtcacttgctcaggtccgcctgtcttgaattaggatcacatttacacaatatcagacagctaaagccctaacttaaaggcaatgtgctaccttagactgggaatcagggagggtcctaaatatatacaaaatctggccaggcccagtgactcacgcctagtaatcccagcactttgagaggccaaagtaggaggactgcttgaggccgggagtttgagaccagcctggccaacatagtgacaccctgactctacacacgggcacacacatacctgcacatacacacaaataaattgtctggg

SEQ ID NO: 583985 - DNA, 287 bp, Homo sapiens
caattgcaatttagctttctttccaaatggattcattgtggcgtgagacttgatagaatgtgaagcaaattctcctcctggaatttggctgtaagcctagaggatgggctgcataaattattctaaatgccatagaatcttgcatgttgtttctttctagactgttttaaatctgcgtcaggatgcctggaagtgagacactgaacaagcaagagctcattgcacaaaagagaaatagtgacttgcaaaaaaaaaataaatgaaacatcctttttgtaaaaaaaaaa

SEQ ID NO: 583986 - DNA, 147 bp, Homo sapiens
  misc_feature (2)..(2): n is a, c, g, or t
cncggccgcacctttattacatgggtgaagacaaaacaaggatttatttgcctttgcgggaccttgattttccatagacatgagctaacgctcacaactctttgccctcatgacacatgcactcgtctcggaccactcgttccggcc

SEQ ID NO: 583987 - DNA, 680 bp, Homo sapiens
agacatgttctcactctgtctcccaggctgaaaagcagtggtgtgatcacagctcactgtagcctcagtctcctgggctcaagccatcctctcacctcagccttctgagtagcttggaccacaggtgtataccaccatctctagctaatttttatatacttttttggagagatggggtctcattatgtagcccagtctggtattgaactcctggcctcaagcattctgcccacctcggcctcccagagtgctggggttatagatgagagccactgtgtctggcccagaagatccttacaaatataaactggacgatgacctgcatctgcttcaagtcctcagggacttcctgctacatctgtaataggcttaggaccccttcacatgtccctgctgtcctctctggccacatatcctattttagccctgatgtctttccgtaaattcccacagcacaaggcttttccagccttggaagctttgaatgtgctttctcctttgcctagaagagcttattcaacatgcacctgggtgaagccccattctccttctcatcttggcataaatgtcaccactcagggagggcctccccagccacacatttagatcaggcctccctctctcatgggctatctcataaccttattagcccctaactcatgggctatctcgtaactcta

SEQ ID NO: 583988 - DNA, 163 bp, Homo sapiens
ttatagctttcagcacgaggaagagctctggggacacaataaacaaatatagactacacagcatcttaactgataaactcccatgtgtattagtacattaaacatcaagaggaccatacattaagcaagactaccagagtacctacaatatcgtcaattgata

SEQ ID NO: 583989 - DNA, 412 bp, Homo sapiens
ctctctctctctctctctctctctctctctctctctctctctgtctatctgtctgtctgtctctgtcgctctctctctcctcgcgatcccacatgagtacgcctaagaccacggggtccacccgagacccgttgagcaccaaccctaggcccccgcgcggacccttatgggctccgaccagatgagagaagcaatcatgaaccatgaaagagctcgtcaaatgcgggcacaagcgcgcatagcagccaaagggacagctagcgacacgaacagagacgatcatcaaacagacacagaagatgacgcacaggatcaggcctgcttaaggaagctagggagacagactacctctggaaccggagagcggaagacgttcacaaatcaggggaccatgaccgcatctcacgctgtc

SEQ ID NO: 583990 - DNA, 446 bp, Homo sapiens
  misc_feature (15)..(15): n is a, c, g, or t
  misc_feature (74)..(74): n is a, c, g, or t
  misc_feature (425)..(425): n is a, c, g, or t
  misc_feature (433)..(433): n is a, c, g, or t
gtcacttgcactccngaatttaatcccctgacctaacatggcctaaaaatcctgtttaagagtccaaccttaanccctaccttcctcctgttttgagttaattcctaaaactcctaaaaagcaagccttgtattcctttccctttataaaaattatttgtggcccggcacagtggcctcatacctgtaatccccagcattttgggaggccaaggcaggtagatcacctgagatcaagagttcgagaaccagcctggctgacatggtaaaacgccatctctaccaaaaaatacaaaaattagcagggtgaggtggtaggcgcctgtagtcccagctacttgggaggctgagacagaagaattgcttgaacccaggaggcagaggttgcagtgagccgagatcaagccaatgcactccagcctggantgaggagncaaagctccgtct

SEQ ID NO: 583991 - DNA, 207 bp, Homo sapiens
ggggcttctacggatgtgcgggccatctacggctgtgcggtgccagtacggatgtgcgggccactacggtatgtgctgggtggaaggcaggggcgggtgatggaccgccgccccagggtcacctggttgatgttgtagtcactggtggtctctcctaggtccgccagggtagaagttgggcccgtgatgctgatagcaacaggcagt

SEQ ID NO: 583992 - DNA, 257 bp, Homo sapiens
caggggaagagggtgtgcagaaagaaaacacagtcatgttatacagcgaggccttgtgtagatagagtttatgtagtcataataattgccagccctgaatgttgagctaaaccaattattatactgtaaggaggatgtgaggattggagtatttctggtttgggaaagccgcagggtggtcaacttgatccagttaaatttgtcatatttctccagaagcaagtactacccagggttaccgagcctccgaattcgta

SEQ ID NO: 583993 - DNA, 131 bp, Homo sapiens
agtgtctgagcaggtgaaggatatttacatggcagcaggcagacagaatagagccaagcaaaaggggaaacaccttataaaaccatcagatctcttgagacttacttactaccacaagaacagtatgtggg

SEQ ID NO: 583994 - DNA, 337 bp, Homo sapiens
ggcattatagcaaaaccaggaactctgaaatctgtagcatgctatggagagtctatatctttttctgagctcagtggggaagtcttggagactgaagagaattggccctttgcagtcatccaggcagccttcaccttccttatgggtagcaccaccatcaggaacatcaaaagccacccatccactcacccacagcacagtgccttaccagcgtcacccatggagctgaagatgctctcggtgacacacatgatggtgtcagtagcctggtcgtagcggccgatgggtcgcctcggttggaaaactgccgcacatgctgttggagaccacggaggct

SEQ ID NO: 583995 - DNA, 676 bp, Homo sapiens
ggtgaggcccgatgtgaggactgaccctggattcctcgaaactgccattgtgatcattactactgatactattggaaatggctgtatcatattttaagtactaagtgtgaattgttacctcagaaacgcttctgattccatcctagtgagaagctggccctcaggtggtggcagacaaaggatgtgtaagatatcctcccgatagattatatatcgtccatcatggatttgaatgaaatgccaaataacacgtccactttcaacgatgatagataatacgcggagcacttatactgatggccttgtgcctgggtcttgggccatacattctacacactagggcctacatcttcttgaactcagcataggtatcttatcaacattctggagagtgataactatatgaatacttatataatacaatttattggcttatatacatttatacacacagataatctgattatttatttctcaatatatatatggctaaacctattatcacaaaatcacacacctgaatgaagtgtgtgtaaaactgaatgacggacctgagcctccatgggcgacaaggagtgaccaaagcatgagcgctgagacccgaaagcaagataaaaagcacaggaagtgacaacataaagggaagcccgaagggcgctgcaggccccggagacca

SEQ ID NO: 583996 - DNA, 227 bp, Homo sapiens
cccctcgaactcgacggttctcaagctgacacgaatttacggattcatgaccccactttcattaaatagtcccaggagatagctaaataacattttcagatagacactcacactgcataagttccataatacacaaagctaagatatgctgaccgaactcacattgacgtatggagcactcacctagaaaagccaagacctccggcacacaattagaacatctgaac

SEQ ID NO: 583997 - DNA, 375 bp, Homo sapiens
  misc_feature (40)..(40): n is a, c, g, or t
  misc_feature (77)..(77): n is a, c, g, or t
  misc_feature (85)..(85): n is a, c, g, or t
  misc_feature (136)..(136): n is a, c, g, or t
tgcgctgggatattcaagagtctgaaaagctctacacagnaaatctgacctcaaccacagctaggtcctgactgtangaaaacanaaatactaagtaaaatctcaaaacatagtaagtaaagccatactcaacctngtcataatccaagaaatatcaattaaacaatgtgcaccattgagccaaacttttgtaaaaattatactatctagtgcaggccaagatgctgaaattggtaccttcacgcactgctggtggcatcatatactggtacaacccttttggaaagcaatttagcaataatcattgagagccacaaatataattgtgccctttaactcagacagtcctgctcctgggaattcacctctgatgga

SEQ ID NO: 583998 - DNA, 113 bp, Homo sapiens
tgttcccttggggttgcgaatgtcaatttcttcatgtgccacattgagtgtctccacacagcacaagggactcttcggcaagccaggcccttcagtgaacttgcgaaataggc

SEQ ID NO: 583999 - DNA, 103 bp, Homo sapiens
  misc_feature (44)..(44): n is a, c, g, or t
  misc_feature (59)..(59): n is a, c, g, or t
  misc_feature (83)..(83): n is a, c, g, or t
attatcgaaaccatcaggctactcattcaaccaatagccctggncggacgggtaaccgntaacattactgcaggcacctacgnatgcacctaattggagcgcg

SEQ ID NO: 584000 - DNA, 682 bp, Homo sapiens
  misc_feature (483)..(483): n is a, c, g, or t
  misc_feature (635)..(635): n is a, c, g, or t
  misc_feature (680)..(680): n is a, c, g, or t
tgtcattaccgtagctgtatccggcactgaaggtgcataaggtgaacggtaactggcgttcaggctactgttatggttgttatcgtcatccagactttgttccaggctatagctcaggcgaccatcatccagcagtgagccatcaagacgcatttcatgttgggttgggcgatctttctggctggtcatctgataggaaacttcattgctaaaaaaggtttcattttcagtttgatgtgacatggaaggccgtggctgacccgcggccaatttatagcgaacctgtccctggcgagtcaggaagggcgtcgatgctgccgaaacctggaaattgttcacccgaccatcttcttccgtcactttgacatccagcgtgccctgaacagactgattgaggtcatcaataataaacgggcctggcgggacttttttctggtaaatgacgcggcctgattgactgatcgtcacccgtggcattggtcntgtgcaataccgctaatttgtggggcgtacacgcaagctcccacggtaacattcgatcgtcactcgccagtgccgcgcccggtataagaaaaaccatcgaaaatattgggaacttgaaatcggtttcgcccgaggggttaactttagagccntaatttgccggtaaatgggaccgaaaaaaagaataaggttgcgcnaa

SEQ ID NO: 584001 - DNA, 126 bp, Homo sapiens
gcatgtatgggaatggtgatagaactatatcccagactgatggaaggatgaaatgacatcagctttggcctggagtcagtagcccggtaaagattcagagggagtgctgcacattcccaaagggtg

SEQ ID NO: 584002 - DNA, 272 bp, Homo sapiens
gctcgcaccatcttcactgtgtgctcgtagtgtctggcagcagtttgttgatttaactgtctgaggtttagggctaagcatagtggggtatctaatcccagtgatgggtcttagctattgtgtgttcagatatgttaacagccactttcagtagtctatttggtcgtcaactgggagttttctacaactcacgagtgagttttagctattagtagcggagggggtgatctatgacaccgctttacgccgggttctatggagcacacaggtgg

SEQ ID NO: 584003 - DNA, 1142 bp, Homo sapiens
aaaacaccaaatggcggatgactgccggtgcagcgggggggcccgggggccctggtggacctgggatggggaacctgcggtggcttccgctggaggtttcggcagtggcatccggggccggggtctgcggcctgtggactggggccggggcctgaggccgcaggagctctgctggaggcaaggccgaggataaggagtggatgcccgtccagccaagttgggccgcttggtcaaggcacatgaagcatccaagtccctggaggcagcatctcatctcttctccctgcccattcaggaatcagcagatcattgatttcttcctgggggcctctctcaaggatgaggttatgaagcattatgccagtgccagaagccagcacccgtgccggcccagcgcaccaggttcacggccatcatgtatgcataatcgggggcactacaatgtgcaacgtcaggatctgggtgttcacagtgctccaccggaggtggccaccgacaatccagtggggcccatccatccatggacaagctcatccatcgtcacccgtgcgcagaggctactgggaggaacaagatcggcaaagaccccaaaacttgtccctttgcaaagggtgaacaggccgattgcgggttcttgtgctggtacgcctcatcgctggaaccacagggggcactggagcatcgtactccggaacactgttgccttcaaaaggctgctccatgatgggctggatataagatgactgggtaagcgtacagacggggaatgacatgacgaacgtggtgcaagttggcaaggccaaactttgagtgcaatttaagagctacagattactgaccaccgcactatgaaggagacagggatcaccagatgcatataggagttaattgacacgactagcaagaaccaacacaagccaccagccaccgacacacggaccaaccgggaaacagcaagagaattcacacagcagaaaaaaaaggacaagcgaaagaaagacaagaccaacacagcgccacacagagcagacaagaaagcaacaacagcacgagcaagaaacacgcccgccacaacggagacacagcaggaaccgagcagacacaacaaacagacgatcacaatcacgcacacaaacaacacg

SEQ ID NO: 584004 - DNA, 221 bp, Homo sapiens
ccccccccccccggaaaatttttgggcccttttttgtgggcccaaaatttttccccttggggttggggcctttcccaggggaattttccccaacccgctttaccccggggtgggcccccctttgtttttttttttcccaatgggggggggggggggtttttgggccccctttggttttttttttgggccctggtttctttaaccccctggcccgttttgga

SEQ ID NO: 584005 - DNA, 371 bp, Homo sapiens
gtcgacccaggtattaggcccaggatccattagttacttttcctgatcctctccctcatcccatcctctgccctccagtaggcctcacaacatgtggtatttggtttcctgttcccgcgttagtttggtaaggataatgacctccagctccatccatgtcactgcaaaggacataatcttgttccttttttttttttgttcttttgagacagagtctcgctctgtcacccaggctggagtgcagtggcgtgatctcggcttactgcaacctggaggtgaaggattcttacactgaatactttaacagttggtaaaaggaaataaagaagacacaaataaatggaaatatatcccatgtgtatgaatgggaa

SEQ ID NO: 584006 - DNA, 999 bp, Homo sapiens
  misc_feature (320)..(320): n is a, c, g, or t
  misc_feature (999)..(999): n is a, c, g, or t
gacatctacgaggcggtatgtcctcccccatgccatcctgcgtctggagcctggcatggtcgggacctgagctgatcgtacctacatgaataggatcctcgagccggatactgcggcgtacggacttacaacaccagcggaccgtacgcgggcaacattacgtgctgatgagcgattatagggacgaacgcctagtgctactgtcagcgccatggaacctctcagatgctaaggtaggatgcggcgaacgggcatgctgtccatggcatccgtcaccgtgagaagaatgagcgtacgatgctgtcctgaacggctcaggntcaatcaactagttgagcatatgtgacgtcggcttccgtatggccgtgatggctacgtcgttctcagcacgttcctttcctggagcagtgggacgttcctgatggtgattgccagcggacatatctcatcctatctaatgtgcctagtcagtgtagagtgtggaacggtgtgacagtccgtcagaaggaaccgtgatacggcacaaaacacgtgcatgtctagggggttatcatctcattgtatcccgtggctacttgcctgaccaggagtgtcacgtaaggaagattcacgtgcaccatggtgaccgcagcaccaagtagaaagactcatggagtcattgtgtcctccttgatcgcatagtagtccgttgtggatcggcgggtccatcctggtctccgctgtctgaccttacagcaaaatgtggatcatgataggcacggacgtgtgacgagtccggcccatccaatcgtccactgcaaatgcttctaggcggactactgatttagttgcgttacacccttttcttgagaagaaactacttgcgcagataccaagatgggaactggcatggctgcaatgcggaccacggatgggcagggcatcccttgtaaggggccgcacccaacgttgctcgcgaaccgaacgggccctatgcggacgcatcccaatttagtgggn

SEQ ID NO: 584007 - DNA, 991 bp, Homo sapiens
gtttctgtcagatgtggtatgctattttcctagctgttgttgcgtcctggtttgctgaggggtgggagccacccagcgtctcagggacctgtcctccgtcgacgtcgtcaagtgtgccttgtgtcttgtgtcaggcctgcccttcccaccagcatgtgcctcgtggctcagggtgccccaggcctgcccagctagtgctgtccgtcccatctcctgtgggcagtcccttcccgtgcaggcgcatgggcttcctgagtagggctgagtgcaggccatggcccctgtgggtggcactggaggggctgtgacctgtgtccccagttgttgccctccccagtggactggctatgtgagcctgcttgctcactagagagatggattctcacctgtcgacctgactcgagcccctctgcttcctggcctaagcgagggttccaggtttcagacactggcagccaagtgaacgagctgtgctcgctgggtggtgcagtgcctggcaccaggaggcttgcataccgcctttccttcctgacgtcctctgtccttggttgctggcccatagcagtgcctgccgtgcctctgtgtaccctcctgtagccaattcccgatatcagtggggaaatttcgtgtctattgtcaggcgtcgcatatgacgcccaggatggggggccactgtggcggaagggggtcctgtggaacaactcttggcacaggacctgccctgtaagttgtagggggcatggtggctgggagcggcagggatccgaacgcgtggcggtggttgtgaaggaggctgttgatttcttcgggcccatgggtccagggtgcccgaaggagttcctgcggccgatttgtccccagtttttaacacgtgcctcgagacggggccggttaacgtgtcccgcactggcgtgggggtccccttaaaaatctctccatgtgagaggtttcatcaaacccggtgcccccccatattctaaactgacacaag

SEQ ID NO: 584008 - DNA, 120 bp, Homo sapiens
tggtgctagtcgacggtagaataatttcatggtgacttccctttggcaagccctgctatcacctgcgttgggtcttttaagatgtaaatggtaccttgagttacctggcccagtgaaata

SEQ ID NO: 584009 - DNA, 292 bp, Homo sapiens
ttaaaacgcctttattccctgcaacagttaaagcaacaaaatctaatgacatgaaataaacactgcaaaactgcattctgaccccttgctgcaaggtttttcattaaaacaattagagcccatggccccaagaatgctgagacactttcaaacttgacaacatttagataactggaggaacaccagcatcatgcctctgtgtgaacatttcggagaaggtgaaataaattaggacctgcaatacaattggaactgaatcctcaatacacccactttcctcagaagtgtgaaa

SEQ ID NO: 584010 - DNA, 401 bp, Homo sapiens
tacggcatcatctggagagaagcagcagaagaatgaaaacgctacgagaactcttggaactatccgtgtcaagatttgtccgggtaaaacagagtactcctttctgggactatgttatgggaggctgtccgagtcaattttccctgttgtggcatggacttcactggctccaatggagacccctcctcacctgactccctacactacctgagtccaacaggggtcaatgagtacctgatggcactgtggagtgtgggcagcgtggttcaggactatgactcgtgagtacctgcttctctgggctatacccgctccctgcagatgcttcagcctctgagcttacagtcccctcactgccttttgcccaatacactgtcctcccacagagacaagctgttccc

SEQ ID NO: 584011 - DNA, 330 bp, Homo sapiens
ggctttgtcccctgcctgccgcagagctggacagcacgcttccctgtcctgaacccggacagaagatttcactttgactccagagggctccagttgagctggaggtgtttagagagctgccaaagctccccctcaaatttctctcaggggttcgaggagctgcaggggacagcgatctgtgtcagcatcggggagccgtggagccgccatctccctcgcgacccagctccggccgtggcccgggattgatgacacgctcagtgagagggaaaattacattttcaggatgtctgccagggctcgctttgataaatgtttaaaaatgtgcta

SEQ ID NO: 584012 - DNA, 275 bp, Homo sapiens
  misc_feature (36)..(36): n is a, c, g, or t
  misc_feature (84)..(84): n is a, c, g, or t
  misc_feature (189)..(189): n is a, c, g, or t
  misc_feature (221)..(221): n is a, c, g, or t
acaaatggatatgtaaatatcactttgagatccttntttgacgttttttggatacatacccagaagtggggtttgctgggtcangtggtaattctattttcaatttttggagaaacctctatactgttttccgtaatggctgcagcattttacattcccaccagcagtgcacaagggttccaatttttncacacccttgccaacacttgtaattttctgtncttttgatgatggcgcttcttgtgggtatgcagtgatatctcattgtggatttt

SEQ ID NO: 584013 - DNA, 143 bp, Homo sapiens
atgactgtcctggtcttactgggacagtctgtatgaggcatgtcaccacacgtgtcgcctcatagctgcaagagagaggcaccagcgtgaagttcccctgtactgacagagatgcctgtggatcattcaaccgcctccggggc

SEQ ID NO: 584014 - DNA, 223 bp, Homo sapiens
ctcgggcccctgcaccaacaagagagccaaagtctgcagttgcatttccgagtcttgggccaagacttttctttgcagcggggagcacccagcccattttagccctgccagtgttgagggctgtgtacaaaagcccctgaaggatgcccctacccgaattcctgccctcgggcaggctgcccccaaaaaaggaggcgtcagggtgggccacagctgttcaatg

SEQ ID NO: 584015 - DNA, 406 bp, Homo sapiens
ccccctccccgggtactataaaaaaagtagaagataaaaatttttggagaggatgtggagaaaacagaatcctgggcattgccgttataatcgtgaaaaagtaaaactgtgatggcaaacagtatggagcttcctcaaaaaaattaaaactggaactaccatataatctagccatcccatttctggatatatattcaaaagaattgaaaacaagattttgaaaagatacggttacacttgtgttcatttcggggtgattcacaacaaccaagaggtagaggcagtgtaatatccacggacagatgaatggataaagaaaatggggtatatatataaaatggaatattattcagccttaaagaagaaaattgtgccaaatgctacaacatagataaaccttgaaaac

SEQ ID NO: 584016 - DNA, 646 bp, Homo sapiens
ttagatctcactttttatactattttatgcataattttagacttcctcattaaatacaaagatctatttctcaaatctaatactatattggtaacaaactaaagattaatgtgtaggataaaattattcacataatatattaattggtgctctaatatcctcatagtattattgtcttttattcttcatattacacttgtaatactttttactaacgtaactcctaattactggtgtcattctctatcgtctttccctctgtttaaaatactttcaacatatttcttctttagccatctttctcaatagtatttctataccccaagtagagaaccatccctttcaatctttggtgctttgattaaagatatcacaggaaattgtttcatattgcaggtttgactgtggtgcaatgaatgatatatgttagaaattgtttgttattttctgaatttttcacataatctgtattattgctgccaaatgtatgttcttctaaaaaaagtctcaaatttaattttcactctgtttagaactttgttatgtaaccttgttgagatccaattgggatgctatgagttagaaccacataaaagccagtctgctgaagattatcttaagtcttttatggattcaaaagatgaga

SEQ ID NO: 584017 - DNA, 340 bp, Homo sapiens
  misc_feature (75)..(75): n is a, c, g, or t
  misc_feature (81)..(81): n is a, c, g, or t
  misc_feature (90)..(90): n is a, c, g, or t
  misc_feature (98)..(98): n is a, c, g, or t
  misc_feature (103)..(103): n is a, c, g, or t
  misc_feature (105)..(105): n is a, c, g, or t
caatatagcataacctattatatattggtcctagcctttctattagaactattcagagattcctcagtattttanagcagncatcaaaantggacttngtatngnttattcataaaagacacttggtaatagacttcagtgaactctgtatgaatgcaatagttatgctgtaatagtttatgctgtaatagtttatgctgtaatacgtttatgctgtaatacgtttactgctgtaatagtttatgctgtaatagtttatgctgtaatagtttatgctgtaatacgtttatggtgtaatagtttatgctgtaatagtttatgctgtaatagtttatgctgt

SEQ ID NO: 584018 - DNA, 461 bp, Homo sapiens
  misc_feature (196)..(196): n is a, c, g, or t
  misc_feature (202)..(202): n is a, c, g, or t
  misc_feature (211)..(211): n is a, c, g, or t
  misc_feature (219)..(219): n is a, c, g, or t
  misc_feature (224)..(224): n is a, c, g, or t
  misc_feature (226)..(226): n is a, c, g, or t
tcaaacagctcgataagcctttttgactgtgtacatctgtaccgggaataacattcctaggctgaaatttccacgaaagaagtagagaccgtgtacgtcgagttgcttcatggcgtgagttgcccgtgacctgctttgggcgattttgtatgttgctatgtgaaagtagttgcagatgtttcctgaagtattttanagcagncatcaaaantggacttngtatngnttattcataaaagacacttggtaatagacttcagtgaactctgtatgaatgcaatagttatgctgtaatagtttatgctgtaatagtttatgctgtaatacgtttatgctgtaatacgtttactgctgtaatagtttatgctgtaatagtttatgctgtaatagtttatgctgtaatacgtttatggtgtaatagtttatgctgtaatagtttatgctgtaatagtttatgctgt

SEQ ID NO: 584019 - DNA, 142 bp, Homo sapiens
tgcatgctcgggtactggaggatcctctaaagtctgaccaggctccagcttaccgatatttaggagagtcagcaacggtgctcacgtgtcgacggaacttgtccaagggaggcatgcaacgcagtggtgaatacacgtcgac

SEQ ID NO: 584020 - DNA, 870 bp, Homo sapiens
tactgtgattttcccatggccttagtaaccagcagaccaggagattctctcccattcctggctcagcaggtcccatgcccatggagctttgctcactgctagcacagcagtctgagatctaacaacgagggtgcagcctggctgggggaggggcgtcccccattgctgaggcttaagtaggaaaacaaagcagccgggaagctcgaactgggcagagcccagtgcagctcagcaagttctattgcctctatagactccacctctgtggggagggcatagctgaagaaaaggcagcagaaacttctgtagacttaaacgtccctgtctaacagctctgaagagagcagtggttctcccagcacagcatttaagctctgagaatggacagactgcctactcaagttggtccctgacccccatgtagcctaactggggagacatctcccagtatgggccgacagacacctcatacaggcgggtgcccctctgggatgaagcttccagaggaaggatcaggcagcaataattgctgttctgcagctccactgtgatacccaggcaacagagtctgagtggactccagcaaatccaacagacctgcagttgagggacctgtagaaggaaacttaaaaaaaacacaccacaaaaaaaaaacattgttgggcgggctggcccaaagaggttttaaaacaaccgttggggggggccaatagtaatagaacggcccacgggtccaggacccggcactgaaggtgtgttccccaaaaaacggcggcggggtcgaacaccagaggttgcgctcgggtcacggccggcaccccccggcgcccgaaaacacaacagagacacccaaaacggcacacgaccagc

SEQ ID NO: 584021 - DNA, 179 bp, Homo sapiens
gggtgttgttgcagttgcactgggctgctgtggacgttgtcgattcctcactacggcccaaggttgtggagctggcagaaaagtgggttgttggagttgagctcgggctgccgtgggaggttgtagatagctcaacaaaggctgatgtggtagtaggagctgcagctcgcccctgagtt

SEQ ID NO: 584022 - DNA, 150 bp, Homo sapiens
tccacagcaactaggcgaggcctgttaattggaatgagtcacatttaaattactttaaagaggatccatatgcagggcaagtctggtgtcgagcagccgcgttaattcagctccaatagcgtatattctagttgctgccgttcaaaagct

SEQ ID NO: 584023 - DNA, 357 bp, Homo sapiens
gggagaaccagacactatcaggcactgcgaggatctctttttaaatgtcactactgtcgtcacaaaactgatgatgatactggacatgaatggggatgagaggagggagatgatatgacgtgaccactccagccgtttccaagtagacttactatacttacaccccttaacatctttgtgcacacattacaggtggtgtgggctgtgatgatggcatcctagaagccattggactgtgcggtttcctctatggtgcatttttagatctctgtgactccctgtgatgccccccatatgacgcctgtttctctcactatgcagtggacccgacacgatgagtagtgttaccagcagtgg

SEQ ID NO: 584024 - DNA, 733 bp, Homo sapiens
  misc_feature (50)..(50): n is a, c, g, or t
  misc_feature (93)..(93): n is a, c, g, or t
  misc_feature (119)..(119): n is a, c, g, or t
  misc_feature (163)..(163): n is a, c, g, or t
  misc_feature (299)..(299): n is a, c, g, or t
  misc_feature (441)..(441): n is a, c, g, or t
  misc_feature (602)..(602): n is a, c, g, or t
  misc_feature (633)..(633): n is a, c, g, or t
  misc_feature (645)..(645): n is a, c, g, or t
  misc_feature (660)..(660): n is a, c, g, or t
  misc_feature (677)..(677): n is a, c, g, or t
acagaaccaaggctgggtatcaagcaacctcatgacttccactgcaactntttaacatccccaattcctggtttttcagttcagttggctganaaggatggaaactggagttttaagtngagaagcagaaagagaaacatagattgatcctcaaaagaaaatnaaagaatccatttatcacagttttatcctcatactccacagttagattgcttctcctgaagctgctttgttagtttctgatatgaagacagagaagccacttctatgtggaaaaggatttgccagaggttcctcanttcgtgcaggtacatgttgcccaggcaaattaagagcagcataagccccaccttcatagttctggctggtctgttgaacaggtacaaattacattggaaaatgcaggctacgaaaggtacaagaaaagccagattgtttccnatttcctcatgggcaacctgttaagaatgttctgcaaggtgaactcctcgaatgagatttagggcagcgcacatgatgttgagaatgagggagaggatacccagggctgttactggttccatttggaaattaggagcaggctccaagtgcattggtgtgtnaacattcatcaccccatttgccacaactgtnttctccagagtnagaaccgctggaggntgcaacttgagctcctnctgaattttttccaagctgcacttcatctgagaggaacttacatagttaaaatgcc

SEQ ID NO: 584025 - DNA, 137 bp, Homo sapiens
  misc_feature (29)..(29): n is a, c, g, or t
  misc_feature (68)..(68): n is a, c, g, or t
  misc_feature (114)..(114): n is a, c, g, or t
  misc_feature (121)..(121): n is a, c, g, or t
gtttcgagtggccgtggcagtatcgcttnccacccttctttacgttacaaccgcatgtggacactcgnacagaagcagctggccgcctggtgctcgcttgtcctgtccttctgncgtctgnacaaacaatccagcat

SEQ ID NO: 584026 - DNA, 320 bp, Homo sapiens
ctgccctaattcccaccacaccttttctaaatgtcaaacctactttactattaacaatcagcatcaagttaattgaaagttttttaatcgactggtgcagattataaaaatattcctttttaaactatctgtggtgaaggactagtattattcttccaattcatcatcaaccaagacgtggtcctacagtgcctgctttgggccacttgtgacctaccctgtgagtgaccaagctcatctatgtcctgttcagtgaggcaggattaattgagaacacacttggatgttgcagcacaaccaccatagatggttacgggggt

SEQ ID NO: 584027 - DNA, 386 bp, Homo sapiens
tgcgatccttaaactgactagaggcaggttctgctacgttggccaggctgtctcaaactcctggcttcaagcaatccacctctctcggctcccaaagtgctgggattacaggtgtgagtcaccacgcctggcccttttttttttttttttaaaaaaaatggagtctggctctgtggcccaggcaaaagtgcaggggggtggtcccagttggtggcaacctccacctccgggtttcaagcaattctccggcctcagcctcccgagtagctggaactatagggcgcatgtggccacgcatgggtaattttttggtattttataagtaaagatggggtccacggtgtagcccagggctgggtacttaaatccctgagctcaggcaatcc

SEQ ID NO: 584028 - DNA, 830 bp, Homo sapiens
cactctttgcgggtcttattctcccgcgccccgtatgattttcggccttctgtgcaatgcggtgagcccccattctttccgcgcacattgtcctcccggcgtcattcgcctcctggggtttctctaaggctcttcttccgtagggcattgctgaaccatcacgtgatggggcgcccggcggtctttggtctcccgcgcggtctcctcttgctccccccgccgtcgtacacatgtaatgagggggctgaatacgcccccccaggcccctctctttcgattccgccgccccccgtggccctggtgggaataaatactgcagccccctgccccttcttgagggatttctttactgcgcctcggggtgtttatttcccccccccgaggacgccccctccacccttcttaggaaccgttccctcgcgagggagtactcctcctctctctgtcaccagggagtggaaaattcgacgtgtctcttatccacacaaacagatgtgggggaggcaacctcctcggcgccactcctcgccacgcacagcagtggggtttgccctccgacagagattggagcgtggcggaccatatttcctgtttgaatgggcgtcgtctcctcctcacacgcccgggcttgtatagagaccccttcgtggagtagccccccggatgtttgcaaggcgcccccttgccatacttaatatagcggtcttgacggcgcatagcattgctacgctcccccgcctcatatgccgtccctttctttcgtgattggcatgccaacgagcctggcggcccaagatggagaaaaaactgttgtttcggcccacaagaca

SEQ ID NO: 584029 - DNA, 159 bp, Homo sapiens
tgatgcccctgttggcgatgattgaggcaggagagtcatttgaacctgggaggctgcagattgccgtgagctgaggtcatgtgattgcactccacctgggcaaggaaagcacccggcgacaggacaccaggtcccccacctcatcattcctcgcaacag

SEQ ID NO: 584030 - DNA, 741 bp, Homo sapiens
actctactagcttgtaccgctgacacctagtaggacagcttggcattaggcctccatcgacggaactgaaacatagatctccatgggaaaggcggcagctcgagaacgcgtggattcgcgcggctggaggaattcggtgcgaggactggagaccgacattagagctggacaaactgggcaagggtgcctatgcgaaagtctacaaaggctaaagcgagctcacagacaaccttgtggggctcagggagatcagactggaacatgaagagggggcaccctgcatcgacatccgggaagtgtgcctacataaggacctggaactcgccaacagggaggcgctcatgacattatgcacactgagaaggtcctgacccttgtctgtgagtacctggacaaggacctgaagcagtacctggatgactgcgggaacatcatcaacatgcacaacgtgaaactgtttctgttccagctgctccgtggcctggactactggtacctgcagaaagtgctacacccagacctaaggctcaagaaactgctcatgaaccataggggatagcttaacctggctgacttaggcctggtccgagccaaggtcaatcctcaccatgacatactccaatgaagtggtgaaactgtggtaaccggcctccgaaatcctgattgggtccactggcttcttcacttagattgtcatgatttggttatggctatgatattttttaaaaattgctctaagca

SEQ ID NO: 584031 - DNA, 253 bp, Homo sapiens
cagcttgtgcatgggccaatcttctttctgacactccacattgcagtaaaatgcctgcttgcatcttccacatttggacaatccttctttcctggtgaagcagtactcgcagtggttgccccgctcgttgaccgtgagcacgtaggcataggccgggcaggagaacagcaagtcccccacctggaagggctgcagagcccgcagcccccggcctttgcccgggctgcagaagcgctccaggccgccgaggccc

SEQ ID NO: 584032 - DNA, 362 bp, Homo sapiens
cggcacgagggagactccatcaaagcaatataaattctgatgaaattgaaacaagaagaaacattaaatttatgatgagaccagatgcagtggctcaggcctgtaatcccagcattttcagaggctgagacaggtgggccacatgagcccaggtattcaagaccagcctgggaaacgtggggaaatccccttttctacaaaaaatacaaaaattagctgggcatggtggcacatacctgccgtctcagttattgtgaagtctgtgcagggaggatggcatgaacctgggaggtcaagattgcagtgagctatgatcatgccactgcactccagcatgggtgatggagagagatactgtctta

SEQ ID NO: 584033 - DNA, 305 bp, Homo sapiens
  misc_feature (23)..(23): n is a, c, g, or t
  misc_feature (66)..(66): n is a, c, g, or t
  misc_feature (133)..(133): n is a, c, g, or t
aaggtgacaaagaatttggcccngggtggactcagactaactactctaacagcatttctggtgtcncccagtgatcaaaaaagagagtggttgtggaacctgttggcccagttggtttcaagccagagacatnccagaaagtttttaccctctatatttgcatggtgctgcgtgagcggaggaatcctctgaatcctgaaaccagctcttgcctctcttccacggaagagggcctgggccacgtggagcctcagtgcccgtttggcctaaatctctcgctgacaataaagagcaccttgcgttgc

SEQ ID NO: 584034 - DNA, 407 bp, Homo sapiens
  misc_feature (161)..(162): n is a, c, g, or t
  misc_feature (168)..(168): n is a, c, g, or t
  misc_feature (232)..(232): n is a, c, g, or t
  misc_feature (281)..(281): n is a, c, g, or t
  misc_feature (352)..(352): n is a, c, g, or t
  misc_feature (377)..(377): n is a, c, g, or t
  misc_feature (393)..(393): n is a, c, g, or t
agaagaatgaagatttgcaaagagaagcagaagtaagagaaaatttatggcccctaaaatatggcctgggcaggagcagaactactacaaatgcattttcacctgggtgaaaagacttgcagctagagccaggctcaacgccacgtggaagcggccaaggnntggggnctgcaccctctgaagcaatgcctcaagctgtaccttggcccattttcaccatggctggagctcngagcagcagggacacaggtcaccaagtcgccaggctgcacacagcagtngagccctgggcctgacccacaatctattttttcctcctaggcttcaggaccgttgaagggaggggctgccnttaaagatctcttgacattgccttnggagacttttctttcnttgtcttggtgatt

SEQ ID NO: 584035 - DNA, 327 bp, Homo sapiens
ccccccccccccaagagtccccccgccgggggcccccccaaaatggggggttacagggggggcccccgggcccccccggggtttttttttaaaatttttttcccgggtgtgggggggaaattttaccagggggtgcccccctttaacaccccccttatgaatcccctggggtttcccttgggcccggggggttgtttgcctttttggggggtttttttgggggggttttccccccttttgggggggggcctttttttcttgtttttcccttttttgggcccctttggggggcccgggggaaaaaaaaaagggtttttttttttttta

SEQ ID NO: 584036 - DNA, 262 bp, Homo sapiens
caggttgggatactgaaaatttccagatgagctcttctttcctacaagtattcataattagggaatgccagggtttagggtaggggttaatctgttgggggttgatgtgtttagcaacgaagctactcctcagctttgtgctaaaaatatggttcggcactgccctcttggtggcacagggccataatttgttccaatagaccccctcttctatgccctgttgacttgtaaatttagttaacaatatatacgggtggggtac

SEQ ID NO: 584037 - DNA, 745 bp, Homo sapiens
tatatataagattattagtataaaaggggagataggtaggagtagcgtggtaagggcgatgagtgtggggaggaatggggtgggtttggtatgttcaaatctgtcatttatatttttacgtggtaagatatggtggagtagtgtgatttgagtgtgtgagtagattagtgcgtaggtagaatgtagagtgttaagtgaggtgtgatggtggctatagatggtggggatgatgaggctatggtttattgtgtgaattcttcgataatggcccatttgtggcaaaaagccggtaagcgtcgggcaggcctccctagtggacgatggaggtgtcggatggaattaacgtggtgtctacgtcatgtatagcttgtttcagtgtgcgaaatagtagtagggtcgtggtgctggacgttcaagttgagtaagtacgagatatgcggtagtagtccaggataatatcacatacgttaatcttaacaatggtactggtaagggttgtcacggtaaaactggctattatccactcctactggatgggtaaatagagcgagctactgcctaagacatatgagcaggtaaaaccggagaagtgggactaacatacccacctcaaagtgaccgaacatagaagggaacaaactgtgccacagtgcgaagcaaacatcaaacgataaacgacaggaaacaaaagccaatcaccgaacaggcgccgacaagcaccgtacaaaaaccaccgcaatcaaaa

SEQ ID NO: 584038 - DNA, 397 bp, Homo sapiens
ttgcctatattcaggacctgccacctcatgtgcacaccgtatctttctcaccttttttttgagatggagtctcgctctcttgcccaggctggagtgcaagggcacgttctcagctcactgcaacctccgcctctggggttcaagcaattctgctgcatcagcctcccgagtacctgggattacaggcatgtgccaccacgcccggctaatttggtatttttagtagagacggggtttggccatgttggccaggctggtctcgaactcttgacttcagatgatccatctgccttggcctcccacagtgctgggattacaggcgtgagccaccatgcccggcctctttctcacctttacacctgtcttcttatcctcacatctgttttcacattgggcg

SEQ ID NO: 584039 - DNA, 607 bp, Homo sapiens
ttgggacggcggactgtacgggaaagcatgggcaagggcggcccgggtcggcaagggcagtgtgtctggtagaggcgccctgagccatcgtgatcgtggagagacaggttgggcatgttgccgcagaggtcaccgaagatttagtagcactggtcggagaaggtgatcttgttgacggtatggcggattaagccagctttcagcaggttgctggcatacttgcgggcctccctccggtccgtgaagcctttcacattgtggtacagccagtccaccacatctgagccgataaaagcattagggatggtaatcttgagccacatgcggtcacggacctccaaccctgattcaggggaggccatggcttttacgatggcagccatgtcactgtggatggacaagtggaagtcgtctaggcgctctgtgtcagggatggaactggtgatggaggagctggtggaggtgatggtgctcagggaggggttcatgccgtatgcagggaaggtgccggtcatggctgccgtgtgggagacccaggccgcagggtccatgggccggatgtgccgctcctgggcaatgtgaagcaacacgtgtctttggtccagca

SEQ ID NO: 584040 - DNA, 670 bp, Homo sapiens
gaatgatgacttattcagcgtcttcataatcagcttcgtgattctctgcctccagctgttcctgacattagtagacaggcagaaagtctctcattaactagggaggtttcccagagcaggataaccattcagcttcagaacgtttacctgatgagtatacgtcgaactttttagccataatgcagagtgctacaggacaaagaaaccacaaacatggaccaaatttgcttggagaatcttcataccacttcgagatcagcatcttaaccaattccatcatcctctccaccaaaggacgtgtcgatcagcagaagtaacttcagctccctctgcttctgtaggtcttggcaccggttgtcaatggagaatcctatagcctctactatctatctgttccttatcctactgcttctctagtattctcagaatgagacgtgtaaatcgaaggcctacctcaatccatctgaaaaacttcctagtatataacatttataattatgtgtttacatgaattttttatttatttaggttttttttttttttttttttttatgttgaaaattctgccaaacgagatttatctaatattgttgtaaacattcttaagggataggtagaagaggcgtgtgtgtgttgtgtcgggcataatctgagttatctaagagatgta

SEQ ID NO: 584041 - DNA, 812 bp, Homo sapiens
cgcggtggctcacgcctgtaatcccagcactttgggaggccaaggcgggcggatcacgaggtcaggagatcgaaaccatcctggctaacacggtgaaaccccgtctctactaaaaatacaaaaaattagccgggcgcggtggcaggcgcctgtagtcccagctacttgggaggctgaggcaggagaatggcgtaaacctgggaggcggagcttgcagtgagccgagatcgcaccactgcactccagcctgggcgacagagcgagactccgtctcaaaaaaaaaaaaagaaagcaagtttcacattgaataaggctgtgtgggaaggcttttggattaaaatctttgggatttataacatcctgtaagtttaggagaacccggttttcccagagcagattcaagcttctaaaaataaagtgcttcagtagcaggaatggcatgtttaaaaagctgatggcaggtaagcatggggtagggtcttcttcaccattatctgtcacgtcctgtgtccctgcgtggaaatggtgtccttgactaaacccatcgggcttgtggaacccaatgtttgtggttctgaatacccaggtttgggtgggtatttattctatgtttttacatttttatgcgccttggttaaggtaaggataacattgggtttaggtggatcacgggggtatgggtttgaacctcaactttggatgggggttaaccgtggcttaaaacggggtggggaaaatatcttcaaacaagggagggaaaatggagacaacaggtggtcgcccaaaaagaaaaaaaaaagtgtggggcgcga

SEQ ID NO: 584042 - DNA, 697 bp, Homo sapiens
gagcgggggtgtgcgcgagagccgaaggtcgcgttcctgcagctgcttccgttgccggggcgggcgcctgggtgtccctggcgagcgtgatccccgaagggtcagcgcgcgcggagccccagggctgaatgcgcggtcggggtcgcgcggtccggagctttgcccgtctcgctggcgggcccgctgctctcccgtcgctcgtggcgctgttgcgggcgctagtagtggtctagtagcgcgtaggctcgcctcgggctgctatgagtcgtccgattgcgtcgtgtgcacgtcgcgttccctgacggcctgttctgcgcggcgagggtactgtgcggactgatcgcttgtgcatgtctcgcggagagcggacggcgcttgagctcgtcgcatcccccggtggggaaacgtagaaactgggttactcgccagctttaggcggaggggtttgaatgagagcgggtgcgcatcgggttggattccttcgaccgactacgtgaaaccattaggaacaaatccttgtggttaactagctcagcaggcttcatcagtgtaagctgtactcgggcctagaaattatgtaacatggcgactgatacgtctcaaggtgaactcgtccatccttaaggcagatcccagcttatacgtaggagctcagcctgatccacgcgggacaagtgacggtgagacggtagcacca

SEQ ID NO: 584043 - DNA, 223 bp, Homo sapiens
  misc_feature (4)..(4): n is a, c, g, or t
gttnttgatagtaggagcagaagacacatttatctcctgaggaaacaaatagattcagatagcccttattcacccataaacttttactcctcaaatacctactacatctagcagttacaacgttatttaaatggagatggataattacagtatgtacatttcttaaggttttggtactattttatctattttttgtttttgagacagagtcttgctctgtttc

SEQ ID NO: 584044 - DNA, 408 bp, Homo sapiens
gttcgaagatgatgaatatgcctaattaccctgaatctgaatcactacacatttatacatatcaaagccattactatgtactcccatgaaaacgtataattattatttgtcaattcaaaaataaaattttaatttagtttgttgaggcagggtcttgctctttcacccaggctggagtgtactagcaccatcacagcacactgcagcctcaacctcccaggctcaaacaatcctcccatctcagccttctgagtagctgggaccacagacacacaccaccacatccagctagtttttttaattttggagagacagagttttgccatgttgcccagggtggtctcaaatttcctgagtgcaattgatccacctgcctcagacttctaaagtgctgggattacagatgtg

SEQ ID NO: 584045 - DNA, 672 bp, Homo sapiens
gagtgtgggagtttcgcccggcgcccttgtgttgagccgtttccccgggcccccccttgggttttaatgaagaggtgcgcgccatattgggcccccggccccccttgttggggtgtgtgtaccccaagcgtggcccccaggcggtggtccccgtccatggggggaacccggtggaccttcgtggaagtgtgtcccccccgcgtgtgggccccctctcttttgggccttgggtggtgcgaaattgtcccgccgtccgacccgggcgcgtgggtccccgaatccgtggcctccgcggcccccccgtgggcccgccccggggggcccccaataggtccaaccggtgggccccccgcccggggtttttcgggggcgcccgcgccccccccccccgcggcgttttggagccccccccggggaaccacgcgggttcttttgcgaagagtttgtgagccacacgacggtgttggaccgctcttcttataaatgggtggccccacgctaatatagtgtccttgtctttttaatggtcccccccccttcctcttccgcctctttctctctgggaccacaaacctcttctttgggtgaaggaagatttccctctttctctcccacgctttctatccccccctcaaacaaatttgtttcagagagaggaacatatacacaaaa

SEQ ID NO: 584046 - DNA, 493 bp, Homo sapiens
tagcactaataagctgtgtgcgcgacacacaccacagaggtaggaaggaccacctttaataaattatcttcttaatcgcagagaatttctgaagataaaactgacaaaatgctaaaccaaggctttgatgagtcccaaaggaccacagatccatcggctcctatttgaagaattcatcccctgtagggttctagcctatgtagggcactggattacaagaaccaccagggctttgaacaactgccctaagaagccttctaacccactctcatttgccgattctttggaccacccactcctgctgggagaaaggccacaaattggctctgttttcaccccccagggacattgcaccccctcgccccgaatcctttggccagaggggccaaatctcctaatttggcggcccgataaaatacgcaaattccgccataccctctgtccctccgtcgaaaaagaatacctccccccccaattcccccacacaaattcg

SEQ ID NO: 584047 - DNA, 149 bp, Homo sapiens
  misc_feature (16)..(16): n is a, c, g, or t
  misc_feature (44)..(44): n is a, c, g, or t
  misc_feature (73)..(73): n is a, c, g, or t
  misc_feature (119)..(119): n is a, c, g, or t
tcagaggccacagagngaggtgacagtccctcatctccctcagnctccacagtcttctggctctcctcctcgnctttccgcgtaaactcctcgatgactatgtcctcagagctagcggnctcatgagatggtttcggatggatcaggac

SEQ ID NO: 584048 - DNA, 384 bp, Homo sapiens
aatagacaagcaggggatactggtcaggctgaatcatcctccccgtggatacagagctgccagtatcccctgccttgttctatcctgtgtagtgcataggagaaaagggcctggcaatctcgtacacacaaagaggagaccaagatgtgctcttcctctcaagggaaaggggaaagctaggatattcttaagagaaggtaaatagctaaagccaaggaaatgaagggctatgatggaatagcctggacatgatatagagtgaaatattttcaagcacaggagttatacaagtggcttaaatgtatcacatgtgtacagttcatctcagtacctgccagcctcactttgaggtataaaacatggacagaaatgggtctcataggg

SEQ ID NO: 584049 - DNA, 208 bp, Homo sapiens
aaccagagaccgagagcatgagtggggtgtgctcgtgtgcgtggatccgggtgtgtgtgtgtgtctggtatatgtgtgcgcagagtgcatcattttcagactctactatttccgtcaagtttctgtatgatttggatcatctcaggatcggattctgttttagagtgtctctgggcccagatccgggcccctgccctcctctgcacct

SEQ ID NO: 584050 - DNA, 1348 bp, Homo sapiens
ggagtcacagtgtaagtagagcgtgttttgaacacgttttttcgtagatgccttagcagggattatatgccgtccgccattgtgttaatgagccaaggtgggcaccatgaataggtcggtatgtcttggttacgtagtccacctagtggcttctcatttattaagtgaagctttctctagagcaaggcacatggattaatgctaccttgttttgatatagcatatatgttttgagctatgacatctttcagttggttaatctctgtttaaggataagtcaaatttctatcggaattggccccctagggcgtttggggtgggaacgatacgtggatatttggtccttatctgggatcccatttgtgttcttcttagggtatagctgcccatgagtgtgtttgatcgtaaggttttctatcggtaagcactggggattgcttgctgcttgggagaattggttacgttcgtttcaccttgtgttccacggcgctgggtaacggggggtacaagattgcgttccgtgggtattccccgttagtatttccctcgggcgttaagggagctccgtggaataaggttgctaacggcccatctggggttctttcccggaaggtagcgtgcccaaggatatccttgaaccatggtggtggaatcagtgttcttaaccctctgcgcttgcggcagcgccttgggttggtttggggttcatgaattggcaactctcgttttggtctatctgagggggacggtgattgtgttctgcgtgccaagggttgtcaggaagtgctcataggggaccttgtggtttttaacgcggtagtgggcttgtggtttttttgatatgtgtgttatttaaaccgcccaagaggtttcgctaccaaggacatgccctggttcttgccctagatgtaagtgttggactatctcctttagggtctcagttggtataagttgccgtgcttgcaatcaatagaagcttctttgggctatagttaggtacttatacagtgtgtcggtagatgattgtcagttggtattgtaaataaagagaagtggtaatgaatgggtattggtatctgaatgagagttcagttgcttgttccggaaatcccgatgtggaatggagtagagcctgtgtgccactgttgagtccatcccctgggtacgcgagtcatggcaatccacaggccctctgccacaggacgccagcctcggcctcagagtatgccggctgtctgcagagaggtgtttgcatgtataaactatttattgtttcttattccttcgatttgtgatgtaattaatcttagagagcttatatccgtggaggtaaataagtcactatggg

SEQ ID NO: 584051 - DNA, 470 bp, Homo sapiens
gctcgacaacccaaacaccaaacgcctggcacttggcaaacattaccagagtaggctgaaacgaaggctggtaaagataaaagactctaccggcactttcataggttattagagcacacgcgggccgttccagatgttccgcattacccgcgtttttattgtcttaagaggaactcctgaaaaatgctcggcattctctctgggtttgccgcagccgtttttagttgacggcgtcgttcatttcctcttcgtcttgagacgagacgtaaaggccatcttctgctccaacaacaaggcagcacttactacagtgggctgaagcgtaatatacgtattcagggtaaatggaacggccaagtgcaccgttaagtgcatcatgagttttgtttaccagcctagccgcttgggggagggtcggaaaatccgtgacccaccggtccctctgtcgacccctgtgacctggcgcgaat

SEQ ID NO: 584052 - DNA, 986 bp, Homo sapiens
tatcctctcgcgcacacaaccaacctaccctttaggtgaacccgtaacggaccattacatgtgttcctatctgtgtatctgcccttctacttgggatactatttaataaagaaagtcatcattgtctacgttgaaagcatctgccgtgtagaaacgttatccatgtccggaaagattctcgttcatctctcaaattacttcattgtctaatggacggttctgaaagaaaagcatcccaaatcggcgtaccttgcgcgaaccgtttgacaaccggcaccctgcttctttccacctctccagataacacttactctgaaccccaactcggcgcaaaatcaaaccactcttgtttctctgcacggcgatctgccagtccctgctcttcattgttacgtacgctgattcacatgtctaccacacaagtgtcagtccgaacctagccctttccttcttatccctccaccacgctctaataccccgcccaccccatccacaactttaggatgaccacaccctccaaaactcatctccacgcccaatcttcccccccccctccctccattcctccaccatccagcccgctaacacgtcgcccgctctacatccctctccacggcgttatccccctctcacccaactcagacaaaactgccatgcacgctcctgggtacgtccccatcatccctcaccatcccctcacccatacccaacacctacatctccatcaaacaacccactttcttcacatcactcaccacgccccactcttcactcgtcacgtctcacaccttatcctcctcatacatcaatcaccgccatctccaccacgcaacgatgatctcaatgcccccgctaatatactcttcgcccctccaccagactcctacccgatatattatctccacatataacccagctatctttccgcctaccacatgttccaggtcatctacacctaacacaccacccgtaaaagacttccattg

SEQ ID NO: 584053 - DNA, 102 bp, Homo sapiens
aagtacttcttcggcggcaggacgttttcttcgaagaagccctcattgacaagcattccccgctgggaagtatctggccaccacaaagggggtcccggtgtt

SEQ ID NO: 584054 - DNA, 910 bp, Homo sapiens
  misc_feature (7)..(7): n is a, c, g, or t
  misc_feature (40)..(41): n is a, c, g, or t
  misc_feature (49)..(49): n is a, c, g, or t
  misc_feature (98)..(98): n is a, c, g, or t
  misc_feature (101)..(101): n is a, c, g, or t
  misc_feature (115)..(116): n is a, c, g, or t
  misc_feature (136)..(136): n is a, c, g, or t
  misc_feature (169)..(169): n is a, c, g, or t
  misc_feature (189)..(189): n is a, c, g, or t
  misc_feature (202)..(202): n is a, c, g, or t
  misc_feature (205)..(205): n is a, c, g, or t
  misc_feature (221)..(221): n is a, c, g, or t
  misc_feature (224)..(224): n is a, c, g, or t
  misc_feature (240)..(240): n is a, c, g, or t
  misc_feature (244)..(244): n is a, c, g, or t
  misc_feature (248)..(248): n is a, c, g, or t
  misc_feature (276)..(276): n is a, c, g, or t
  misc_feature (304)..(307): n is a, c, g, or t
  misc_feature (311)..(311): n is a, c, g, or t
  misc_feature (313)..(313): n is a, c, g, or t
  misc_feature (315)..(315): n is a, c, g, or t
  misc_feature (347)..(347): n is a, c, g, or t
  misc_feature (350)..(350): n is a, c, g, or t
  misc_feature (372)..(374): n is a, c, g, or t
  misc_feature (381)..(381): n is a, c, g, or t
  misc_feature (467)..(467): n is a, c, g, or t
  misc_feature (512)..(512): n is a, c, g, or t
  misc_feature (520)..(520): n is a, c, g, or t
  misc_feature (549)..(549): n is a, c, g, or t
  misc_feature (685)..(685): n is a, c, g, or t
  misc_feature (707)..(707): n is a, c, g, or t
  misc_feature (713)..(713): n is a, c, g, or t
  misc_feature (790)..(790): n is a, c, g, or t
  misc_feature (824)..(824): n is a, c, g, or t
  misc_feature (846)..(846): n is a, c, g, or t
  misc_feature (897)..(897): n is a, c, g, or t
tattatngtttttattatttaaaaaaaggaagagaattgnngggggggnggggagggggtatatataaatattataaaatcatattagaataaataangtngtcataaataaagnncccattgatttatgggtggngtttgggaacggctttggctatttgcttttggngggtaatttgggcaccaggnttccccctcaggngangttccagttaccaggnganactggaacctcaggtntatnaaanctggaggggcagtgaaggcctattattnacagcacataagattctaggagacagannnnggcncngnagaggtggggcgcggcgcgcgcgcttcattgngtnccttaaatatgctagaattttnnngggggcnagaacctcggaagacactccatcccccaccatcatgaatactgagcttgcacacttggggacctgccccagcgtgaggtcaggggngtgggttaatgcattctggaaaaggggattacttgattactgtcncccaagtncccacagccctggggtccatgcagagacnacagtgcaagagacgtggctccccgctgagatccagctgatctgaccgggcagtcactttgtcactcagaaacagagatgcgattgaagatggggagtcggcggggggctgccacgggctggggtggtgcaaaaantcccgcctcgaagacgggagantcaganccccccaggctgctgccgctgctggcatattcatcagggtcggatcccagggactgtacagagggggtccgaaccangccacccaagggcccccagacgctgataggagtngcccttcggcaggaggggcaanagactggggtggggtctcttcgagccagggggggtgccaggggcagcaganaaggcagagggtg

SEQ ID NO: 584055 - DNA, 810 bp, Homo sapiens
  misc_feature (639)..(639): n is a, c, g, or t
gggcaggcctatttgactccaaggtagcagctgtggtaggatagagactaaaagctggaggagggtaggcgacatgaatgctgtagaccaggagcggtggggtacaaagggggcccatgcgggagatgccacttggccagtaggacctccgaagaggttgttatcccaggcgtggaggtgggggccatgagcagactacagaggtgcaggcacgcgaggattcgtccgacgttcgttcgcaggcccatgctgggtccacgagttctagactgtcgccttccgtccctaggcccgtggattctgtgctatttccgtggtcgccctgacgttatatctagcttgttcgccctttccccaaagctcatcttccagaacttttccctcatcgtcacgtaagccgcctaggttgcactctactaactgcagctcccgttctagcatgtctgccgttctttcgtagcaaagagagagaacagcggagctatgacttagttcagtgcagagagataggtgaggccagctcggagatcttataccagtctgtacttggacaaaggctagcacagggctaggcaccgaataacagatttcgtagtgagtgcacaatgacaagagcacctgactacaatgcgagcaacntgtaacaacaagagacaatggagtacacagtccttcactgggcatccgagggcccagtcgtcgcgccgagcagagatatgccctccatctagcagaacactgcatggaaaggcacccaagcccccttgcatcagtgtccttcctcaattagcagaagagggcttactcatc

SEQ ID NO: 584056 - DNA, 193 bp, Homo sapiens
aatcctctttccaaagcaggccctcaccagtctcttttctctttcgtggttcacccctgtcaatggagcaaaaaaccaacattacttccccttagaactgcagaagggctttgtgtttcccaccaaaccccttcctggacagggaactactttggcttggtgcttttgatcccaaagttcccacagccgcagt

SEQ ID NO: 584057 - DNA, 164 bp, Homo sapiens
catgtacaagtgtgtgtgtgcatgcatgtggcagtgtgtcatgtatatacatgtgctgctgtgcgtgtatgtgtgcatgcatgtgaccgtgtaccatgtgtatacatgtgcaggtatgtgtgtatatgtgtgcatagatgtatagtggcagtgtaccatgtata

SEQ ID NO: 584058 - DNA, 319 bp, Homo sapiens
  misc_feature (63)..(63): n is a, c, g, or t
  misc_feature (115)..(115): n is a, c, g, or t
  misc_feature (130)..(130): n is a, c, g, or t
  misc_feature (276)..(276): n is a, c, g, or t
  misc_feature (290)..(290): n is a, c, g, or t
caggtgtgagccaccacgccagcctgacgatgtttcttacttctatcacttccttttgatttnttcttatagcttctatctctgcttacgtcacccatcattcttgcgtgttgtntgctttgcgcattanagccctttgcatgttaatcagttattttaaatttatgatctggtaattctaaaatgtctgccataactgagtctggttctgatgcttgttttcttttcagactgtttttttgtcttttagcatgccttgtaattttttgttgatanctagacatgatgtnttgcataaataaacaagtaaactaaggta

SEQ ID NO: 584059 - DNA, 544 bp, Homo sapiens
tcaaacaagggtttgaaacacctacgggaatttggctcccaaataagctggaattggtggtatatgcctcaaatataactgactgtatcctataggggtaacttttcaaacagcccttagcatttttatactatttaacccattggtgcatggagttttctttaaaaaatgcttgtggtgaaagacccaagatacccagtatgcttaaggtgaacagaaaatgtgtcctgtcttgtaaagggacactttcaagtatggtggtaaatcctgggacagaggttgctgacactttaaaaaacattaacttacttattataagtgacctaatttaaataacatctgaagattacccatttttgtggtcttagaatttcaaaaagaaaacgcaaacgggctgtccatagcgtgttggcactcaagggacacaaaccaagattcttctatcagggggcacatatttacactctttgccaacaataaaactcgtgtacgggatcactttacaaaaattcgatttgaccctccagcctgatacagtactaac

SEQ ID NO: 584060 - DNA, 903 bp, Homo sapiens
ggggcgaacacgccgcggtcctcgtcgtggtgcagtggctcacgcctgtaatcccagcactttgggaggccaaggcaggtggatcacctgaggtcgggagttcaagaccagcctgaccaacatggagaaaccccatctctactagaaatacaaaattagccaggcatggtggtgcatgcctgtaatcccagctactcgggaggctgaagcaggagaatcgcttgaatccgggaggcagaggttgctgtgagccgagatcgcgccatttccagcctgggcaacaagagggaaactccgtctcacaaaaaaaaaacaaaaccagaccgagaaaagaacaccttaagtttccacccaggcctgtgaagtaagaacctctgctagagaggccaagtggctgctccacatcatcatcctcctcagtctggtgggggctcaggggaagtctctcgtcactggcgactcggcggctccagggtctcagaccttgccccacacggaaagcccttttcacctatcccaaagggacgctgcgacgagatgtccgcaacgatggctctgaagagattcctcttgcgaatctgtcttagctcatcacagtgcatccaacgcttaaccccgggtcacaccttgatcaagcacagtggctgcggatggaaaaacctaggtggtgtggtcagaaagagctggagcgttgagaggtggggggttaagccatcgagcagctgctgggattcacccctcttcaggtgactactgctgatgggtactcttgtgcgacgcaagtgcgaagccagggtggggacttttcagagctaattaggcctccagagtatcacggtagttcatgaatcgtaatgacattgactggttctcgggattttcccggcacatacttttggggga

SEQ ID NO: 584061 - DNA, 225 bp, Homo sapiens
tcgagctcggtacctcttttagttgagaacacacatcgcaaatagtttctggaatgcttctgtctagtttttatttgaagatatttcctttttcaccacaggcctgaaagcgcttgaaacgtccgcttgcagatactacagaaagagtgtttcaaacctgctctatgaaagggaatgttcagttctgtgacttgaatgcaaacatcacaaagaagttcctgagaa

SEQ ID NO: 584062 - DNA, 745 bp, Homo sapiens
  misc_feature (175)..(175): n is a, c, g, or t
  misc_feature (213)..(213): n is a, c, g, or t
  misc_feature (230)..(230): n is a, c, g, or t
  misc_feature (248)..(248): n is a, c, g, or t
  misc_feature (266)..(266): n is a, c, g, or t
  misc_feature (276)..(276): n is a, c, g, or t
  misc_feature (288)..(288): n is a, c, g, or t
  misc_feature (303)..(303): n is a, c, g, or t
  misc_feature (306)..(306): n is a, c, g, or t
  misc_feature (314)..(314): n is a, c, g, or t
  misc_feature (334)..(334): n is a, c, g, or t
  misc_feature (339)..(339): n is a, c, g, or t
  misc_feature (346)..(346): n is a, c, g, or t
  misc_feature (359)..(359): n is a, c, g, or t
  misc_feature (362)..(362): n is a, c, g, or t
  misc_feature (378)..(378): n is a, c, g, or t
  misc_feature (383)..(383): n is a, c, g, or t
  misc_feature (466)..(466): n is a, c, g, or t
  misc_feature (473)..(474): n is a, c, g, or t
  misc_feature (522)..(522): n is a, c, g, or t
cgcggacttctgccaagcaccggctcatgtgaggctcgcggcacagcgttctctgggctccccagaagccagcctttcgctcccggacccggcagcccgagcaggagccgtgggaccgggcgccacaccctctgcggcgtgtcatgggcccgcgccgccgggagccgaaagcccngaggccccgaggaggcgcaccctgagcccgacccccgnccccccggcccctcccnggcggggccccttccttnaggcgcttcctcccatcnaacacagtcnggcggagacaanggtttggctaaaggngantccgaaangcttcagaagagcacaacancctcnttgatanaggaagctgcccnttncagccgcctggcaagnagaanatatgtgttaaattcactcgtggtgtggacttcaattggcaagcccaggccctattggccctacaagaggcagcagaagcatntctagtnnatctctttgaggacgcctatctcctcaccttacatgcaggccgagttnctctcttcccaaaggatgtgcaactggcccggaaggctccgggggccttgaaggaggggactcgagtgagctccttgcacccggtgttcctgtcagtcttacctgctcagccaggggggttgatccggggactctccgagcctgctagtccatggatctgcgagtgctgacttgcgctctacgttgtttgtcgtacttttctttggaaggacctgtatcctga

SEQ ID NO: 584063 - DNA, 196 bp, Homo sapiens
gtaagttatacccaagtataatcatatcagcataagcactataagtttagtcaccaccataagcactatagaatttccatatccttagatcataataagttattaaatccttaggtccaagtttcagccctagacctcaggccacagacccctcagaaccacctcagctccaccaagctagtagcacctcttccac

SEQ ID NO: 584064 - DNA, 371 bp, Homo sapiens
ccgcgtcgacattttgtcggcttgccctgggcaaagagggagtttatggtggaaagtgggtccaagactacccctgggttagacccctgccttgccccatccgctcctcccaagccctggttgcggcgctaaaatgtggttcaagctgacaaggccgagccgtggaggaatgctggggttcgcccgcagaagggatgggacaagagaggaggggtaaaggagaccccagtaaagggcaggccatttcaggtgaagaaaggtaagaggaatctgtgaagtcaagggccaggctgtggaggagattaaaggaggtcaaagagaggtaagggggtaaggttgctgaggtcgacgcggccgcgaatttagtagta

SEQ ID NO: 584065 - DNA, 487 bp, Homo sapiens
ctcgttatagaggatccccatccggtgctgagcatttgcctgtttcgcagctacttgggaggctgagacaggagaatgcttgaacctgggaggtggaggttgcaatgagctgagatcgcgccactgcactccagcctgggcaacaagagcaaaacaacttctcaaaaaaaaaagaagtttctaatctgtatatgtttacaaaaacagccatcccttttggtaaaggagtcagttgtagattggttggtccccaccacatggattatgcctttgttttctcagcagcagtgcctggtcatagcccggatccagaaacgctgcttaactgatcaaacagttgggcaggggtatgcccgtctccagatgcttagtctaacttcacgtggaataggctcgcatcctacccacgggattgcaggtgtttctttggcgtgatattccaccactgagaacattttgaaggtaccaggatatctctggtctcatc

SEQ ID NO: 584066 - DNA, 232 bp, Homo sapiens
atcactatatgcctgaagctaatctaccaaatcttgaaacctgagaatattctattctatcttcttccgtctaggtaagtagagttcctatacactacgcctactcatgtttagcgcagacctattgacagcctacagcatatacgctaaaagctacactctacaacctactacctatccagctacccgataccctaggaccatccagtatatctagagatctagctatact

SEQ ID NO: 584067 - DNA, 278 bp, Homo sapiens
tctcctcgtaggacggggtccctccccgagactgggtatctgtagcatgggaagacgtgatccacgtgggctcccactcggggcgcattcttatccccataaatagtataagccacgaccggaacacgggagtggacctgctgagcgtcctaacgtgtactgctagcaggaccgatgcgaactacataggtgggaccatccggaacaaggccaggccaaggcctctcccactaagggacgctacagcccatggtctccctagaggtatccaccacggt

SEQ ID NO: 584068 - DNA, 908 bp, Homo sapiens
taaaaaaaaaccccttttttccttttttgggcaaaaaaagcgggggagggggggggtttggggggtgttttcaaaaaacacaaacccctcatttcccctctcctcagttctcctccctcgcactcttcttccttgtgtttccaccctctctctgcgtggggtgtcgtgcaccacatcgctggtgactccgttgttggggtcgctgcccccacttgtggtgtctcatcccccaaagagtcatcgtttgtcttcccccatagagtgctcttgatctctttatgacgagagtggtggagggtgagtaccgcccgcgctcccacacaagacaacaagtgccgcaggagatccctgtgtcgtgcgccccccgtggagacagaacacaacacggggggagtcaccgctgtcccacccagtggtggggtgccgcccatctctgcgggcaaacacatcacctccggggcgccactttcggtcggtggagagccccccccacagagaggaggagcacatcatgagcaagatagtgtccccgccgctgtgtgtgttatttaccacaccctctccagagggcgtctgtcataagtgctcgcgccctttgtgtgtgaaacgctcgctcgctcgtgtgtgttgtctccctcgccccctaattggatgatcgcggggggcataccgtggtgcgcaccctgtgtttccccccgcggtgtgttctttccgtggtgccccccccccttgtttgtttccctccgctttgttagcaccagggagacctatcacaccgagaaatcatcgagatgggccccccggaaaaaatctgggggggtcgccccccaacggctcgaaaggggtcttctttctcgcgccccacctctttttgtcggtcgcccagtccctctgtgtggagtgctccc

SEQ ID NO: 584069 - DNA, 352 bp, Homo sapiens
acagtatctgataaatatttgtatccaagaacttctctacctatttcagccaaaagtctcatattggtcttagaggctagctagtatagtatacgcaagaggctatagcaatatgcccacaaagcaccagacaggagcaaattaggtaatcctctggagctcagggatgctctcgatgcactcatcttaaggtgctttaagcagttaactcacaggacatataaagagtcatatcaagataggcatatacaaagactgctcacccgtaagtttaagtccaatcaccagtatggtaccatctgaagccacagagtgtgcattcagtttaaaatgaagaagcttagccctgtgg

SEQ ID NO: 584070 - DNA, 941 bp, Homo sapiens
tctaagcccctcccgcgagcccctcccccacgttactccacgcctctgccctctctccctccctgacgcttgcctactgacctatcagtggggctcctctcaccgccaatctcaggtaatgtccccgtagtttacggtcgacttctcgtacttccaatctgctagcgccccctgattgtcacctgctcacacgtgctccaccacagcccctcctctgctaaccgatgtacagcggccgataatcctccggcgttttctttggtatgtacggattccacgactcttctcgcctcttttatctccgtgcgctgtctctctggctttcgcttgtttttccttccccgcctcatccactggtttcccgattctataacccccgtacttatcgtgcctcgtagtactcgtatgaaatttctgatacaggtcgagttacctgaattgttttatctagatgaactgtctcagagtcataaagtcccactggcacgttccccatatgtttatctgattggacatggtcgatatgccatgcaggccgaatctgttactgaaggcgtgcgttcgccaaatatgcacctgtacattccacaagcattgccttcttattttacgtcttttagctgtttaaaccttgtaagatggcaaagaggttggatcaacgtttaaatgactgtgctgcccctttcacatcataacgatctactgaccacgaaaggccgccgcctgccttttcccatctgtctatctatctggcctggcagggaacgtatagtacttgcatgttggtgaaggaagaagtggggtggaagtagtggggtgggacgacagtgaaaatcctagagtaataaccaagcctggcaccaagggtgtcctgtcaggcatgtaaatgcagtttaatcagagtgccattttattactgccgcggatgatcttaaaaatta

SEQ ID NO: 584071 - DNA, 346 bp, Homo sapiens
tccccatctgtggcagctaaaacaaaaatcactcaaaatattcgggttaacttgtaagctctctctcatagggagctgccatacctcacagtccaaggtgtttcctatagacttcagtaactttatactgacttgtaatggcaatttactatgcagcaaaaagtgattcagaaaaaaaaataccctacagttgtctgtatcccttggtatacacaatggcttaagtaacctcttgctttaaacatttgtcctgggataaaatgctaatgtctgtataggaatgtcacagtgcaagagtgctgctagcccaggcacaaaggttattaaaacttatttggttgaaggg

SEQ ID NO: 584072 - DNA, 496 bp, Homo sapiens
gagagaactagtctcgagttttataatattggggatggctgtgggtataatactaagttgaaatgatatcttttcggggaaaggctttgtaaattaggccttattctctttgtcccttctcggtacaggggaggagaattccgaactgtacgataagaacaccagacctgggattactccgggtctagaactccaagatcacctgtcaggacttaaactctgtctagacacaacacagacaccttataaataggcgcggtagccacccactcgggactgctccctgcggattcgccagagcatcttcaaggacggcttcctgtaaaaacccctatatctttggatgggcaattcgtgcagcgcctctctgataagacacttcgcgcactttcgccacccgtgttttaaacaccccccttaggggtctaaccttgtgttccccgagtgttgggctcacgagttaaagtggggacttcaaagtgtgactttactagcc

SEQ ID NO: 584073 - DNA, 941 bp, Homo sapiens
ttactggaatgttaggttacctccccttagtatattattatggttctatgtgctagacttgtttttctctcattgattgctaattggggctatttgattttgtttagaccttgttggttatccatttgcctagtcatcttttatatttaggttactttttttgcattccacgtatccctgtaatagctgctgtctgtgtatacacgtgtttggcattattcaggtgtgatacctgttaaagttctataatgctttctttccgatattggtcgtcttatgatgaataagtttctaaatttatctgacaccatgtcagaaacttgttttggggaatttgatagctattgatgtgcatctgttataactgatgacagtacttcactcatcattcccccgataccttttttgatgtcagtatctacattgttgcctcctcctttttggttttgctggttataataggtttggattggagagggctcactggcctcccaatcctgtggagctggatcattggtattcaaatcatatatgtggataggatagggaggatgatattaccaggattcatggatgcgggatctagattaccaggaacaataggagtggattcctgccccaacccaaccgcattcgatgtggatttttatattcaaccgtaatgtggctattccaaagatttttttttcctatttttgacgaattggagcccttaagatgcacgatggaattgtgttttgcgttttttggtaaaaggagcaaagcgaggacctggagataaacgctggaagcaatctccattggaaggaaattcagcacgagtagatggtaaacatctaaaggggaaagggaggggattacgatattaaaaatagtaaatcagtaagtcaacttctaaatttcaagaaaacaaaattgggtgttaggcatcaggggtttca

SEQ ID NO: 584074 - DNA, 1421 bp, Homo sapiens
tattctgtgatgtttgctgttttctgtcttgtttctttctttctagtttgcccttttgatcttgtgttgtcttttgctcgttgtttctttatctttgttttctttctttcttttatccttctgttttttactgcggcgtttgcctctggcttctttttcgccttcgtttcttgcttttttttttgtgctcccgggttgatctcatggttcggcttcttttctcggtgttttatttcacttcttggtatttcactttgtatccgatgttctttctttatgctgtccctttgtttgatgttccctccctgttttgtttcttgtgtgttgttctattccactgttgttatttgggcgctgttcattgtccctgtctcgcgtatgttggtgtcttcttctccttgctccattgtcgtctagtgtgttcggtgaacttctcgtgcgttgcctgtgttaccatcttacactgttcctgcgtttgtccaggtatcttgtgctatgatttcacccggtggtatgcctgtgccttgagggtcaccctctgtgctgttacgtttgggcttaatatcccattgattaacttggttttttgattcatttcttttcttcttattatacatggaatctatatttggacatttctttttagtcattgcatttttctggttctgtgtttagcccttataattatatcactgttgttgtgtgtaaatgcgtcttgaccttgaaggaaagataccaagttgtgatgcacactttttatcacatgattatattgattatttactacgtctgtctatgccaatcgatatgatcgctgtttgttctgtgatcctgcctttgacgttttatattccatgtaagttattgtggccttagtaactgccttgcagtaacatccgttatattgctttaataaacctgcttcaccatacacctttgccccctatatagatgtgtgcttgcaacactatataagcatttgtgattggtgatgttgattaagtatatatttcggtctgttctgcaatgatagagctttatgttaatatatttatgtgcattctgtataatacagctagctatatcaattcttcacatacttctatatggcagaatgagaggacggccatattgataataactatctgatgatcacggcaggacactgcacttcgtacatataggatttctctaggctcggtgaggcagtagagtatttatgttttctttgacaggttaactgaatctcttttatccatcggtaattttgagaggatgattcctatgatgtgttcacccaggggaatcgctggcttttaatagaaatcttctatgtggttgtaactgttcatatcgtctgactggtctgtgttgacattcattattcccatggtattggactcttctaaactatgtgcctt

SEQ ID NO: 584075 - DNA, 148 bp, Homo sapiens
gtgtgtcgagtaaggtagtgcaacttcttggctgaataggtttaaaaagatcctttccattgtgagacagtgaacatatcaagtagtatttttcataattcgatacccaattacttgaaattccatgatgcagcaaacaatagtaaac

SEQ ID NO: 584076 - DNA, 217 bp, Homo sapiens
  misc_feature (60)..(60): n is a, c, g, or t
  misc_feature (64)..(64): n is a, c, g, or t
aagttgtgagatattggatgtgaggcaatttttcctttctctggagtctttatgaaacanaacntttgaaaaacctatgtattattcaaacagctttggtcccccccccacagaaaagcctaactacacacaacaaaatgtatgtcaaccaagtgtttagaatgaaattataagtgtttaagtccaaataaagcatgtgatgtggaataatctatgc

SEQ ID NO: 584077 - DNA, 367 bp, Homo sapiens
  misc_feature (329)..(329): n is a, c, g, or t
tctgacctgggtgaggtgtagcattgtcctgggattgtttgcccagcttccgatggaccccttctgggactactcttaggcctaaaaaggggttaggcacctctcccctgatcaagaatggaccaagattccctccagagcagagaggcccccagccctatgtttacagccactgacatgtctaagaaacttgtatgactttcatgtccctccttagcctaaggacccctgggacagtgtccataggtcatccccagaacctgtgggaagagtagagaatatgtattcttggggtattgggaaagcagctttgtagccttctccctccntctgcccctctgagacaataaaattgccctctttaaaa

SEQ ID NO: 584078 - DNA, 114 bp, Homo sapiens
ataaactcaaaaatgattagagtttataggacaatttagtcaagtacctagttataaaactaaagggaaaaaatcaagttattggtcaaaataaaactgaggatgcttataaaa

SEQ ID NO: 584079 - DNA, 150 bp, Homo sapiens
tcgacagcaagaaatagaagaaaaactcatcgaggaagaaacagcacgagagtagaagaattgtagcaaaaagggtggaggaagaactgagaaaaggaggatgaatttaacgggagtctccaggttgagagccaaaccatcatgaaagca

SEQ ID NO: 584080 - DNA, 270 bp, Homo sapiens
taaaaatgcaaaaattagccgggggtggcggcccatgcctgtaatcccagctacatgggaggttgaggtgggagaattgcttgaacccaggaggcggaggcaaaggctccagtgacccaagattgtgcccctgccctcccccctgggcaacagagcaaggccccctttcaaaaataaataaatatatataaaaaataaaaagctttttttggtttttttccctataaagttttgctttattaaaaagctaataaccagctttttttccca

SEQ ID NO: 584081 - DNA, 650 bp, Homo sapiens
agtaaactgggtgtgactgtagtgaatacgatggcagtcctgcgcccttctgctcttgcttcttcatagttactcgtgcctaattctgctcaacggtcagtgggctgctctgatccaaatctggggggcttcaagagaggcgcatgcgagatggatcatcaggtgcccctgtgctcccttccgtgccgcattggatgcgaatacgatgggctggtgtgtggcattgctgatgggccggattgggttaatggacctgaagggagaccgagcgcggctgacggggggggggggggggagggccggactgggaggctccccgagagtcgggcgtgaagagactgtctctgatgctcggacctctctggcgacatgcggacgcgtgcagacacttgactcttagtgggataggtggctcactctgcatgggggacccgtgcgctgggagtcaagctgtgggtgcgtcggtgcattggagaaggggagtgacggggcatagaccttgtcggggcctttggcgctgagcgggttaggggctctgcgaggacaggcgccctggccgcgtgctggagtggcgtacgtcatggggatggggtagggccgcgtgcgtgaggcgtgcggcggatgtggtggagctgggggggggtgggggg

SEQ ID NO: 584082 - DNA, 241 bp, Homo sapiens
ttcaagagactaaatgaagaactttgacctagtggatctggtggatgtcaatatccctgatttaatggtgagatccattttagagattctattctcctgggtcatgaggatgattaatcagacgtcttgggcattagattgaagcatctcagaacatcttttgatccccttctatataggcacctgtgtctgctatacaagaaaagatatgtttcctgcatgttcattcctgatgggcggg

SEQ ID NO: 584083 - DNA, 220 bp, Homo sapiens
  misc_feature (95)..(95): n is a, c, g, or t
ggcagcaactacaacgcagtaaacagagtagtcgtcacagtaaggagaagatcgccagtcacctctttcattggcaaccatttttaacaattcangtcacacctcagggctacttggatcaagggtcaggttcctattgccaccttttcaaaattatattcaggtgtccaaaaatcattctttttttcgcggtgtgccctcgcaattgtaggaggggata

SEQ ID NO: 584084 - DNA, 390 bp, Homo sapiens
atttatttattaaccttgactagttttttatgagtctttactattttctatagttatatcttttcatctgcaaacggcacaatacacattattctagtattgtaattatcttttcttttcttgcctcattgctctcactaggatttccagtactatgttgaatagaaatggtgaaagtagtgcatactttttgttattattatactttaagttttatggtacatgtgcatctacgtaggctttctttgccttgtttttaaactttgaggattagctttcagtttctcaccattgagtatgctgttaagtggcttgcccttttggttgccttgtgagatataatatttatggtcatgctgagctctgagagtataatgtatgtagcagtac

SEQ ID NO: 584085 - DNA, 429 bp, Homo sapiens
  misc_feature (10)..(10): n is a, c, g, or t
  misc_feature (35)..(35): n is a, c, g, or t
  misc_feature (81)..(81): n is a, c, g, or t
  misc_feature (93)..(93): n is a, c, g, or t
  misc_feature (116)..(116): n is a, c, g, or t
aggaaaaggnccattgaacccatgtccagtttagnggaccctttccacacttggccaacatgaatgttaaggtccaaaggnaccattggggcntatggaggtttttttaatccaanttttaatttggggtcaaataagcccattttgtttgtttgttattaagtgtaaagagagctttcggttagcttatttagttataactttatctcacccacttctaaaaaagcgttgaggctacttgaagtaaagtcctgtagacgagagagcgtaacactaaaagatagaaagaaaacttagaagatggaagagaaataattgcactagaaacctggccaatatcatgaacaggctccatatagggactcctgtatatagatcgctgtgtgtgtggatagtacgttcaataaatgtattatctgaactgctttt

SEQ ID NO: 584086 - DNA, 182 bp, Homo sapiens
gggttggctgttccttgttattcccaaagccctggtttggggcccatgttcaccctggctttcagtctagtcaggggcaatgttttttaaaggggggggcctaattatttccagagtagcagcaaaagaggaaacgttgtgaattaaggattccatttaaagggaacatggtttttccctga

SEQ ID NO: 584087 - DNA, 105 bp, Homo sapiens
catggatttgctggtgcagtacaactaggcttaatagggacatgtatcccataaattgtgcaactactatatatccataaaaattagaagcaaattcaaaaaaaa

SEQ ID NO: 584088 - DNA, 721 bp, Homo sapiens
gaggggaaggtttccgatgagcccaggatcagacattgccacttcagccttggccaccaagagtgaaactctttctcataaaaaaaaaagattgtttggccgggcgtgttgcttcatgcctataatcccaacacattgagaggtcaaggcagcggaatacttgaggccaggctggtctcaaactcctgacttcaggtcatctgcccacctcagcctcccaaagtgctgggagccaccatgcctggctgtttctgtgtcacttctattcctgtgtctgcatttatactcccaagccttccacccaccctccaccttctcagttgtcatttcccaggcctgagagtctgtgcctgggggttgtgctatccatggatgttcatctacactgggtcagaactcaccaccacagcacgctctgtttactgataagaccattcctctgcatggcatatgaggtatctatgtcactctgaggcctcaaaaatgctaaacattcttttcttcccctataatatgacttcctcttcgcacttacaccttcaagtaagtagtttaaggaggagataaaaattttactgttaaaaaaaggagattgctgggtgcagtggctcacgcctgtaatcccggcactttgggaggccgaggcgggtagatcacctcacgttgggagttcaagaccagcctgaccagcatggagaaaccccatctctactaaaaatac

SEQ ID NO: 584089 - DNA, 322 bp, Homo sapiens
gttcactttctacacagatacaacagttcttctgatggtgactccagttacttgggacgccgcttgtagccttcagccctaagtcaatagcagtgagagcttatcccaaagtccccgtttctgcgtcgtccgcatgctcttggtgacacatactagcggtcgtgatattatccaaatggatcctgttgggaaagaataatattagcttgagcaacctggctaagatagaggggctctgggagactttgaagaccagtcctgtttgcagggaagccccacttgaaggaagaagtctaagagtgaagtaggtgtagaaatagaa

SEQ ID NO: 584090 - DNA, 578 bp, Homo sapiens
  misc_feature (176)..(176): n is a, c, g, or t
  misc_feature (234)..(234): n is a, c, g, or t
  misc_feature (320)..(320): n is a, c, g, or t
  misc_feature (330)..(330): n is a, c, g, or t
  misc_feature (359)..(359): n is a, c, g, or t
tagtgtaatgagattcatgattatatctgaacggtgaatatagtcttactcaaattaatactagctgggtaaacatgtctatctacagattatcctgtctgggcgcggtaactctacgcctatcatcccagcactttggaaggccgaggcaggcagatcacctgaggtcaggctgngcttgaactcctgacctcaaatgatccacccaccatgccctcccaaagtgttgggatnacaggtgtgagccaccgtgcctggcctgaaaattgtgatcatggaaagtacctcacagaattgtgggatgaatggagctaatgttngcaaagctcntatttcagtgtccaggatatgttaggccntatgcctacagagtcaggcacattttcttgaaacacaaagccctttatctagcttaacctcttcccactttagagtcgtgggtgcaggaaatattttgttttcctctttaccgtaaggaaagtaacagtgctagtgtgttgttgaaatgccatgctctgggcatgtgtttggggagagagatgcagtgcgaggtgggaggtggatcctctagagcgggc

SEQ ID NO: 584091 - DNA, 200 bp, Homo sapiens
tccaagcagacacaactgaacaactatccacacagagatactttcagaagaactaaaactcaggtgagcaatcacagtacctggttttaacatattaaggaaagaggcactgaagaggttaggaaagattgtcttgaattgcctataccacacctcctccgtcatccagcagtgcagtacgatgtggagagaatataatc

SEQ ID NO: 584092 - DNA, 101 bp, Homo sapiens
tgccgaccccaaatgggagctgtctcgggcccggctgaccctgggcaagccccttggggagggctgcttcggccaggtggtcatggcggaggccatcggtt

SEQ ID NO: 584093 - DNA, 231 bp, Homo sapiens
tagggaaaccgtgggaccctgtattgaggagaactgggttacacgcacgacacggttcaaggcctcgcagcatgcacaacaacagtgcaaggtcatcatcacagataagcagtgggatacacacatcacgccactatgcacacacaatgcaggtacacacacacacccacatgcacacacacagaatagcacgggtacacacacgcacacccacagtgcacacactaatgc

SEQ ID NO: 584094 - DNA, 627 bp, Homo sapiens
  misc_feature (132)..(132): n is a, c, g, or t
  misc_feature (346)..(346): n is a, c, g, or t
  misc_feature (407)..(407): n is a, c, g, or t
ctgttccgggaggcagcaggggcttgaggccgagaagggccgttgattgccagcaacagtggagactttgtagcgtgtcccggttcttagtgcgtcgaaatggtccccgagacctgaagctgaagaagccgncactggtttgcacattgccgtcgggcatgacctgtgtatgctctggtggtggtgtcttacattccgtcattcatacgggaggaaattaattctgatggaatggttaacttggttttgagaacctttccgaaaagatggttcgggtttactacttgaacttttgtatgaagagtattgtggcaattaaggagggccgagtgagcttttcttgggncttacaagagttaaattgtgacaatcatattcatggtgacaggactttggcgagttccagnttgccttatgttaccaatggggaaggtttgaaggtcttcataaattccctgtgtaaccggaattctggatattgtcaagtcaataaattagtttcgcactaaaaataatctttccaaaagcttaaggaaaatttttcttccccccattttttttccccgtttatattacctcttgtgggtgtttttatttcccaaaattttcttgtggtgggggcacact

SEQ ID NO: 584095 - DNA, 397 bp, Homo sapiens
  misc_feature (61)..(61): n is a, c, g, or t
  misc_feature (70)..(70): n is a, c, g, or t
  misc_feature (348)..(348): n is a, c, g, or t
ccggccaacttgaaaagctgcaaactgcaatgggtcgcccttttcgcaatgccctggggcncgcgccggngctgaagccctgatagtctctcgttccgtatgaaggtggaggcgaacactcccaaatgcaaatcgaaaccgcgaaaggcgcggcccgacgaatggctgcagataacggacgtcttcatcgccgcccgcgccgccatgccctatctgccccatcaccatacgcgcgccgaaacccgcgcctttttcaaaagcgtgatggaaacgcaggaagtctggacggcggaggccacgctcgacggcgagcagcgcattgcgggtttcgccgcgatccgtgacacncaaggcgaaacctggctcgaccatctctatattcatcccgcatcgcaga

SEQ ID NO: 584096 - DNA, 395 bp, Homo sapiens
gtggtaacgtatgaaaatgtctaggaggcacaccctctctggcatctatgatgggccaaatgcccacattcgcttggccacagtatgtgaaattgaacccagcttatacacagggtgcggcagctgtcgtgtttctctatgtgtgccaagtgtcatgtctgtaccatgcagggatagctgagtcttcatcctcctcagctcctatctgttcagtgcactgaacaccagctgctctcttcctctctggctcccatggcagccatggtctgttgcagagagaagaggattgcctgttccctctttaagggaacctccgttttgctttctggaaccactctcttaatgccgtctgtcaaaaccagctaggactccctggggtccaatccctctgtgtt

SEQ ID NO: 584097 - DNA, 418 bp, Homo sapiens
aaactagtatgacctgaaagctgagaaagataaattgcttctgcttattcagtgagtacatatatgtgtatactgatttcactggaggcaccatttttccacagtgatcctttccccctcttgtggtttgtctagccaggggttctggggcctcgggaggccctcatgttcatttcttccacggcccatactgcctcctgcctttctccacacacacagcccttaacaggtatttatttcaaattaccaaagtgagttgctctcacataagaaaatgcacttcctccgttcactttccaaactctaggtgctgtacaaagaagtgcttagagtgttggagacttatctgacatactatcaatcatgccgttagagctctacggcctaccaaacactccatgtgagggtttggggagcc

SEQ ID NO: 584098 - DNA, 189 bp, Homo sapiens
gtatagacatagagctcgtgtccggcgcgaacatcgtcacgcacctgaaggtgggatatccatactattgacatcgcccgggacctgagtcgtggtaggtggcaggatatgacacgtatgtggcggaatgatcattgtgtttagtgcctgttgaatgctcgtcatccacaagctcgaccacagcaagct

SEQ ID NO: 584099 - DNA, 135 bp, Homo sapiens
agcctggcttcttttaaacatgatcaacaactgtgacagccccctgtttcctttcagatttgcggcttaaaaaaagcaaacaggggcacatgtttttaggatctcctggggctgcatcggggcaaaatcaaaaca

SEQ ID NO: 584100 - DNA, 171 bp, Homo sapiens
gctgctacagtaaaattataaattgtgtttatcactagcaatttagaattgaaaatttcattatcatatcatagtgtttctccttgacagaagcacattatctagccctgttatttgaaaatcagtaagtgagcacccttagaatgcagattctagtctaaatgcacttca

SEQ ID NO: 584101 - DNA, 297 bp, Homo sapiens
aacatgtagacttagaccaaattccatgtcatgatgtatgttagctcatgcttaggattcatatgatgtgttttgctatgtgcatggtgaattacggtaattcacctctcccaattcggcgtgttcttcgcatatgaactacatctgacctgatccccttggtacgtaggtagtctctaatcgagattcgatcaaaaccattttcaaaaccctttcggtttgactatggtaatcacatgatttacgtcgcatcacatgatctgtttgacatcacatgatttgcataacaccacacaa

SEQ ID NO: 584102 - DNA, 294 bp, Homo sapiens
ctctagagatcccccaagcccgaccatacaccctgaataattgccaattgcttcttttatacccttcttgagcatctgtaaaaataccaagcttgaagtttattaaataaatgtgattaaatattttgtgttgtgatctcaatatttttcttcagattatcacactaattctcttctttaagcctgagatttgagctaaaaatcttaagctctgcgataaggtatcaatttaataataaatttccagtcttttgtagtattttatattaatttttctgaaagacaatggtgatg

SEQ ID NO: 584103 - DNA, 786 bp, Homo sapiens
  misc_feature (108)..(108): n is a, c, g, or t
  misc_feature (254)..(254): n is a, c, g, or t
cttcaagatgaagctgaacatctccttcccagccactggcgtgccagtaaactcattgcacgtggacgatgaacggcacaacttcgtactttctatgagaagcgtatnggccacagacagttgctagctgacgctctgggtgaagaatggaagcggttatgtgtgtccgacatcagctggtgggaactgacaaacaaggtttcccacatgacagcagggctgtctgtgaccgcatgggcgtgtcacgcctgctnactgcagtaacggggcatttcctgtgtacagcaccacaggagacactgagagaacagacaagacgaaacatcacgtctcgtggtgtgcattgtgagatggcaaattctgagacgttctcaaccttggattatggtaagcacaaaggacgcgaacggatacttcctcggcactgacatgataactacacgtgcactcgcacgccttgggaccccaagaagcagctacgcagcaatcacgacaaacttgttcaagtctcttctaaagaacgatgactgtccgccagatatgtcgtacagaaagcccgttaaataacagaaggttaagaagactaaggagcaagagcacccacagatgtcagcgtctgtgttgactcccacgtgtccctgcagcacacaacggcggcgtattgctctgcaagaagccagcgtagcaaagaacaaataacagaagagcgctgcacgcaatcatgctaaaactttgggaccaggagcaatgcagggacggctaaggagcaagcgccacgaaccacat

SEQ ID NO: 584104 - DNA, 80 bp, Homo sapiens
tttatagttgaaatacaattttttattcaccattgtctgcacaaatccttgaaaataaacctttttttccctacaaaaaa

SEQ ID NO: 584105 - DNA, 273 bp, Homo sapiens
tattgagtggcatgtgatggtcggtgcatatatataggtgtcgttgtcatggtgtgtgtagtcacggtgtctgtgtgtgacatcatcaccgtcggtgtgatgccctcgtggcgtttgtgtgacattaatatgtgtgacgtcgacatggcccgtgacgtcgatgctgcatctcggtgtgacgtcatgccaagttccccatgtctgtgtgcgacgtgctgcatctgaacgaggccatcgctatatctcttcgtgacgtcacatggccactcaata

SEQ ID NO: 584106 - DNA, 203 bp, Homo sapiens
tgcttggattacaggcatgagccaccacgcccagcctcatgacaagtttttgtttgagagccctgttttcaattctttgtatgtacccaggagtggaactgcatggcacatggtaattctgtttgacattttgacggactgccaaacttttttccatagcggcggcattttatattccttgcagcaatgtgtgagagcgttgg

SEQ ID NO: 584107 - DNA, 418 bp, Homo sapiens
tacttccacagggccagtatttccctggtaccaaaaccagacaaagacgcaacaaaaaaagaaaactacaggccagtatctttgaacagagatgcaaaatccttaaaccaaattcaactacatatttaaaagatcattcattgtaatcaagtgggattcatcccagggatgcaaggatggttcaacatactctgatatggtttgtgtttgtgtccctgcccaaatcttacatttaattgtaatccccagtgttggaggaggggcctggtggaacgtgattggatcataggagtggagttctcatgaatggtttagccccatctccccttgctactatatagtcggtgagttctcatgagatctgattgtttaaacctccctgctctctgtctctctcctactctggccatgtgtgttc

SEQ ID NO: 584108 - DNA, 324 bp, Homo sapiens
  misc_feature (6)..(6): n is a, c, g, or t
  misc_feature (21)..(21): n is a, c, g, or t
  misc_feature (154)..(154): n is a, c, g, or t
  misc_feature (180)..(180): n is a, c, g, or t
agaagngacagactcttgctntgttgcccaggctggagtgcagtgacatgatctcagctcactgcaacctccacctctcgggttcaagcgattctcctgtctcagccttccgagtagctgggattacaggtgtctgccaccatgcccagccaangtatttttagtagagatggcgtttcnccatgttggtcaggctgatcttgaactcctgacctcaagcagtccgcctgccttggcctcccaaagtgctgggattacaggtgtgagccaccatggctggccaaagattttatttttaataaaagcaaaacttttttaaaaact

SEQ ID NO: 584109 - DNA, 91 bp, Homo sapiens
tttacattcatgaggaatgttaatttgtactatttaactattcttgatgtaaaatcttgtcatgtgtataaaaataaaaaagatcccaaat

SEQ ID NO: 584110 - DNA, 325 bp, Homo sapiens
  misc_feature (173)..(173): n is a, c, g, or t
gctagctagatgaagggtggatggtcactgtgggtggccagctgctcttggcagaagagacactgtggcatagcggaagagctgagggctagaaggcagtgtgtggacagtcacaggactggagccctggctgagggtggctactgggatattgctcaccgaaaatgactganccaatggggtgatggtgacgggtgagatgactgtgaactgaggctgctggactaggaggagaatggctcaagacagtggtggatgctggccgctggagccggggcctttttggaggcttaggtgtgctcacaggcatcagtaccatattttg

SEQ ID NO: 584111 - DNA, 241 bp, Homo sapiens
tttggggggtaggtggcgcaccccacccacaaccccccgctccacgggtgaaaccctgtctctattaaatatacaaaggttggccaggcatggtggcgggcgcctgtgatgctggctgcttggaaggctgaggcaggagaatcgcttgaaaccagaaagtggaggttgcagtgagccgagattgcgccactgcacttcagcctgggtaacaagagggaaactccatctcaaaaaaaaaaaa

SEQ ID NO: 584112 - DNA, 1177 bp, Homo sapiens
  misc_feature (271)..(271): n is a, c, g, or t
  misc_feature (277)..(277): n is a, c, g, or t
  misc_feature (296)..(296): n is a, c, g, or t
  misc_feature (426)..(426): n is a, c, g, or t
  misc_feature (430)..(430): n is a, c, g, or t
  misc_feature (444)..(445): n is a, c, g, or t
ctctcgcactctgtacttccgccgctccgccgtcgcgtttctactgccggtcgcaatggaagaagagagtcgccgtcgctggtcaattgacaaatggctccggcagtgtgcaaagctggttttgctggggagcgaacgctccccgatgccgtgatttccttaccagtcgatcgggacgccccagatagccagggacgatcaatggtgtggctatggagaccaagaatggaacatcactaacagatgcgtggctgatcgcaagcgcctcatngatgancatagaccgttgtggccantacgcattggaccactagaaaaggtagcaccaccattttgacgtcgattgggctagtctgattccatcactaagcatgggtggaactggaacagttgtgacgcacaagcactactagtgggtcaacaccnaacnaacacatgttcttnntagcagaacttggagggcgtaggactgtctgcttaggactccacaccgcgggaagagtaggtccaacactccacgtttgacattgccatagaatctctgtaagaactctcgctcgcttggaaacactctcgaagggacgcaaaccagaagagggaagatgactcacgattatgtgtgacgaccttcaataccccggccatgtacgtggccatccaggtctgttgctgtccctctacgcctctgggtcgcaccactggcattgtcatggactctggatgacggggtcacccacacggtgcccatctacgagggctatgccctcccccgagcctatcctgcgtctggacctggctggcgggacctgaccgaatactcgatgaagatcctcactgagctgaggctactgcttgagcatcacggcgagcggtaaaatcgtgcgcgacatcaaggaagaagctgtgcgacgtctgcctggagttcgagcaggagatgggcaccgcgtatctcctctctctggagaaagtacgagctgccgatggcaggtctcaccatggatgcacggtccgggtcggagggcgtccactcttcggttgaactggggacgcggcacttgatcctttatgtgtggaccgaaacgtccacggggttgggcccattcggatggagaaaagatcctggcaaaaaaatagccacacatggggggcgcccatacagtataaagacccacagagg

SEQ ID NO: 584113 - DNA, 333 bp, Homo sapiens
caggactaatgtagatgcggacagggagtacatgcagtcctggacccccagagatggtctagggcataagggcctgcgaaggggctggcagcaacagaggctggagcgaggagaatgagaggccagagggaccatagtgccgggcacgcctgaccatgtcgcatggggcaggcgagacggggccatgaagaaggcgggacgggacagggggtgatggcagcctacctggagtccgcctaccccagctgttctcggagaaccaagtagctacacaggaagttctccaaggtccagtgtcctttctcccaccagttggtggaggcttcagtgggg

SEQ ID NO: 584114 - DNA, 980 bp, Homo sapiens
gcggccgccctattttttttttttattgggggtatcactcaaaacctaggtctacagccaggtcaagtgcctgctttattcaacaggaagcgctcaaggtgggactcaccccccacctttcacagttgtaaagtgaatagggagcaaggcaggaagctaaaaaaataatgcatggatctagacaattcaaaaaaacccttcataagatcagcttacggccaaaacgtggctcagggtgacagacacaaaagcagtgtgacagaaaagccttagggcagcctgagccagtgatgggcctagcggaagtagttgggagaacattcgtgagacaaccaaatgccagtgtttagatataaagggcatccacaaacagccggtatccaggggcccttacctctgtatgctgcacaagtatctggctccaggtggcaccaggctggaaatgcccaggatgaccgggtaccccgggggcaccctgacagtgtagagtgggggtaacatccacgcggagggacagccgaggtcacacggggggcgctggagccatatgacggccatgaagggcctactaccaccaacgccagggccctcaaagtggtgccccttccagaagcgacccggaaggatctcagcccagaattcccaaagacagcggaccacaggcgtgtacccgaacttgacctacaaacttgtacatgtgacagtcagaggcccccagaccaatgcgtcgtcggataaaacctaagaacaaagtgccagaagcaggcgaagaacccgaaaccacctgccagaagagggagtacgcaaattcccgtgccaccacaggggccagagtcacacctgtgcattgcgaaagtccaaaactcgggacaatcccaacatagcctagtccaaagagcaacccacaaatgaccactgtgagcagacaggcggaaaacggacctacagcgagacgacaagacgagtaccaagaactggaa

SEQ ID NO: 584115 - DNA, 159 bp, Homo sapiens
atccggtgtaattcgcgcggcgtaccatatcgtacaggttcaagtgaacagctctcatgtagaacatgtagtaagggaagtggcagcggatcgtaattcgggataagtattggtctaagggtggtcgaagtagtagggcggcgcgtacggagctcgaat

SEQ ID NO: 584116 - DNA, 212 bp, Homo sapiens
cacatgtacagatggttggacctactcatgcatattcaccagcagctggagcatctccacccttggtatctctggtgtacattactatgagctctgtagctattgaacaccacgtttgatacgctccttccactacaggacgctcctgcttgggctcgccctgtgccagggcagcctcgatatcttcagatctactcagaagaccgacagct

SEQ ID NO: 584117 - DNA, 481 bp, Homo sapiens
tgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcacctttcttggttggcacgggacggtccttgggccttaaaggcctgggtcctccaaaccgggcgtctcctgtgcggacctccgggggtgcggggggttccagcgaggcagctgctacgggtaccttgccagggctccctaggagggaaacccacggacttccaggcagggcatcccaggaactgtgcggcacccattcttctgtgctctcccagcccatttccactcctacgttcgtcatggatacatctccgttcttccctgctgtgatctttcgccatcaacaactacaccaacttccgagactcgtac

SEQ ID NO: 584118 - DNA, 229 bp, Homo sapiens
tatcatcatatcatccccatccccatcattatcaccatcacaccatcattgctgtcatcaccattcaccatcactgtcatcatcaccatcatcgtcattatcatcatcatccccattaccactacattattatcactatctccatcaccatcatcaccatcaccttcatcatcaccgtcatccccattaccactacattattatcactatcaccatcaccatcatcacc

SEQ ID NO: 584119 - DNA, 154 bp, Homo sapiens
agagtgaaactccatctcaaaaaaaaaaaaaaaaaattctatcagccggtcttcatcagtggggaatatatttcttcagttatttaaaagaatcggcttgtcccaggggttatcctttttttttttttttttttttttattatatttttttttt

SEQ ID NO: 584120 - DNA, 895 bp, Homo sapiens
gtgacagactttacagaagtctagctgacattgtagtaccaaattcccttggtacgaattgtggaggatgacttttgcacaataaataatattactagtttccgccagcttcaagcttggatcattgtaatacattcatgcaacactactgggaaggggagcaagggagcactaggcacgctgacacgtgcaatgggtgataggacattcgactttgcagtgagcgccttggagaatgcctagttctcatcgcctagagactatcactcgtctctcatgggtacgcgatcgcgtttggcttattcatctatagtacagtttgtcttgtctttgacgaccggggaaaggctctttatgagcaggcaccggtgtcttccttgcgtgtattgcacgtggcctagcacgttatagaaggttagtgagtattcgtcgaatgaattagtcgagtatcacttatacagtcactttgcaaatttggtgcatccattcacttatgttctagagagacctgtttcccatgcattagtaattagtcctactgggaatgaagtttcataaaatctgtgcagacagggcatgcttgactagtgtgtgtccaggccttccaatatgtgctccagaatatcttctaaagggacagggacggatctgagtacaacataaatctgtgaagatgttcattgcagaactgtttatagtaatacaatgttaagaactgactaaattattcccatagtgggtgatgagcttaaagtagagatgtttgccttcattatggcataatggtagtgactaaacatcaggtcattaggagactatttagtgaataggaaggggaggttgcagtgattttgcaaaaactgaaactgtgatacgaaaataacctgtatggaac

SEQ ID NO: 584121 - DNA, 111 bp, Homo sapiens
ggtccaaaagtagaggacttattgttcattgtagttcatacattcaaagcattgaactgtagtttctatagcaagccaattacatccataagtgaagaaaagagtgcttgg

SEQ ID NO: 584122 - DNA, 517 bp, Homo sapiens
gacctgtggtaacacgtttgtgtgggaggctactttcactttcatcgcccagtacggcgctcagcgtgctgatgccctttcttacactatagttgactcccatgcctactaacatcatacttctaatcattattgaggcaccaaattccacacctcccaatactcttctcttgttctccacagtaatcaccagcctactagtcccaaggcctattatagtaaatacacctctcatgctgtgtccttccgttcccccaacgtccaagccgttggggtgaccgttcatgacactgtcaacttctacgttatcgccgcgggccccaacgcccataacaactatgccgttatctctttctaataatattatttctcccactcctcatcttacaaccatggttcttctatagtcgctcacaccccagttcacatctcttctataaaagactccttgtcccatcaccattccacccagaacaatagttaacgttctgctatcccccgtaaccgcatcgtcctc

SEQ ID NO: 584123 - DNA, 151 bp, Homo sapiens
  misc_feature (43)..(43): n is a, c, g, or t
  misc_feature (61)..(61): n is a, c, g, or t
  misc_feature (96)..(96): n is a, c, g, or t
  misc_feature (138)..(138): n is a, c, g, or t
  misc_feature (140)..(140): n is a, c, g, or t
ttccgcccctccccaggactcccactattgcctctgtgattgncccaggaggaaaacacgnccaagctcaagacccttcccctgccctgggctgtnggggtctgagtctagagcccccaaccctaggccccgtgccanangggaagaggcc

SEQ ID NO: 584124 - DNA, 133 bp, Homo sapiens
gtagaacaccaatattcgtagtcatctcttcaacagcacatcgcagcacatagcgatacacaacaaaaacctatacatcaaattcaagcaatgcaatcacatttaccaggcgataacatgacaacaccagcat

SEQ ID NO: 584125 - DNA, 1603 bp, Homo sapiens
  misc_feature (422)..(422): n is a, c, g, or t
  misc_feature (1597)..(1597): n is a, c, g, or t
  misc_feature (1599)..(1599): n is a, c, g, or t
tacattggccgtcctctctagggtggtcttgggcgaggagggccctgtggggaatcggggtctatatccccgatacatatttcggcctcaggggttcatacctgtggtttctcctgtggcacccgtggttgtgtcagaacccttccatcatttctcccgtgcacaggagggttgggaaatacgggtggctcgacgcccatagggtctccgaagtgtagataggggggagaacctttcgccgcgtgggagagagggcggcggggtattgatgggagcctgtggctcttctggggaagacactctcttcgcgaattcccttgcggttcttttctcccacactctcttcagatatattctgcggggataatttgtggggcgtggatacagtgtggcgtgtggagggaacccccatatacagaagngtgtggaatatagcggctctataatagaggggtacacgggcgctgtggagtgcaaattattataacgtgtgcgctgtgaacactgtggggaaacacaccaacccagaggcacctgtgttacacattttgtgctgttgcctctccgcaacccctttttctctctccttttacaaaacacaacagttcaagagtctcacaagaagtgtcctcattcacattttctctcataaaagcgttggcacagagggtttaacctttcgccgggtgggataaaaatctctctactttatagggggcaagcccggtggtgtgtttaaccaaatatacatttcttttcccgttgtgggggggctcaattcccctgtgtgtggggatagtagaaaaacccaatatatacttccgggtctcccttatttacctgttgtggaaaaccccaatttttctactgtgggttccccaaaaaaaacccttctcggttgttggggaaatatagacccttttttgttgtgtgcccccctgccgcggggaaagggcgagccccggcgtaattgttagaagtggcccgccccgggagcccaccggggctcccctgtggggcccggttagtccccgatatggtgcccgggagacatggagggagtcaagagaggaggaccataaaaggagccatggagacaaacaagagactagggacacaagaagaggaaaagacatggggtgaggatctcagggaccccagagagacccaagaggggaaacggaggagaaatggaagtacatgtcgcgaccccgtatggtcgaagaaaccggtgcggcgacaccccgcggggggtgggcaggggaccaacaagcacgaggagagaagagaggtagggactactacaagggccccctgggggaccgcgctcctacgcccgggcgcaatatcacagaaaatgcgcggaaaggagaacaccacggggcaaaaggagggggcccatataaatcacaggagataaaaaaacaggatgagccgaggcacaaacatgcatcaaacaaaggtggtcgaacacaggcagatagagtaaaaagagccaccgaatctagaaaggaacgacgacgaggatggaacaaaacaaacacaaagatgagaactacacaaacacatgacacagaacacacaaccacttatcacncnagac

SEQ ID NO: 584126 - DNA, 104 bp, Homo sapiens
tgtgggtgccttacacctacttcgctctctcttctacatgaaggctgtcttggttacccgactaggcaacgggcattggtatcacattaccgaaagtctacacc

SEQ ID NO: 584127 - DNA, 1103 bp, Homo sapiens
  misc_feature (310)..(310): n is a, c, g, or t
  misc_feature (524)..(524): n is a, c, g, or t
  misc_feature (535)..(535): n is a, c, g, or t
tgcatcacaaatagcactttttattggccactatttgaagtctgaactttaaacaaattctgggacggggggttcatatccatcagctcgtccaacttttagccaccgtgttcttcgttccccgaggtggcttttctccagaaacttacgtgccttctcaccagtgaaagcctccagtgagcttccccaattctcaaactttggggcttctctcgagactttttatactttctctaacgaaagactctcagtggaggaggattaaatatagatgtgtggacaacgccctttgtcttatatgtgtctcttntttctccaaatgtgcgtgctctgtggaatctcaattttatttgggacccacttctcttttcaagtctcattttgtgctctgttgcacctctctctgggagtctcatgtgattttcgccatctcaatcctctcttctccgcgggaatttgtggggcgggcacccgtgtgttggtgtggcttgcaggcccattagagagaggggtctttctcgcgnatatctcgtgnagtgtggtgagcgccgtatatttttatagtattaaaaccacaaagaccaacgagataacccagacagcgatagagccaagaggttaacaccccatctgcgggatatagtctcttgttgaaacatctcaacacgcgtgtgaacgcttttcaaatctcattgtgtgtctctgtgcgcatattttctgtgtgacgccccactgtggagacacacaccatttttgtgggctcccccgggggtaattagaagaatctcccaatgtgcacatgtgaggaaaggtttatggcctcaaggggccagggtttttatattcaacccgcctgttgtaacacacaatcctcctttctcgaggagtaaaacctccaggggtgttggggaacatttttctttcctattacaacaatgtgccgaccagctgtactcaagcttcaatgttctctcgtggccaaaacatctccaagggccagaggaaattctcgagctgtggtcaaagaaccgaacagaagagagaacccccctttggaaagacacccccatcttccgagaatgtggccaaacattattgtgggg

SEQ ID NO: 584128 - DNA, 365 bp, Homo sapiens
actggccgggcagtgcagcatttgcaagggacagagaatcatttcctgggggtctgaaaccaggatatggttgtggagagtgagggctgaggagggcgcatggcactggggtgaggaccaggaacctgcccaaagccacaggaccagccgtgcgtgccgggaagccaaagtcacatttctatgtgtccaggaaggaactggaaatcgcagactcctcattcacgtagaggaagtgcccacaccttagcctgctgggttggtgcttccctcccccaggctgccagcctcctgccccttcctctggcccacaaagtccgtgctctgtctccgccacctggctttgccatggtttgttagggtttctt

SEQ ID NO: 584129 - DNA, 111 bp, Homo sapiens
acctagaggatcccctaggtgccttagagacatcagacacagaattcatgccagctaggtaatcctttttgtggaaagcgctacgataagagattacgaatgctgaatggt

SEQ ID NO: 584130 - DNA, 757 bp, Homo sapiens
gtgacgcgctgggtattgtctggtttctaaatatacaaggaattcttcaaatagagaaagaggtaaatccgtcactgaaacaccgaggatgcccactggatatactaatctgaacatctgtaggtagttgtcatgaatcaagtggagagaagatgatagttttgaatgaatgaaaacgggtatctttgatacgccagaattccccccaaagtacgcggtatattcaaccatgctacagatttctctttcactcaaagtgttcaagcagctttgtgagatgatcaaaatcatgtctatgtgatctgtaagcatatgctagctaatccaaattgagctattttgtcagtattcttacatgttatttgtactagaagatttcccataggtcttgtgccagtcatagcagagaacttggctgtcattaccagttgttggtcctagtcatctaacccttgaaaccgattctaggtgacattgttagaattattacttaatatgttaaagagggtggacattgatagctataattcatgtgtaccaggtttgaagattcttctgtagtgaaatatatttctatttaatataacatgatcacatgtcctctatcatgaatgattgtagggagtctactcgcccagtggcatgttacaaaagtgtggtagggctataaagtgaagtgtttacagtttgtaacattttgctcgtgattacattggtttggaatgcttatgggggtataatgaatttaattgaatgg

SEQ ID NO: 584131 - DNA, 141 bp, Homo sapiens
gtgcatgacagattgggaggaaatctgagatctgtgtgtaaaattgatcgttcttcatgggggtaagaaatagctggtctggagttgttgaatgttgcgattaattgtgctgtttgcttgtagttgaataataatagaaac

SEQ ID NO: 584132 - DNA, 117 bp, Homo sapiens
  misc_feature (7)..(7): n is a, c, g, or t
  misc_feature (36)..(36): n is a, c, g, or t
  misc_feature (79)..(79): n is a, c, g, or t
  misc_feature (96)..(96): n is a, c, g, or t
  misc_feature (110)..(110): n is a, c, g, or t
ggtagtnacttcttacccccaattctagaaatcctnttcaaatccagatcagtggggcccatctatcaggagaatcaanccttcaggagcctgagnaagaaagatcgaantccaatt

SEQ ID NO: 584133 - DNA, 575 bp, Homo sapiens
aaagctgatcaaagctacatagtcccccccgtagaatagttcaaaagggttggcacaattcttctttgaatgtctgtagaatactgctgtgaatccatctggtcctggactttatgttgtaggtaatttttaaattaccatttcaatcttgctccttgttattggtctgttcagggcatctaattcttcctgatataagctaggaggtttgtatttttccaggaatttatccatctcttctaggttttctagtttatgtgcataaaggtgtacataagtagcctaagaatgatcttttgtatttcagtggtgtcagttgtagtatctcctgttttgtttcttagttatgttatttggattttctcccttcttttcttggttaatcttgctaatggtctattaattgtatttatcttttgaaaggaccagctttttgtttcatttatctattgtattgtttttcttgtatcagtttcatttaattctgctctgatcttggttatttcctttcttctgctaggtaagagtaagagaagaaaagtatctctagatcttgaggtgtgaccttagaatgt

SEQ ID NO: 584134 - DNA, 416 bp, Homo sapiens
gcagtgggtatcaacgcagagtgcccattacggccgggtagtgatcctcctgtcttagcctctggatgtgctgggattacaggcatgaaccactgcacccagccaaaggtgtataacattaattctggccgggtgcagtggctcacacctgtggtcccaccactttgggaggccggggtgggcggatcacggggtcgggagattgagaccagcctggccggcatggtgaagccccgtctctactaagaatgcaggaattggccgggtgtggtggtgcacgcctgtggtcccggctgctcggggggctgaggcgggagagttgcttgggcctgggaggccggaggttgcagtgagctgaggttgcgccactgcactccagcctgggtgacggagtgagactccgtctcacaaacaaa

SEQ ID NO: 584135 - DNA, 953 bp, Homo sapiens
ggcgcgcggaggaggccaagatggggcagtgcggttcgctttcgcggggtagtgttgggcccgcgggggcgcggggctccgggcgcccgtgccccggggtctggttgttgcagggggcctgtgaagtccccggtagcgggacaccctcagaggcgaggggggcctttgggtcgccgagaggtttgggccttttccggggggccggaaatggttggttcggttggcacaggacgttgggaacattggtgcgcagacaaggggtggttgcgaggagcttggcccggggtggctcataggatttcggcttgtagatgtcgcagttgactttgaatggtttgaccccccccaaggttatcgtgtggctctcaacgggtggcctccatcttttcgtgtggacccaacacccgaggacaatcggggaggggggtcccccgggaggaaatataacgcagggtgtgcgctcgttgcccaagcaggatgtgacttggtgaccataccgggcaaacgatgggggggcgtgtgcaacccggggagacacggaagccatcaggaacgctgggactgggagagaggtggcagggtccaagagaaggggcccacagggacagcatgcgggcgaatctccatgccggcggggacagcctggtccgaatatttcccaaagatctataccccaaagagtgaattgttggttcggagttgccacaaaatggtggatttgccccttgggacttacggtataattcgccgagctacgcattgtgagagagacacacctcttctcccttgcccgcgtttactgggagccccccagctgggttcaatgcgggaaggtcaattaacccttatttctgggcaggatttgctggctcccattacaggtttttagtttgcatgcccctgtccattccagagcagagtttggctttgcgggcttgcaagcacataacttg

SEQ ID NO: 584136 - DNA, 481 bp, Homo sapiens
taccagtgagtgaaaactatgagaataatatatacatctttgacatgtcgtcactgactcattgcaaattgttatttacagacacatgcatgcatgcacacacgagcatacttgtacctttgtctctgggcaaacaggtgggactgttagtgacccatttgggaaaatagagcatctcagagaaggaggtgagttcttcctgcctgtgatttctcttggcgctcccctcctctcccgctctggcttctgtggcggcagtggtgggtaagcactccagtgttctcttaatgaggcactttgcctgtcactcgagcaagcctgggtattccttcctcctcatgctcctggaatagggaatagggatctcatgcttgcaaactacacaatgctgcaggtgcttcccaggggccacaggctgtcaggaaacgtgttttatgttaagtcacaaacccacttgacttctgggtactggaattaatac

SEQ ID NO: 584137 - DNA, 705 bp, Homo sapiens
ccgccagaagagaggtgtagtgaaaagtacccctagatagccataaatgggaataggaaaaagactcatatcaacttggtcgtcattggacacgtagatgcgggacaagctccaccactactggccatctgatctataaatgcggaggtcatcgatccaaaagaagccaatcgtaagaaatagagaaggacggctgctgatatgggactagggctccttcagagtatgcctgtggtctgtgtggatatagaacctggatacagctagacgacgtgaaccgtggtatcgaccatagatgatctccttgatgcgtagaattatgagaccagtgatagttactactgtgactaactcgattgtattgccccgaaggactacgaggaggactttatcaaaaacatgattacagggacatctcaggctgactgtgctgtcctgatggtgctgctggatgtggtgaattatgaagctggtatctccaaggaatgggcagacccgagagacatgccctgtctggcttacacactgggtgtgaaacaactaaatgtgtcggtgtttgacaacaatggattccactgagccacctacgagccagaagagatatgaggaaaatgtacggaagtcagggttacttacgaaacatcggtacaacccgaaccgagcgggtgtgccaattctggttggaatggggactaatgctggacc

SEQ ID NO: 584138 - DNA, 402 bp, Homo sapiens
cgagtactatctaggggtaactgccagcccctgtttgcgcctacctggactaagtgagagacttgtcattgctaaagcatataaggtagctccagggatttctgaaaaaagacacaggcttcttcctagagccagccctatataacatgcccacaagggcaacagtcatcacagttcataacacaccttccatgtcctgtctcgctcactcctcacagccatcctaggagatacatattgtcttcatcctgcatttacagaaaaagaaatgaccccagagagcttcaataatttgccacagaaaatgtcgaaactaggcctttgaaccaaggcagtctagggtaaaaaatagtttcacagtatgaataagaatcgagatctgagtaaactttgagtaagaaa

SEQ ID NO: 584139 - DNA, 154 bp, Homo sapiens
ttgcccttagcccactctttaccacaaggcaacaccttacaaccccttaatccccatactaagtaatttatcgaaacccatcagcctacttattcaaccaatagcctgccgtacgctgaccgcgtacattactcatgcacctactattactatt

SEQ ID NO: 584140 - DNA, 393 bp, Homo sapiens
ggcagcattgtgcggggtaggcctctcccaggagtaacagtccccattcacctcaccctcctgtgtgctcccctcccctcaccccgttcctctccctcaactggcaagtgatctctgtccctcgcaggaacccggctctcaagcaggagctctgctcctatgccattcttggtttggccctctctgagggcgtggggcttcgctgtttgatggtcgccttcctcatcctcttcgccagtgtgaggctccttggggggtcaccgggctgtaggtactgcaagtccagaccattcttggtgctggggggtgtcaagctttaccattaaacacaaggtttccctaagaaaaactgaatctcaatgccctggaacatctcggagcaggagctggaag

SEQ ID NO: 584141 - DNA, 170 bp, Homo sapiens
gggtttcctctcagtcatctgatccagagaggtcacgtgtcatcatcatctttagtatctgtagctccgacttccgtgtagatgtcttccacatcggcagggaccatatgagcccaaagcttgcttcactcctggcaggctggccttttccttttcgcaagacttgatgt

SEQ ID NO: 584142 - DNA, 651 bp, Homo sapiens
cagagtcgtcccgcccccagaaacgagtcccgtagcagactcatggcaccgccccgaatcgggacgcacaatggcaccttccactgcgacgagggactggcatgcgcagtgcttcggctcctgccggagtaccggggatgcagaggattgtgcggacccgggatcccgagaatagattcgcttcctgtgaacatcgtggtgggacgtgggcgtggcggagctacgtacgcctcggcaggacgaccggatgatgacgcatcatcgcagaggtcatttcgcagagtaccatgagctccctggtgccctgtggaagccgtggcagtaccaagcttgacgcagtgcgggactcatctagtctgtacattgcgggtcacaagactgcctgggcccagattgctggggcactagatgaagcaggacagtcatggttgggcaccactctatgacaagatgtatgagaactttggggatggaggtggcatgctgttggactagatgggatctcccagtggcagagggggagcctcgatatgcactggagcaatatgctgagtgcgcgagttgctcgcagttaatcctacctggaaccagcccgagcgaagacagtgaggccaggcttcaagctgtgcaatgggagtctggttcaagagg

SEQ ID NO: 584143 - DNA, 335 bp, Homo sapiens
aaaattttcggtagtgtttcaaattgtcttctgaacaggaatttaacattggttttgatgaaggtgagggtcagttctcaagatttgtgctaatcataaaatgaatgaatgcaaaacaccttgtaatttcatatggaattataaaaattaggtttgctgggttttggcctaataagagtgctagtatgtattggttagaatacatcttactatttcacattttaaaaatcagtacactcttcaggattttcttttatttcaacttggagcttaaattacttccccccatgtattattttcataatgcaaaaaaatataaattagaatattaaaaa

SEQ ID NO: 584144 - DNA, 936 bp, Homo sapiens
gggatcacacactccaacccacctcggtctcccaacagtgtcgcattcacaggcgtgatcccctgtgctcagaccgggttgtgacactgttcgtggaaaagcaactgtcagtacttcagcacacatatatagaacgaagttcaccaggagccgtcactcaccccccaggttgatgctgttcgtacacaaacttactgtctaaggatcaaaagaatcgcacacagacatgttcgatcatatcgctgtgcataggtgtgatcgagatgcgtgaagctggaattagcccctgcccgtaaagggaggcatgcagccgcgtgtccatcaaaggcatgctgtgtgtcggctccaatgctcgtgacttagctcgcggatggtggtcgcgggcggccccacgtctagtaggtagcacacgagcactccgtgcttgccgagggcgtaggctccggagtggcaagcggcgcattcttgaggaagacagatatggtcggggtcctaaggttcccctagcgacgtgagtgggacgtcaacaagggcatggcggtgatgttaatggtgaagcagaaatgatccattttattctagtagtgtaagagacatagtcaattgtctgaaatcctggctagagaaaataggactgtaaatgggcgtcctcctagtcactagcagttgtacagcaaatgagcagcaggggtcactaactcttgcccatcatttcaacacggggctgttgacagtatttttaggctgcaatgatttgccttatcttttatcccaggacgctatacagtgggactttaaaaatcatctttgggataagaatcccgagtcaccgtgagggatgtgaattgaagtcgctccaaggcagtcaagcgcagccatttttctgcagagtcagtgactagttgcacaggagatcaaaattgccactcagtggaa

SEQ ID NO: 584145 - DNA, 411 bp, Homo sapiens
tggaccctccccgggtttaagggcagggacttgcgcccccggcacctttgggagttgggattataaaaattaggcttgcggctgtggcccgctggtgggtttagccacaaggcccccaatggcccaggagcaaatgggaggaccccgaggccaaaagcacactgtccgagcccttttgttcaaccgcttgggacccaccagggtgcagttgggctccagggtccagcccccaagctgcatcagggtttttgggaaaggaggggcctggagggccaggagtcccaaactcacgccccctgggccccagggagccgggaattggggcctgctgctcctgctggcctggaaaactttgtggggtcagccctgtactccgttgctgtttttttataaaccccctcttggaagtga

SEQ ID NO: 584146 - DNA, 116 bp, Homo sapiens
agttcataaaagttcttgagccctaaattttttcccaaaaaaaaaaaagttcttaagtcatccattttaattgggtaaaggttgttcacctaaaggaataaatgtcttttaaccta

SEQ ID NO: 584147 - DNA, 1145 bp, Homo sapiens
gccgcgctgtgctagctgtcggagatggtcggggcttcagcacctcgtgtcgtcctgggaccgcgtgacaccccacgctggggccgatgcccaacagtgatatcgacttgagcaatctggagcggtgtggagaatgtacccggagcttcgagcgcctaccgtgtgccgagcatagcacgcgaggcgctagggccccagatagcatgggtgtgcggaccgtaccgatgagtatttcaggggagtaaggactacgatcccataaggagacagattgatattggggctgcctccaaccaaaagtcatcccggtacctcaaccatgttactggtaacggaaagacgatggccatccgaggagctacgggccaactgttggaaggaggtaggcgtggactgcctcagctcttctcgccaagcagaccgagtggtccccggctggagtgcccgatggcgagggccgagggtggggagatggaccattgtgggccgcctaccgagaaagtcagcagtcttggctgagtacttagcgggcatctaccgagaactgttccacggtgcacagctttgttgccccgggagtccccttgcacgtgggcctacgactgtggggttgacggactgatgcctgaatgccctgttgtactggtgggcaagtgacggttgacttcccaacccgtaggtctttgcccaagctgcccaggaagggtgtacagtacttaagtgcccagacatgagcgggcttcccttggctagggaccagtttggcttaacatccaacgtaaagcttttgtgctttggcgcctaaccattggcttgggaggctcaagatttgccttggaagtaacccttccgcgaggttggggcttggctagaggccaaaaggggttcccccgggggtaaaacacctggggagtttgggctttagacattgtggaacgcaaagggggttggccgcgggttggttccccgtgtagagccgttacgccgcgcagcgactgggtacccagtttgggccgcaggaagggggcttccttgcgagaatatcccagacacgcgcatttggcgcgtataccatgggggtccattcccaaagcgcgaggggaaccccaagacgcgggaatttggagcttctccgtcttagaggg

SEQ ID NO: 584148 - DNA, 107 bp, Homo sapiens
cctgggtcccatttatctgctatttcacttggtacagtgttcagtaagccacgctcaaccacagtcagaaaatattaaatggaaatttccagaaataaacaagtttt

SEQ ID NO: 584149 - DNA, 160 bp, Homo sapiens
gaaaactttttttttaaacccccctttcattgttttagtcaaagcaggattattaagggattatttaaaattcgtttttttaaattagcaacttcaaggaaaaccactttgaaactggaaaaagggtttattttctattaataaaaatgaattgtgccca

SEQ ID NO: 584150 - DNA, 1047 bp, Homo sapiens
tggttgcatgtcccgtgggctccgacgagtatgagcagaagtttggttagcgatggtccagccgtgctgaggtggcctcaagatgttgcgaggccctgataggtcagagaatgaggggcgtaccatgattccgacaggtgctggcggtctccccatgaacttgtctgcgtagtcttgttgatgtgtgaagtatgctagtacgctgttaggtcttggaggtgcgaagggaggtaatcttaattgatggtacagttgtgggagaaatcatggacagatggctgctggttggtgtggaaatgagagtggaaactggtggatactatgggataggggacatagtgtgcttaactgtaggagttttgcagaggtgtaaaatggcggagctgtcgtatttaagtggcgtgtgaagttcggccgagaaatgagtttccagtgtgtgtattgactgtggtacggatttaagtttgtagtcttagagtggagtgagggcgtgctcttaatgcgaacttcgataatacgtggatattctattggttattgccatatatggtcgctggtccggggaggggattttgggatctgaggatggcgtagtgggaaggcattgggctgtgttgttgacgtgaggtttttactagttttgggaaatgattgaatgttcggtgggtaatctatgcaagtgcgcttgagtgagattggattataaggtgaagggatggagcgtcattgaataaggtgcgatatatgggacgcatggttcggaatggccaagatatttgaattgtgtggggtttgaaacgaagaggtgggtcttggatttttcgactgttgtgttgttatataaaaaggtatccagagggtggtaagcggaattgtctgattttcagtaagtttgccactaggaagctgggctagggtggtaattgcaggattgggtagttatgaatagtttcacctgttttgtattcttacagggtagatcattttggatagctgtaaattataaatgaccttttttgtcggcctacgagtattacccaagggatg

SEQ ID NO: 584151 - DNA, 870 bp, Homo sapiens
  misc_feature (202)..(202): n is a, c, g, or t
  misc_feature (648)..(648): n is a, c, g, or t
gatggcggatcgtctggagagccagtagacgaatcgaggaacgactgtctggtcattaagtaggagctgctggatgctacgtgacgctttgtgacatattagacgtgtacattcacaggtctaggagtcttgtgagacagaagatcacgagaggggcggcgatggtcgaccaagcgaagctacatgctgaacgtgaggtagntctcgacggagcaaacaaagcaccagatgtgaaacatggtcacacagtggcaacgcatggatcagagtacgtgcatacggtaggtagatccactgccgtggtctctgtatggtagctactgtatcgcactcggaatgactccctcatactagacttgtcctgtggttcgtgcatatccacgtgggacgaaatctccaggcgctgttcctgaggatcgatcgagaactggtggggagctaatagaaatcatggtatagagtaacgaggtatagaagatatgttgttcttcatggcagttggtgtaacgttggttgcagccaaattcgcttcgaggaactcggtgaagatcgaatggtgagaatcagtctaggttgattcaaaagtagacaataagactctagtggtgttcatgcatcagtacgcatgcgcaggacacggatgaaatngcgactcatatctacccaagagcagaggtgtaccggaatacagtgtacattatgatcaaactcatcgtatggagagcacgcgtagcgatgcggggcccgaaatgactatgtccctggccctccggcctattggcttaattttcggcaaagagtttctgctattccccttgggacccctcaataaggggttatgggcccccaacgggcggtcctatggaatcc

SEQ ID NO: 584152 - DNA, 178 bp, Homo sapiens
ccgccgtacagttgcgacaacattggcttgagtgcagccgccgctttaaccagtgcaaactgacacgcggcaacggaggtcatctccgtgatgaatcgggccaagaaagcagggaagtcagtgggagtggtaaccaccaaacgagtgcagcacgcttcgccaggcgtgaaccttacgc

SEQ ID NO: 584153 - DNA, 363 bp, Homo sapiens
gtttgatttaaaaaatggaataactagcaaaactcaaagtcccaaaagcatgagaagggtacctaaactttgaaaggtctttataagattcttcctactttgccatatccagaacacattatcaggaaccaagactaggatatatggttttcacagtgctttgaatactcccccaagtagcccattttcctttgaaaattccttgagtcaccagttgtttctgcttaaggtggctctgctttgctcctcattgcatttgagctggacattttgtcagtttctgcttttcatgggaattaaagtcaggctaccacacacacacaaaccatagactgggtgacaaagcaagactatctccaaaaa

SEQ ID NO: 584154 - DNA, 292 bp, Homo sapiens
catatcatctagccgttccaggatacagctataccactggaaggaccaatttcgatccatccagcagtgggaacttgaatgactcagtgatacgtcatgcacgggttgctctgaggttaacaagacctgtgtgctgaattattctcacaagactcataccaccaagatggaaaatgaggaatgtaatgagcaaagagaaagaaagaaagaggagctggcttcaaccgcagagaaaacggagcagaaagaacccaagcccctagagaagtcagtctccccgcaaaattcagat

SEQ ID NO: 584155 - DNA, 308 bp, Homo sapiens
atcacaactagggtcagtttgcaggtgtaagccatttaccaagatagtgtaggtaaagaagggcagatttattagagaaatgtgaaaatatgttgcagtgggcagctcagcagagaaggggctacctgcaaagaggcgagggctggaggaaagttttatagggtcctgctgaagggtgctacgtgtggaatgaggtcattgtgcccgcaggttgtttgtgattagctgtctctgacaattgctcatacaataattgttcattattgttctcaacttggggctctccccaacctggggacccttcctta

SEQ ID NO: 584156 - DNA, 164 bp, Homo sapiens
aataatgatagctactttctggtctttgttcttttcttgtatcaccatattggatcaaggtagataacgattgctagtgctccatagaccagtgtagaggctgtgcacttggaagagtggcctgttatggggttctacattatagctcaagaggaaggaagagg

SEQ ID NO: 584157 - DNA, 440 bp, Homo sapiens
  misc_feature (338)..(338): n is a, c, g, or t
agtactaaagaggttagcttttggttgtttcattagatgcgagaagatgcaggcccaagagtcgggtgggacagccaggctcaggcaattgggtaaatgtgtcggaaagaaaattagacatgggaggatcaagaccataagacactagctcattagagatcaagaatccaaatgtgacattcatatccgtccagggccagcacagattcataacacgaattccatttaacatctttatgagcatttaagacatgcatttaattaaagtttccttaccagttaactctacgggggcaagcgttctaaagggatccacatcttcaaattacaagggctgnagagttacatgaatgtgtggtgtaggggggtggtctcaggggagcaggggaaaagacatggcagaggaagttggtaaaagagggtactttctcctgaggaga

SEQ ID NO: 584158 - DNA, 539 bp, Homo sapiens
cgtggtgtgtcaggcacacgaggtggggagattgaactactggatcaggctgcgatgtctggtgtcggtggttcgtggtggcagagaatacaggttctggccggaggaggagtagtagatttctcctctagttcttctaagttcttctcctccagttgtggtttcagctcttcagtctttgtttcagattctggctcaggttcaggttcatgagaggattcttccaaaggctcctctatgccattagtcacagggtgagcttcatagtaaccactgttagcattttcttgcacaggttcaggagatggttgtctttcttcttgttcctcttctacttcatcttctgattcttcatcaagttcaggctcagaatcaccaaacacttcatcttcataacgaaacatatcattgtgaacataaaatttatttggaacagatccttcaggagccagaacaaaggtttgcataaactttctttctggttgtccactgttagacagcaaacccatgacctggacaactactccatcactcaaggt

SEQ ID NO: 584159 - DNA, 159 bp, Homo sapiens
cttcagggtactattctgatagcttccggaacaaaccaaggcaaagctgcctatgtattggatacccccttgatgagacgggtgaggcagacccaacggcacatctcaacggtgaaatatcatgaacactttgataaacacaagggttgcttcacacca

SEQ ID NO: 584160 - DNA, 518 bp, Homo sapiens
  misc_feature (106)..(106): n is a, c, g, or t
  misc_feature (242)..(242): n is a, c, g, or t
  misc_feature (247)..(247): n is a, c, g, or t
cttcaaagagccttagaaagccacgtgtttatttgcagccaaaccactcaaacctcaagtttctggtttgaatgaactacatcaacccagcggtggcgaaactatnacttaggtgcatcttcctgcgcaaagcctcccaaaacatgggggcccctggccgcaaaacgccgcacccacggatgggcctttgctgcggaaaaggctgaggccaagggaggagcagggaatcgtccaaggtcatntgggnccgaccccggcgctttccacggcccaggagggaaggggcgtgcgcaccgggaggcctcctccccgcgcccccgatgggacccccaagcccggcctggccgctgcagggaggccggccccgccgccctcctcgcccggatcgacccctcagtgcccggctgccccctaacccgcctgccggcccggaccgccccaggatcccgcgtacctggcaaggcggaacgcagcggcccgaagcccaaggcaaggcccccacagggggcgagcggccg

SEQ ID NO: 584161 - DNA, 450 bp, Homo sapiens
  misc_feature (265)..(265): n is a, c, g, or t
tggtagccaggccttctgcatcagcaaatggctggatgtaatcgaaaaagggttcccatgctccaggttccattaacttggggttatccaggattttcccatatccgagggtggagatgttaaagaagcccttagaaagcctccttagaacccttataaagacaggatgttttgcctttaaaggggcccgggccttgaccttaagcctccgatttttccttaaaaaccgtgggcccaatattgaaagggaaattttttcccttgnccgggttttaaaaagggtttttcgggaaaaaaaaaaaaaaaaaaatgggccaaaaaggtatcctgttggttaagtctgggggagcccccgtttttaaaaagggttaaccttgaaccaaccatttttaaaaatttttgggttggaaaaggttttcctttaaaaaaagttttttgttaagggtggga

SEQ ID NO: 584162 - DNA, 160 bp, Homo sapiens
  misc_feature (149)..(149): n is a, c, g, or t
cggctcctttgccttccaggacctcagccaccctgggccccagggtctccacagacgcaggtggccctgcagtaagaagagtccaccacctttcttatcgccacagttaagaacaggagggtctcctctgacccaatcttcattggcanagatattcatg

SEQ ID NO: 584163 - DNA, 160 bp, Homo sapiens
aacctgcgtggaatccctgacgctaccgccgtgatgcccaggaagacatggcgagctggaagtcaactacttccttaagatcatccaactagttggatgattatccgagatgtttcattgtgggagcagacaagtgtgggctccaagctagatgcatgca

SEQ ID NO: 584164 - DNA, 87 bp, Homo sapiens
acatctgtgtacttctgtgccagcagtgatagacaggggaaaagctacgagcagtacttcgggccgggcaccaggctcacggtcaca

SEQ ID NO: 584165 - DNA, 134 bp, Homo sapiens
aagccaattgctcttccattgtctaagccgggtcgacaggttggacggcacgcggtgcaggcgctcggcggcacgggtactggagccctcttccgccacagcctggaaaatgcgcaattgactgaactccatta

SEQ ID NO: 584166 - DNA, 170 bp, Homo sapiens
ctgtatcccgtaaggaccctggggtatgctggttggctccctgagcagacatgcaggaaagaagaagcccttcgatgtacacccagtgaccaggctgtcctaaaccgggccttcttcccttgcttcgacactgcctgctgttaaatacaatgtattcagctcttattgag

SEQ ID NO: 584167 - DNA, 427 bp, Homo sapiens
tgcgtctgggcgttgcatgatgttgttgctaattatatctgccatatgtgtgttaaagtaaattaaaatggagacaggcctgaagaatccctgagcagacaaaaccagttgggcctcatcagtgacctaaaccttacttgatttgcagcataagcaaaagttaacttgggctatttcttgtaaatgcctgtattaaagaaaaacagaacttaagcccaaccaatcagaagtagccagccaactcataattatataactaggagctttccagcaagatagactaaatgagatcggttataactgtaacccatcaaatattttcttttttttttatttttttttttttttttttttttttttttggggaaggggatttttttttggcaccggggggggaatggggaaggggggaaatcggggtttgggg

SEQ ID NO: 584168 - DNA, 168 bp, Homo sapiens
gagatcgtgccatggcactccagccggggcaatagagcgagaccccgtctcaaaaaaaacaacaataacaacaacaaaaaaaaacaagtgcggggtgtatccctggggacggaggcatagctacaggatccgggggacaggagacgcatggcctatcaggaagtagcc

SEQ ID NO: 584169 - DNA, 930 bp, Homo sapiens
  misc_feature (696)..(696): n is a, c, g, or t
ctcagaagcccaagtacctgtatctgtccaagtgtttctttttgcgtatggattgtttttttgtgtgcttatggatcttgacctctgtgtaacttttttctctagtcattttcattttctctacctctttttgatcttcctaaacttgacattatatggaactgaaacacctcaaaaactgttttgtttaattaagtgctgggattttaatttaaaaaatgcttgaaatgaatatctcatttatgtgattacagaatactaaacagccttatcataagcagcctcatcaaaaccccctagggtagtgaaagtgatttgtagtttcttacaatattctcaataagtaaaaaggctttttaaacccttgtttgaagtttttgtctcctactcagcacactgcaagttgcacaggcccatgttttctattactgtcttttttttcttttttaaaaaatctgatgttggataactagataatcttaatcccccttctttattcctattgtccagcaatacatctctaacgttttcattaatgacgtgtatgtaatttttgctctgtttccctgatgccttgaaccattgtcatgtttagctcttatttctgctttgccacacatattcagactgtattaatcctcgcgttcttcttctgggtaccacattagaaagaaaagctaagtgcaattataggtnccctggttattttgaattgcgttttaactatacctctgatgtattcgggttgtaggggcgacgcggagctaatctgaatccgcttttcgggccaaatggggtcctggcccggtttaacgctggacgcgaatccttcccaaacaaaatcgggcggggggctccggcggcggcgggaccggcggaatctcccgccgcctggggggctcacaacacagtttttttttatccctttct

SEQ ID NO: 584170 - DNA, 1460 bp, Homo sapiens
gagataagtacgagatggtggatagttgcatctgactcatgcacgttgggcttcggctgtcgtgcgtcacagcgctgtccccgttttggcgagctgcattcagtcgcacgtgtcagtgctgatactgccatgaggagggttagatagaacgacctgtgaaaccgcgtacatctccagcatgctgttacctggtattacagagcagtgaggagtgctacgccctgagcatgtgcagcatagatgtcactgtacatttggcgttggaatacggctgatggatatgcgaccgcaaggagggactcgccattccaactcgaggcacttagacacctacggccgtccaactacaatctgctgccggcataacagatcacgaacatacagcggggcagcgtgggcataggacagcgcggttcgtgctacttagtaccttccggcaagacaacataaggattgcgccacctccaggtccggccggagcctattgtcattttagactgataagtgaccacagggcgtggattcgcgtagggagtgaaggcctagagaaccaggacagcgaaataccactttcgccgacgcctccgggattcccctagacaatggaacgcaacctagggacaccaacagagctagtttccccattggtctggttaaaatacataacgcgcatcccaaatgccctacgctgtatgcagaccctgaaaccgtactagccgtaggacgaagtcgaccgcagaccaactgcgcgaggcgcaatccggcgggccatgcgaataggcgtaacttcttggacgagccctacattccttcctggccaggaggacagagcgcacaagcctagcaccaggagttcccatcgaacataggtaggattcatcgctgtagaaatgatcaattgcgcacattcgtagggcacccattggaacacaataacccatgctacaaaaggcataactatgcccgcttggcagccacctcgggactgcacacacatgaattcccctagggatcttcgtaacgctgacactggcccccgccactgcgtgcgctatgtcgttggccatcattttgcgacatgcggccaaagtgaggatctgagaatataacgcttggggagcaaacgaagaccgacgggcgagcgcaggttgggcttagacagggattaacatagcggaaacaccctagcgaatcggaagcggcatcccatgttgagcactacgacagatagactgcagaccaattccactccggcgaaccctaggacctatatcaactacacctagacgacccacctaaggaaacgtcacttgacggaccctcatcacaggcgcacaccaaagcggcactgacaaccactgcgcgcacaccacgaggcaacagacaacacatcacagcgagatgtacacacacaagagcagcacatcaccaatcaccatagacacttggctcacacacga

SEQ ID NO: 584171 - DNA, 111 bp, Homo sapiens
taatgatcaagatccttacgttactctgaacagatacagaacaatatgaacgtgaagatttcttgattaaggccagttataatcttataggttgtggcccagctgaacagg

SEQ ID NO: 584172 - DNA, 388 bp, Homo sapiens
  misc_feature (9)..(9): n is a, c, g, or t
  misc_feature (12)..(12): n is a, c, g, or t
  misc_feature (14)..(15): n is a, c, g, or t
attcgcggncgngnngacagacagagtcttgctctgtcgcccaggctggagtacgctggcaagatctcggctcactgcaagctccacctcctgggttcacgccatcctcctgcctcagcctcccgagtagctgggactacaggtgcccgccaccacggccggctaatttttttttttttgtatttttagtagagacaggatttcactgtgttagccaggatgggctcgatctcctgacctcgggatctgcccgcctcggcctcccaaagtgctgggattacaggcgtgagccaccgcacccggcctaggggtgcaattcattcttatttttggctggagatggagccaggggctcaggagctgggcagagcccatgttgacgcggccg

SEQ ID NO: 584173 - DNA, 950 bp, Homo sapiens
tgttctcccctccgcagcgtgcggcgtgtggcgtgagaaggaactcgacacgcaccgaccgccctaccgccccagtcgaagcgagaagctagtacgacccgctctgggacggggccatgggcgccccgcgccagctcgggtcatgacgacggaggcggtaggcagtcggtgccgccgctcgagcccggggcactttgtgcaactgcctgtgcccgtcatcccatcagctctaccactgggactgtggcctggcctgctccaggatggtgctgctggtacctgtgccagctggacgacagtgagtttgagagagtccctgcacgatagctgcagctgaccaggagcatctggaccatcgacctggcctacgctgattgcaccgatgtttaggcgtgcatggcaccgccttcgtgtatcccgagtacccttggtgttgtcgacatagggctacaagaaccagtccttctacatggaagcactttgtacacatgatagagacccgggtgacatcacgctgtttgcacacagcaaaggcctgcaaggtgctggtggatgaatagtgctcagttgagttgtgccaggacatccaggcgcacctggctcagtggccatgtggccatcgtgctggtgaactcgggggtgctgcgctgtgacctgtgctccatgccctgtcaatgtactgctgcttcaaccccagtggccaccactgcttctgcccgtactcctgactaccagggccacgttcatcgtgctgcgtggctacaaccgggccactggcttgcatcttctacaatgataccaggctattgccggacccaggaagttgtcagcaccaggcatcagtaacttttgaggaggcaaaaccagttattgcacagattaaggacatctctttgctactgggacgttgacgggtggacctggtgccctaagcccggaacccatccacc

SEQ ID NO: 584174 - DNA, 528 bp, Homo sapiens
cttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgtacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagtttgtcttcattctgaagtc

SEQ ID NO: 584175 - DNA, 367 bp, Homo sapiens
  misc_feature (342)..(342): n is a, c, g, or t
atatgtactacatttggtggaatacgcatgtacaattcttcaaaaatagtaaagagcaaaacaaacaaaaaatagtagaagcactggagaaatacactatggcataaactagttacgggtgggatgtcacatggaccatatctacactctgtggcaaccttcttacctgactccaaaggatcagataatcaaacaggaaattatggtaggaaatcagaaaattgaagtatgcattcatatcctaagcattttattttagctcaaaatataaaatattcatcagttagccaagctttgggatgagagatcatagcctcctctttgataggggtttcttgtttncttgatttcatgtttcagagttttt

SEQ ID NO: 584176 - DNA, 230 bp, Homo sapiens
ctaacctagacgaatgaaattacttaagtccctttcatatctgatactgttaaactatctataccaactggctactccccaggtgtctgtgaaccctttaaaactgtatgtaacattgtgtgacttaccgtgcattttttgagaagagttaaccaatagctttattccttctctattttttaagaaatggccccacttttttctccaagttctggggtgtgcagggtgtg

SEQ ID NO: 584177 - DNA, 222 bp, Homo sapiens
taaagaggtagtaaagtgtgggcagtagaggctcccaagtttggcactaccatccccaggcttagccctgctgacgaggactctatgactttgagccagaaaaccaaggttaattaggatttaaagacggggacatcattacattaaccaatcaagtagatgaaaactggtatgaaggaatgatacacggagaatcgggattcttccccattaattacgtgg

SEQ ID NO: 584178 - DNA, 227 bp, Homo sapiens
tccccgacgagacacgatgggaaagtttgctcgagacaatgaaagcctatgggaaactttatcgctatatactataatccacacagggaaaggcacggcactctgggtgagactgggaaggtcctcagccattcagcaccactgcggactagctccgtccccatgggcccgtcaccccgacaggatatgcctcaccaacgcttcattgtttatacaaccatttgctg

SEQ ID NO: 584179 - DNA, 569 bp, Homo sapiens
tgggacccctggctgcagaggagctgccccctgtgggagactgagctgttctattgctcgataaacccctcttcatcttgctcatcctccacttgtctccatacctcattcttcctggtcgcagaacaagaactcaggacctgtcgaatggtggggctagaagagctgtagcacaaacagggctgagacatgccccctgctcgccacactgtgggtgaagagaaggagaggacagctgtagcccttcagggagcccagacctgggagctcccggagctaggcctgtgactccatctttgggaccctgtggttcctggtatctccaaacttccaggagctaccatgttcctcagtgtcaaccatggaagctgcttgcagtgtgtctggtctggccgcagcctcacagagagcccgcacccatgctggcacctggagctgcccaccctgctgcagcacccagcgtgcctgactggtgtggccagaccccgtgctcctcacacacccctcgccactccatgcctgactcgcccttggcaggcatgggacccaggctggtagtgtgagccaaa

SEQ ID NO: 584180 - DNA, 229 bp, Homo sapiens
ctcgcgaacgtgttatccctggaatggcttcatgtgggctgctagtgagtttcattaattatctgcaagatcagatggatattctcaagagagatagataagcttcatgatacattgtgtcaccgtctgctttcttacctctatcctagccctgactgtcccaagtcctagactttatcgtatatatccatctctaaacgggtttttaaagccctcaacacttgatcct

SEQ ID NO: 584181 - DNA, 218 bp, Homo sapiens
  misc_feature (20)..(20): n is a, c, g, or t
cggcacgctaggatgtggcntatcaaaatatacaagacaatggatgtttatataaaaccactttataagctcattgttcccaaaaacctttttttctttttggcctgttaaaaaaaatgtgggttagtaggcctagtatgaggagcgttatggagtggaagtgaaatcacataccaaggccaccacacaccacctgtccaaataggccgcatccaaag

SEQ ID NO: 584182 - DNA, 956 bp, Homo sapiens
  misc_feature (30)..(30): n is a, c, g, or t
  misc_feature (851)..(851): n is a, c, g, or t
  misc_feature (859)..(859): n is a, c, g, or t
  misc_feature (864)..(864): n is a, c, g, or t
  misc_feature (875)..(875): n is a, c, g, or t
  misc_feature (880)..(881): n is a, c, g, or t
atccttaattaaattaatctcccccccccnggggatctcggactccctggaccctccctccagcccagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaagcctgaactaaacatccaacactgagaatctcttcataatctaggcacagataatctttaacactaaactactgtgaaattctaccagcattaagtactgtatatcgccctgtacttggataggctggtaactcgtaggagagagcnctgttggnatccnttgcttattcnccgcnntttgggggaacattttttttacattttaaaaaaaacttcagcttgacaaacaaaaagaaaaaaaaccgggggctt

SEQ ID NO: 584183 - DNA, 477 bp, Homo sapiens
ccccaaagtatccctatctatattttagtctctaacagaatcaagtaagatacatagcttgttcatatacgtggacaatcttattagagctatgtacgaacatcagaattatctgtgatcgaacttacttgtcattggcacttacagtctttcctattctagccgttgtttttgtttgtattttttattattaatgacatatttagtcttcagatatattatgtaaaggcaccacacatgtaaaacagttattacaaatattttatacataaatctcttggtagattttcagaataatagagatttatatcaagaaaaggaatctagattttgttgcattgtaggagcaaacaaggcttcatattctttttaaaatgacttgaaattttattataaatttccatagtttctatcaaggtcaactggcagttttattacctttgctatggacttgaacttactgtataaaattagttg

SEQ ID NO: 584184 - DNA, 926 bp, Homo sapiens
  misc_feature (30)..(30): n is a, c, g, or t
  misc_feature (821)..(821): n is a, c, g, or t
  misc_feature (829)..(829): n is a, c, g, or t
  misc_feature (834)..(834): n is a, c, g, or t
  misc_feature (845)..(845): n is a, c, g, or t
  misc_feature (850)..(851): n is a, c, g, or t
atccttaattaaattaatctcccccccccnggggatctcggactccctggaccctccctccagcccagcctcgctagctccgcctgcgctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaagcctgaactaaacatccaacactgagaatctcttcataatctaggcacagataatctttaacactaaactactgtgaaattctaccagcattaagtactgtatatcgccctgtacttggataggctggtaactcgtaggagagagcnctgttggnatccnttgcttattcnccgcnntttgggggaacattttttttacattttaaaaaaaacttcagcttgacaaacaaaaagaaaaaaaaccgggggctt

SEQ ID NO: 584185 - DNA, 120 bp, Homo sapiens
cgagcgtacttgaaaatagagtgtcaagcagcgagcgctgatacgactaggatatggatagacgcgtctatttgttgtttcgcactgagcatgataagagggacgccgtggcatcgtatg

SEQ ID NO: 584186 - DNA, 825 bp, Homo sapiens
  misc_feature (30)..(30): n is a, c, g, or t
  misc_feature (720)..(720): n is a, c, g, or t
  misc_feature (728)..(728): n is a, c, g, or t
  misc_feature (733)..(733): n is a, c, g, or t
  misc_feature (744)..(744): n is a, c, g, or t
  misc_feature (749)..(750): n is a, c, g, or t
atccttaattaaattaatctcccccccccnggggatctcggactccctggaccctccctccagcccagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaagcctgaactaaacatccaacactgagaatctcttcataatctaggcacagataatctttaacactaaactactgtgaaattctaccagcattaagtactgtatatcgccctgtacttggataggctggtaactcgtaggagagagcnctgttggnatccnttgcttattcnccgcnntttgggggaacattttttttacattttaaaaaaaacttcagcttgacaaacaaaaagaaaaaaaaccgggggctt

SEQ ID NO: 584187 - DNA, 264 bp, Homo sapiens
  misc_feature (32)..(32): n is a, c, g, or t
  misc_feature (35)..(35): n is a, c, g, or t
ggtcgactactactactaaattcgcggccggntcnacgtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgcttgtcgacgcggccgcgaatttta

SEQ ID NO: 584188 - DNA, 833 bp, Homo sapiens
  misc_feature (409)..(409): n is a, c, g, or t
attaggatgactatatagtaatgtaaggaaaatcagtaaatctctggtagttggatgaaatgtgtacggtcacacgctcgataatcggtgagattttagatggtaacagtttcgtgggaagagtagttgggtgaacgagtggggatgttcaaggtttggtaatgctagtaaatagtacatcgtacatgctactgtagtagttataggttgtataagagtatgtatgcattcttctttatgatgctaatgaaattcaactgtgattatggtgctaacaaagggcgagagttgtacttggtattagaaaagtatgtaagtgaatgttctcacgatgatgattcgttggtaaaatctctttagaatagacgttgttatgatgtgaggaacctattttctgaagagatacttncatccttagtaattgatgtttaaagggtaagcattacagatgtatttgaatgtattagatgctagcgtaagggttattagataagtgaggctgagaacttaagtcaaaagcgtctattgaggtataccattgtatgctagtttcaatttggaaagttggtctttagtggaaaaactaggagccataaagaatatttgtgaattatttgggaccttactaggttcgaaagggtatatgaatgtttgtttttagaaaggtatggaagacgaatgttgtcttcttacttatatagagttcattaatgttgaagtgtctaaaaccgtgcgactatttgagagaatgaaagatcatgttattaccgtaagttattgttacaagggtcttgaaattttgaaagaatttaagatgggggattcataaatgt

SEQ ID NO: 584189 - DNA, 646 bp, Homo sapiens
  misc_feature (30)..(30): n is a, c, g, or t
atccttaattaaattaatctcccccccccnggggatctcggactccctggaccctccctccagcccagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagaggtgagttgggagaccgttggttaccttcagaaatgagttgcgacagttagtgccgcttgctgaacaggaacctggcagtctccagatttttagttgaaactaagcaaataaaatgggactctgattttctaatgtcaactagttcaaaatattgagttttggacctaacaaagttcttattaataattccagtgagccgagatcgcgcccctgccctccagcctgggcaacagagcaagagactccgtcta

SEQ ID NO: 584190 - DNA, 162 bp, Homo sapiens
ctgtcgctgtcatgcctgtagtctcctgaagatgagatgctttcccaggacttcacatcccacttctatcaggtttcaccaacagggaggaagccctgtcaagatctggtgtgtcctgttttttattttttttttttttttggggcagttagaggcaccatg

SEQ ID NO: 584191 - DNA, 345 bp, Homo sapiens
  misc_feature (291)..(291): n is a, c, g, or t
  misc_feature (328)..(328): n is a, c, g, or t
agttcgagcaccgcatggccaacatggtaaaaccccatctctcctaaaaataaaaaaattagctgagtgtggtgacatgtgcctgtagtcccagctacttgggaggctgaggcatgagagttgcttggacccgggaaccagaggctgcagtgagtcgagatcgcgccactgcactccagcctgggtgacagagcaagactctgtctcataaataaataaataaaataaataaatggttttgcatataataattcaataaccccttacaataaccctgtgaggaagagatangctactactattatcctcagtttaactttatgggaancaaactgaggcccagga

SEQ ID NO: 584192 - DNA, 172 bp, Homo sapiens
taaagattcccggcacgaatgcgccatgttggacgtaggtgacttcaccttgacagcattgaataccatgctgcgtaaggggggccgcgagcttggggtctattgcaaggaacagcaggaggcagccctgactcgcatggcgaaggacactataacgtacatgggactctca

SEQ ID NO: 584193 - DNA, 847 bp, Homo sapiens
ggaaaaagagaactaatcctcgactttatttgtattcttatgtttggtctagtgtctctataagttcttttttcttcgaatcataagcgaagtcatgcgtacggtataggcgcctcccagactggtagatcgggctccatacacgcacatctctgagctggaacactacaagattagccctcgggtgtgcctttcgatggggcgctagtaggcccctagtagtagcatctcacttatccatacatgtggagacccctctgctgagcggaacaccgcgagcggagtcgcgcacggagtgcctatcgaagacccacgatgacgagaagaccagggcccgcgcgtccgcatacgcgcgacagcggtcggtgcgcacaggagatgcggtaaccaccagaggcatggtggccaacagcggatagaacggcctaggagctcgacagtaaagtggcgtgccaacccttgtcactctacacctagagccacaaatacctcacagcgtgccctgtatatatacccagtgcgtcgagcgagacccaacacctcatccccgccgcatccgtaaatacaaatcgcgaatggggcccccgaagggcaggcacacctcgaggatacaataaacgtggagaccccccgataggagcaacaaactagaagcgaacgggaccgaatgggccaccgagaatggccccacaagagcacccgcacgcaaggtggtcgtggaactggagccgcccagagggcgcaagacaacactaccccaggggaaggctcccgaaggtgcatccgaatgaacacaaccacaggtggcctccacaggggcaacccaccaggggaaacacacgaaaac

SEQ ID NO: 584194 - DNA, 187 bp, Homo sapiens
  misc_feature (126)..(126): n is a, c, g, or t
tgctgctgctgagtcgatctaaggatccccgcgctagcggcattaatgacgggtgtaggccagtggcgatacctccagctcgacccaagcctgggaacctacatatgccatgggtgcagcactaanaagacgaaaaaaaaaaaagaagaaggaaagaaagaaaagaaaaagaaaaattattaactac

SEQ ID NO: 584195 - DNA, 1558 bp, Homo sapiens
  misc_feature (182)..(182): n is a, c, g, or t
  misc_feature (305)..(305): n is a, c, g, or t
  misc_feature (1146)..(1146): n is a, c, g, or t
gctcttctagtgcctctgagtcaccatatgagacgtcgccgcctccctggactcgccatctgtcccacaggtcatctcgtggggcctcattatagtttcaagcatgacatgggcgagctcgccaggagtccgtggcagatgcgtagggaccgcagtagcgccgtgtggataggcccctcagngagctggatcacggaccagccaagacgcacccttcattctcacgcacctcacacagcctcctatgacctgagggacctacgcgggaaccctcgcaggcaggcctggagcattgatagcttagncatcactggacctctagagcaacgtaggtcccgtcgctgctacgatcatactatcgctgcttgccataccacgtggcagaacgtgtgcactggctagtattacgaaacgcagagttgattcccctggggctctatgggggcgtgcgactccacctgtgagagaaatgcctaggctaagtgcgtcaaggcggaaagcaggggagccgcatggcgcagagctgatttgctagtcggggcgtactttgcctctgtgctctatccgcgttaccatcttaggtggagcgaaatcgatccgattgggtttccaccgtcccccgtagcgcaagccgttggtggattgcgacgcacgctctcgtgcgagtcccttagggggcccgttcctagccccattgtgcgccgtcgcattgatctcttggttgccacctcggttcgggctatgcacgtggccttgcgattggtgggggatgggcccgaagacgcgccccaaggatttccttcggcgcccatacacgaatccttgagggagggaggggcggccgcgcattggcacggttatgggggccccgacaaggcctgggcccgcgggcgtgaacagcgaggtgccggggtgtcggttgagccggccattgggctttggattgtgaaccccagggttgccctggtggcgcccccctgttcacccccgggtcatattagtgggtttggtgcactcgggaggggggggagacgtcgtcctatcctggcccgtggtgtggggcttttcgcccgatttccatggggcgccattccccaaggggctcaaacaagttggcgttggggatagagtccctcgaatttcgcnccctgtgggggttttccctgggcccttggtcccccacagggcgcgtatggcgtccggggaagtggcgcgtgggcagcgaggccgccggggaggggaggggccccaagggaggcgcggaagcgggggccaatctcagaacatggcgctcccgaagcaggcggggtaccacagggggggagaaagcggacaaaacaacgtgtgtgacccccggacaaccgagggctcctatcaccgcgaattcacacccactggctataagcacatggggaaaacacactgtcaaacacaagaggcacgtaatgacacgggggaaccattcgaacacaccacggggggaagaggaacaggcgcatagggcacaaagtaggggaacaaccctccacacagtagcattgacaaggcgaagttcagc

SEQ ID NO: 584196 - DNA, 214 bp, Homo sapiens
  misc_feature (45)..(45): n is a, c, g, or t
  misc_feature (213)..(213): n is a, c, g, or t
tcttttgagaccttgggaagggcagccccagaggaggctggctcntagtcacagtctagtcggcagtgacatgaacagcagccctcgtggaccagggtctgccccctgaccaggactcactgtgactcttctcttcctcacataattcctaacctggaaattaaaacaaaacaaaacaaaaccccaagctagctggctgtggaggaagtgaang

SEQ ID NO: 584197 - DNA, 787 bp, Homo sapiens
aagcactggttattacaatgggatctggtgtctcgattctaccctgctagaagcctcaaaatacttcgagtctcccttcaccattcgacgacggtctgtacggctcaccatttgtgtatccagaagcttcctaccggacgtccaacgtctgtatttggcgtcaactttttcacgtcacctgatcttgcgttgcgattccggtcatcttaagatttcacattcactagtccatacacatcaatttttgtgagcatctgattgccaggccgactgtatacgtgggcgatgttcgtcagatcgttggtctttagacttataactcctggtatgtctccaatcatattagatgatgcggtcgttgcttctatttacagaacacgcagatagatagttggctctgagaacggcagtgaagcccaacatatactatacccgctgtagagctggggcggaggaagaaccgcgagggctactggaggcagtctcctgaaagatgcagcgagccaggccgttggcggcagcgcttctgctggccaaggaacaactccaacgaaagcgacacgacattgaacgggagtgacgtagagggagtaagcaacgcgcctatgtaccggccactgaaaaagactgccactggggccctgggaaggacaatatcgcgcttgaaagcacaagggaccctgttagggaatctttcagtggccgctgtggttgtcgtggccccgacaccgggaagggccaaccatcatcctggtgaagctttcctgagagaactcacctcccctag

SEQ ID NO: 584198 - DNA, 1501 bp, Homo sapiens
aaaaacactataatgccattactattattacaaattgtttagaaaatagttatgtttgcaaggagggatagggaacgtatataatcctgtctctccagtagtagctatttttacctttgtgaaattcctcatagtctttgcctcaattgtacaaatttttatatgatgtatctagaattttttctgcctttaacctcctaatgtatcctgaacacctttctgttttgctgccagtcatcataattatcattttaaatgatgcatcaccgtcagttgaatggatggactggagtttaattgactgccccttccttatgtgagctgtgcgaggcagccatggcgcctgcaaaggaggcagaatgcacatgaggacagggagaggagagggggcaaagaggctcccatggccagctgcacctcacagtcgttctttccattctacctgctctgtgggggcatccctgcagctggcttccagtctgcaccctcttggtggatgggtatgaaggacaggtgccctcttactacactctcatcctgtgccaggcgctgtgcgtagtgtattctctcaagcaatcctgccagtcagagcttctcctcactttacacacacaggcactggaggaggtgaggacaagaaggaacatcttcacccagagccttgagggccacggggcagtagggcctcagctcattctatctggcccagtctctgtgtccacttgacttaaccatgtggccatgttaattccatcttgaaggcagggagaggtcatgggcagccccactcccccttatggcactctgatgtccccagtcacggctctgggtctctctccacagccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattggaaaaaaaaaa

SEQ ID NO: 584199 - DNA, 388 bp, Homo sapiens
ggttgagtcatcacattcctgctgatcaagtagcctgatcagtcctacctgttttgtgttccttgtttttatccttaaaaattgtgagtttgttattgctgtgccgtatttgtatgtaaaatactttttgctgtcatttctaccatgtaataaaaattctgttttcttctgttcctagatgattcctcttgattcttttgttggccagagtgctgatggcaaaatggttcctataatccctggtggaaatagtatcccactcacattttccaacaggaaggaatatgtggagagggccattgaatatcgacttcatgagatggacagacaggtggctgaaacatctcgggagttacacatgaatgcttgggtttcctcaatactgcga

SEQ ID NO: 584200 - DNA, 2160 bp, Homo sapiens
  misc_feature (254)..(254): n is a, c, g, or t
tgaacacacacttgctttggcatcaaatggaggtgtgtatgcctgggggagcaattcagaagggcagctcggcttaggccataccaaccatgttcgagaaccaaccctggtaacaggtcatgcaagggaaaaatgttcggcagatctcggctggccgctgccacagtgctgcatggacagcaccacctgtcccaccaagagcaccaggtgtgtcagtacctctgcagctgggcctgcctgacacagtgcccccncagtatggggcgctgagagaagtcagcattcacacggtgcgggccaggctccggctgctctaccacttctctgacctcatgtactcatcctggagactgctgaaccttagccccaacaaccagaacagcacatcccattataatgctggaacttggggcattgtacagggacaacttcggcctttgttagccccaagagtctacactctgccaatggtgcgctccataggaaaaaccatggttcaaggcaaaaactatggacctcagataactgtaaagaggatatcaaccagaggacggaagtgtaagcctatttttgtccaaatagcgagacaagtagttaagctgaatgcttcagacctccgcctgccttcccgagcgtggaaggttaagctggttggagaaggggctgatgatgctggaggagtgtttgatgacaccatcacagagatgtgccaggaacttgaaactggtattgttgaccttcttataccctctcccaatgccaccgcagaagtgggttacaatagggacaggttcctttttaacccttctgcctgcctcgatgaacacttaatgcagtttaagtttttaggaattttaatgggggttgccattcgcacaaagaagcctctggacctccacttggcccctctggtgtggaagcagctgtgctgtgtcccactcaccctagaggacctggaggaggtggatctgctctacgtgcagactctcaacagcattcttcacattgaagacagtgggattaccgaggagagtttccatgagatgattcctcttgattcttttgttggccagagtgctgatggcaaaatggttcctataatccctggtggaaatagtatcccactcacattttccaacaggaaggaatatgtggagagggccattgaatatcgacttcatgagatggacagacaggtggctgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgataggccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattggaaaaaaaaaa

SEQ ID NO: 584201 - DNA, 600 bp, Homo sapiens
cctgaaaggtaccattttgaccctccaggatcgattttctcactccaattttatcatccaaacattgattttgctggaaggatttgtctggatggtctcaaattgccccccaaaggtgcttggagacctccctcaacatcgcaactgtgttgacctctattcagctggtcatgtcagaacccaaccctgatgacccggtcatgggtgacatatcctcagaatttaaatataataagccagccttcctcaagaatgccagacagtgggcaaaaaagcatgcaagacaaaaacaaaagggtgatgaggaaaaaatgcttgataatttaccaaagggtggtgactccaaaggacccaactccacccaaaaaaggaaggccagtcagctagtaggcataaaaaaaaaatttcatccttatgtttaggggacctgtcccgggtcattttaggtaaagtgttttttgccaaggggatttaaggtgccccccctgaatttttttttaaaaaaatttgaagacaaaaattttggggaggttatttattttggacaaaaggattttgaaatttttttaacctgaaaaaaaaaaagtcctttaatgttga

SEQ ID NO: 584202 - DNA, 1672 bp, Homo sapiens
agcaggtagcttacgatccgttacatagttcttctcaaaaatcagttcagaatatcagtccatgtgctgtgtgaaacaataactacggtccacatgtggctttagagaactcaacgtgtgattcagggaagccgccgcaactgaatttttcagttttatttaattactttagccttatgtggctaatggatgccatattgaacagtacaggtatagactaacgctcatagcggtggttgctcaacttcatttctaatagaaataaggaaaatgctgttgaaatattccctttaattttacaggttcctttttaacccttctgcctgcctcgatgaacacttaatgcagtttaagtttttaggaattttaatgggggttgccattcgcacaaagaagcctctggacctccacttggcccctctggtgtggaagcagctgtgctgtgtcccactcaccctagaggacctggaggaggtggatctgctctacgtgcagactctcaacagcattcttcacattgaagacagtgggattaccgaggagagtttccatgagatgattcctcttgattcttttgttggccagagtgctgatggcaaaatggttcctataatccctggtggaaatagtatcccactcacattttccaacaggaaggaatatgtggagagggccattgaatatcgacttcatgagatggacagacaggtggctgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgataggccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattggaaaaaaaaaa

SEQ ID NO: 584203 - DNA, 272 bp, Homo sapiens
cctgaggatcccaatgtgtggtgttatgtcaaagatagacaatatcaccccatagtgaaggacttctttgacatcataatgcgtaagaccgcatctttttttacatactgtaatccttgttattacaccatttttgtaaataaaaattcaggttaattaatgaacaaaacgcaagttattctttccacattaggttttgcatatacatgaatttacacactttgcgccagctggttgaatatgtgtcgtactccacataacaccacacaatt

SEQ ID NO: 584204 - DNA, 1027 bp, Homo sapiens
  misc_feature (1)..(1): n is a, c, g, or t
ngtaggttgtctcatcgaacgcattcaaatattttattaccaacgcccacaattgtttaggttggcatcgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgataggccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattggaaaaaaaaaa

SEQ ID NO: 584205 - DNA, 757 bp, Homo sapiens
ggctcccgaggtgccgggattgcagatggagtctcgttcactcagtgctcaatggtgcccaggctggagtgcagatggcgtgatctcagctcactacaacctacacctcccagccgcctgccttggcctcccaaagagccgagattgcagcctctgcccggcgccaccccgtctgggaagtgaggagcgtctctgcctggccgcccatcgtctgggatatgaggagcccctctgcctggctgcccagtctggaaagtgaggagcgtctctgcccggccgccatcccatctaggaagcgaggagcacctcttccccgccgccatcccatctaggaagtgaggagcgtctctgcccggccgcccatcgtctgagatgtggggagcacctctgccccaccgccctgtctgggatgtgaggagcgcctctgctgggccgcaaccctgtctgggaggatgtctccggagaggctgactaaactataaacagtatcatagaacagtccacgaaggaaggcagacttcatccactgactcttgtctgccattgactgaagttggtctcacaggacaccaacgtcctcgtccccttgatctgggcggtctctgcaggcagggcaccaggagaacggatcccaagccagtggttggcagctcccttgtcccaactggaggcctgaaattccaggccttgttgaaggtgacgcaggaggggcaaatgtggggtccgagaaggtcatgggagccgcaggagtgtccac

SEQ ID NO: 584206 - DNA, 1013 bp, Homo sapiens
  misc_feature (37)..(37): n is a, c, g, or t
tttcccattccccgttcctcatcctctatcgccccanacacttattctggtggctgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgataggccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattggaaaaaaaaaa

SEQ ID NO: 584207 - DNA, 237 bp, Homo sapiens
tagatttgttcgcagggggacagagtttcactgtctcgccaggctggagtgtaatggtgcgatttcaggtcactgcaccctccgcttcctgggttcacccgttgtcagcctccagagtagctgggactacaggcacacagcaccatgcctggctaattttagtatttcgagtagagagagtgtttcaacatgttggccaggctgatcttgaacttctgacctcaggtgattagccca

SEQ ID NO: 584208 - DNA, 297 bp, Homo sapiens
gagagttttctaattacgtttacaaaatatcttccctttggcccatacaagtggtgactgccatgtcgaactcgcggcccaggtcccgccgagacgccgggggtggcgctggggcagccggccgggacgagctggtgtcgcggtccttgcagagcgcagagcactgtctgggcgtccaggacttcggcactgcctatgcccactacctcctcgtgctcagcctggcgccggagctgaaacacgacgtgaaggtgagcgtccttttttctcacttgctggcagatccaacgtcctcgt

SEQ ID NO: 584209 - DNA, 1148 bp, Homo sapiens
ctgctgcccttggagagggagagagagagagggggggcaaagaggctcccatggccagctgcacctcacagtcgttctttccattctacctgctctgtgggggcatccctgcagctggcttccagtctgcaccctcttggtggatgggtatgaaggacaggtgccctcttactacactctcatcctgtgccaggcgctgtgcgtagtgtattctctcaagcaatcctgccagtcagagcttctcctcactttacacacacaggcactggaggaggtgaggacaagaaggaacatcttcacccagagccttgagggccacggggcagtagggcctcagctcattctatctggcccagtctctgtgtccacttgacttaaccatgtggccatgttaattccatcttgaaggcagggagaggtcatgggcagccccactcccccttatggcactctgatgtccccagtcacggctctgggtctctctccacagccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattggaaaaaaaaaa

SEQ ID NO: 584210 - DNA, 495 bp, Homo sapiens
atagatgtcgctagtctcagagggcagctgcgtatttaattaaactctggtttatgacctgacaaaaagccaaaaatatcactctttccaggagtggggaaaactgaggatgcctcccaagtctagtggcttcacaaaagatcatcctgtcttctctgtcatgcccactgagctcctattcccctacgtgttacaatacacaatttaaaacgccattgtgggagtgaagggttgacatttaaggaaaaggttgaggggtttctcttatgggctgtctaaaaggagagacacgtatctttcttaccttttttttttggcttagcccaccatgacttgtgacccaaaaccccccagatttaacagaagccctcacatttactctggaagcttacttccaaggagactacagacccttacttagtaggccaaactcaacacaatccagtaatgggtctttaatctaacccgcaattcctagctagcatggaactgggc

SEQ ID NO: 584211 - DNA, 402 bp, Homo sapiens
cccttccctgccaaaccaccagggtcctgccccaggggcagggtgcctctagcgcactacttagaaccctgcccaaagggtggtgctggtgttgcgggaaccctggcattttttccgggacggccgggttcttctgggctcaagggcccttagggaacggcccctaggccttatggggtaccagctcctgccgctaccctttgaggaactggagtcccaaaaaggcctgccccagctcaaaagcttccttaggcaaaagctccaggccctgggcctgcgctgggggccttaagggggcttaggggattatgtggggttcaggatggcccccccctgggggggggatgatttgccctttggttccctgggttttgatttttcattaaagttcctttccttcca

SEQ ID NO: 584212 - DNA, 997 bp, Homo sapiens
gtaccatcccggggcttggggacccctgaattagacagtttggaagtacaaataaaaatgatagtaaagggctgggcgtggtggctcacacctgtaatcccagcattccgggaggcaaaggcgggcagatcacctgaggtcaggagtttaagaccagcctgtctaacatggtgtaaccccatctctactaaaaatacagaaattagccaggcatggtggcaggtgcctgtagtcccagctactcgggaggctgaggcagttgaatcacttgaacccaggaggcggagattgcagatgaaccgagatcgcaccgctgcactccagcctggagtggcagagcaagaatccatctcaacaaaaaaaaaagatagtaaaggattaataaccatatgaaaataacctaatccaggcatccagagagagaactataaaatataaaggaaactggtgaccgagatggcatcaggacctaaaatcccagacactgaggagaggcggaaaacgcggcgaatcactatgacggcacaggacagccagagaccacacacgactcacccatggccgacacccccgactcaactaacaaatactacaaaataagtggacaatgaggcacaacgctacaaaatccgcgaaaacacacgaagacatgagccgaaagaactcagcagcaacccgggaaggtatcacgctatcggtgacgcccacgaacacagccatgggagtcaccaactgtggcgaaacgagccagacatctggctacaaaaaaaaaaaaaaactacaaacttacagtagaaaagcacacgagagagaaaccccaaaatagcacgagcacggacccgactaccgagagcgcagacaaggggaacagaagcatccagccaaagaatacaacgcgcaacgacacacagacatcgtcagagcagcaaagaacactagcaaccaggcgaaagcaaacaacacacaccacacaacaggaccggcagcacatcaacga

SEQ ID NO: 584213 - DNA, 290 bp, Homo sapiens
ttggaccataaatcatcaaattggataatgactaactgtagtcttttcttttttttatttttattcagctgcgggatacaattttcatggtcaaaatggaactgaagttcactccaaattattgtgatcttaaacttttcattccttggaaccaaccaaaacaacttgtggttaacttcgaaatccccgggtttcaaatcatttatagatttggaaggggatttggcatatctacctttctttgtagcaaatggtcccttattattagctcagttgcactataaagcttc

SEQ ID NO: 584214 - DNA, 773 bp, Homo sapiens
  misc_feature (526)..(526): n is a, c, g, or t
atccactcccttaccatcaaatgaatgggccaacaatggtactgagcctacgagtacaccgacgtacgggggtactagactcgttcaaactcctgacataggcttccccgccacttattcctagtaacccagagcgatcctgtcggagtcctttgacgattgacaaggcgaagtagtagtcgcgcatctgacagtcgcccaattcgttgtacatcaatttacagtcacatagactgtcattgcgacgtgcgactggagtctgttctcccgacagttgagtgcattcaaaaatcgagatagcgaattacccaggcactttgcttaatacccgaacagcacgaacttatcatcgcgctaacactgacgcggggtgtaatacctgactgtgctcaagaatgcttctgacaatcatgatgtgagtagaaacacacatgttttcactcgtccctattacgctgcctaagtacacttaattctcgctcgctaatacaactcttttttgagagagtaaagggcccccgtactntcatccacgtattaggacacctcgccgtcttaacacccgcttgctacgatgcgctcacttgataggaggcgtaagcgttacgcaagtcaaagccaggttacacaaagaaagattcatgaaggagcatagagaaccaactctggtgctgcgcggcgtccccctctagcgagacttgacaaaagtaaaaaggttttattttaatcattccactttccacgcgtatgaggggacgcgcacgcaggggccc

SEQ ID NO: 584215 - DNA, 146 bp, Homo sapiens
gttacagtcccctaggagatgggaggagggagataggtatagtaggcgctaagacgagtatgagggttcctactccacgtggcaggctgctgatactgggctaggagcaacaggacactgactctaggtttatgacctgtccatac

SEQ ID NO: 584216 - DNA, 152 bp, Homo sapiens
tccaggctctctgccctgtgctcccaattggtgcgatccgttactgcccgtgctcacggacatggatacagaccctgctgtgctccacaccctgcaggcgcctcgggaagcgccaaaggattcccttcacgttggtgctactgctgcatagc

SEQ ID NO: 584217 - DNA, 187 bp, Homo sapiens
cccttttttgggggggaaaggggggccccctttttttttttcgcccggtttttttttagccccccccccccggggggggggggggggccccttggtttttttttttcccgccccccccggaaaaaccccctttgggggggttttttttttttttttttttaaaaaaaaaaaaaaaacccccccccca

SEQ ID NO: 584218 - DNA, 861 bp, Homo sapiens
  misc_feature (26)..(26): n is a, c, g, or t
  misc_feature (138)..(140): n is a, c, g, or t
  misc_feature (206)..(206): n is a, c, g, or t
  misc_feature (232)..(232): n is a, c, g, or t
  misc_feature (243)..(243): n is a, c, g, or t
  misc_feature (246)..(246): n is a, c, g, or t
  misc_feature (260)..(260): n is a, c, g, or t
  misc_feature (287)..(287): n is a, c, g, or t
  misc_feature (292)..(293): n is a, c, g, or t
  misc_feature (314)..(314): n is a, c, g, or t
  misc_feature (328)..(328): n is a, c, g, or t
  misc_feature (331)..(331): n is a, c, g, or t
  misc_feature (339)..(339): n is a, c, g, or t
  misc_feature (353)..(353): n is a, c, g, or t
  misc_feature (363)..(363): n is a, c, g, or t
  misc_feature (386)..(386): n is a, c, g, or t
  misc_feature (392)..(393): n is a, c, g, or t
  misc_feature (409)..(409): n is a, c, g, or t
  misc_feature (454)..(454): n is a, c, g, or t
  misc_feature (459)..(459): n is a, c, g, or t
  misc_feature (700)..(700): n is a, c, g, or t
  misc_feature (859)..(859): n is a, c, g, or t
gctttattttagtgaattataaaggnaaacaaaaaggaaactgttgagaagtgttcttcattaacctgtctaacgacagcccgaagatcctgaaacacatggaaactgcgacatgctaccagcagaggctggggaatnnnggttctgctctcactgaatggtggggaaccttcaactgcttagcctgtgctttccttttctgattnaacatttacaaaggaaaaaacaatgnttagcactgantantttaaacacacttnagaaaatagatgttaacagtgttagtnggggnnccaggcccctgactagcaacngtggcggggcttcngtncccaaggnggctggggtttggncagctcagtnctgctatgggctgtggctcagcngatggnnaggtgctctccatgcntggtttacaacaacaggtcttaatagttagggacaggcggccatnccggntggggtgggggcgaggactgttcatcctgacaagggtcaccacccacacggtcagagcagaacccccagggactctctgggcctctacgtgccttccaggcaccgactgttcagctgcttggtaccccgggaataaaaactaactgagcagagcagctgatgcctcggcagggcccctcattaggggaggacggtgctggtggggcctgggggcccacgctcccagtgaagacaacctgtnaggaagaactcattctggaacctcccggagtttgctgagaaggaaattaatcacttcgtaacttgatgcagcttaaggcttcatttctaagctgtaacatggcctttaactaagatatcacaatattcaattccaattagagttttagcctgcagagtnta

SEQ ID NO: 584219 - DNA, 131 bp, Homo sapiens
cccggggggggggaaaaaaaaaaaattttttttgaggtttggtgtccccccccccccgtttttttttccgggggttttttttggggcccctttttgggccccccgggaaatttttttttttttgggggcca

SEQ ID NO: 584220 - DNA, 387 bp, Homo sapiens
gtcgagattttaatagcatcttcagcgagatgggggcctggaccttgccttcccactctcctgaacttccaggtcctgagtcagaaacacctggtgtgagattgcgagaggggcagacacttcgtgactcaatgcttagtacccagatagtcaccaaccaggatctttgagggggtcttggagagtcatgcaaaacctgaatcctccaaaccagctccagattgggggtccagggaccttttcataggttggatgatacatggcctgtgagtcccattctagagccagagaggacaaggatcttgactccaggtttccaggaggtctggtcactctcacccagctaatctattcaaagactctgtaccagtcataagcagtgggcat

SEQ ID NO: 584221 - DNA, 1493 bp, Homo sapiens
gtttcagataggaagcactcctcactcttctagtaagggagcgatcacctgaagaatgttgcagctcgccttggcacagacaggaagaaacgagagaactcgttaaaattgatgctctcatagccaagcagcttacgaagaatgctcgtgagcgcgaaagctgcaatgatgtcacgtctcgtcgaaggctagtatgctaggcatcaggaatgctgactggttccagggtctgtgcatactgctagcacttctcgagactagtattgagaatgcctgttcatgggacgaattgcatcgaggatttgcagagcgagacagaacatctcggtcgaggtggctgcaacatgtggagaggttcgcattggagaccggaaactcggcagacatgggactaggtacgaatgagccgactgacgcgagtgcgcccgtttcgtctaatgtctcaaacgtaacgagctgtcgcagaagcgcactgacacataggtgtgtgactgtgccatcagtgtccaccacgacaatgaagaaccggttgtcccggtggggtcccggtggcgctctgttcattaactctggcatggccactatgtgtgtcacaatgtcactcaaagaaaagcgattgggaacttatgggaatgccagctctatagagcagatagatctggctgggtcctaagttgacaatgtgttcccaccacggtcaagggccatcatggtacactgtaagcggcagtaacacgggggttcggctaagttacgtgcgcatgtgtatttgtatgttgaaacgtccttggttcactgagttccccatgatggcatctcgttcgcaattaggacacatggtgtatatgaggggaaaggaacggcctcggtgaattaagggacagtttacgaatggcctacgaatgagggcgtcgcatttcactccttggggcaccctgcgtacacacacgagggccaggttgtggacccggcgtattcgccatgtagaaagcggtgcacaggcggaggagagctacatgcggtcatcttgacggatagacagatgggagtttgacacttcgtctgaagaaacacgtcacgcacatcgaacctgtgtaacatacaaattgacaaagtagatgggagcacgagtcatttgggacgtcaaaggcaatgaaaccaaagaagacaaagccccggtgtagagaaagcgaagacaacggaccaacccgacaatagaaggccacagacaagaggtccaacgggtcaagcaccacgagggcaaggaaacacgaacagacgcgaggggaaaaggaaataagccgggggacagtaagggaacgggcatgcacaaggatggaccaacaagggcgcataaagaaacgaggacaccggaacagcgctgagcgacgcccaggggccatgaacaagaggacacaacagcgacaaaagagaaaaccacgggtgcaagagcagacacccattgtgagaaaaatccaacaaggaggagagca

SEQ ID NO: 584222 - DNA, 870 bp, Homo sapiens
tctctctctctcctctcttttgacttggtggggtgcgtgcgatcacccaccccacgaagaggtgtgtttttctctctcgtggggtggagggtgtgtctgggttgtgttttctcttctctcttcttcttctctctctcgtctcgtggggtggtgtgcgcagcgcgtggtggttgggtctctcccacccccccctcgctgcgacggtgtggctgcgccccaccagagagtgtgcgcactatactattagtgtgttgtgtggtggcttctcatccacacacccacctcgtctgtgtgtgttgtgctgtggttctgtgcatgcaccccaccaccacccgctttttttgtgtggtggaggggtgtgtgtggtgtgtgtggcgtcgcgcgcgcccacacacacacgctcgtgtgttggcgaggctggctcccttccatgtgtgtgtgttggtgctccctctgtgtgtgttgtgtgtgttggtgtgtgtgggtgtgtacgatctgctctctctcttctgtgtggtgtgtggtgctcactcacacacactacactactttgtggttgtgtgtgtgtgtgcgcccccctgtcgtgtgtgtgtgacgtgtgtgtcgtccctctcgcgtcgtgactgtggtgggtgtgttgtgtgcgtcccccccctgcctgtatgggtgggtgagatatacgctcacgccgcaggtggttctcactcccttgtttgggttgtgtttgatgaacactccttttggccggcgccccacatccattggtgtttggtgtcgccgccttccccaatggttgtggattgaatgacactcacactcttctttgtgtggggggtggtggtttgatttccgccccttgatttggttggc

SEQ ID NO: 584223 - DNA, 251 bp, Homo sapiens
acgaacagcagcatcttgagcacttgatgctaacgtcagaatctgccctggaacagcgccgattttgggcattggcttgcacaccacgaacatccttgtcacttgccactgaccattccccactccaacttggctgtaaaaaaacctgggcttagagccctggttcttttcatccccatcgcggttcatcagcttgcgaagtgccgcgttccaatcatcgtgctgttcgcacgggcctgctgccaacaata

SEQ ID NO: 584224 - DNA, 4951 bp, Homo sapiens
  misc_feature (17)..(17): n is a, c, g, or t
  misc_feature (2578)..(2578): n is a, c, g, or t
  misc_feature (2804)..(2804): n is a, c, g, or t
tttcggcaatagaaaanaaaggccacaaaaacatcatttgaatcagccttcagtagcaccgggaaaaactacttctttcccaaagaaagaggtgagacagatcgatcgggaaaaatcagaggcttttgaaagaactgtcaagacaggcggaaaagccaggagaaaaaagtacaattcctagatcggctgatcatcccccaaagttatatcacagtgctctcaacagacagaaggaacaacaaaggattgagagagaaaacttggctttattgaaaaggcttgaggccgtgaaaccaacagttggtatgaaacgttcagaacaactgatggactatcatcgcaatatgggctatctcaactcatcaccattgtcaagacgggccagatccactcttggccaatatagcccattaagagcttccaggacatccagtgctacgagtggtctcagttgtaggagtgagcgatcagcggttgacccctccagtggccaccctcgaagaagacctaaaccccctaatgtccgtacagcttggttataaaacacttttttactttaaacattgttcacacaacttttcttgaagtgctcgtgcatattcctataattctctgtgtaaacatctagaataccgttttagcaattgaaggtgtacaacagtgagttgtaatgtattgttattcagtgcaaaattattgtcaaaaaacgatttaatgtaaaaagtgtttcctgaggatgtatttatatgagatgtatgtgttcttaatagagaaatagtggtatgcatgtgtatcttctaattattcagttgtcatgctgtcaaaatagtagtgatagtatcattgcatgtcgtacccaagatggtcactatatagttttcaatttgtgttattttcatttctttataagtgttataccatgagctcagctcctaaatttggctggctttgtttttcatttgctttagaacttatgtggcatgacatagctcgattgtatgagatttaacacttattatgaaacaaatcttgaaatttgttttcactggtagagctgatctagatttgatgagcagattgagagacgcttctattggagcaattcttgtaattcaccagaggtatctagttgttgtataagtgcactgagttagatcttaaaagtttgatcaatcattccaaaccatttcaaatatgaatattagaaagttcaacttagaagcttcccttttgtgttttcatgcattcaggtaaagtcctatttatgactcttagaaatgaggtaggttttagagctagtcttctaactcgtgaatagtttaaggaccacatcagttgcaaaccaagtatttgttgaatcagtaaaatggcactatcagcatgaagagccgagaagcagatcctgaggtgtgtcggacagtgttttaggtaattcagtatttattatgttattagagaagacttagcgtaagaaagaaatgctttagaaattccagcaagtatttataaggcctgaaaaaactaaaatttgaacaaaaagggaaataaatcacacatttgttgaggctgctgctttaagtattagctaattttcttgttttggtttacttgatttatttgattgaaccctggaagtattatttttaccagtcccacatttaaagacctagtaatcttgatggaatggtaatggcagatagggtttaatgttgttgacttttcaaattagaattttttttctatgaaacttaggcttttatataacaaagtatgttatctcattgttaccgccgtttttcactactagccttttcagtatgcccttaaaatgtattggaaaggttccatgttaaatgacaaatatctttttcagtatgaatttttgatctgtagccacaataagattttcatttttcagtgctcaggctctgtagcatgtatgctgaatgcttttttccttagcacctttaacagtaaggtgttactgcattttacaaaacatcaattcaacatgtcttggatttagtttgtattcatagattttgttaaggatcaggcctgtgaacatgggcacagtgaggttaaataattcacgtggccacaacctggctttgaggttctgcttttgggggccataattttcattcaatgttattcgatgctctgttctggtgaacaagttactatacctgctgtgtatataagcttgagctatactaaaccaaggctttattttcttttgttttttaacttactgtacttttactgtttatataacctatatttcaagagagagaagataatgctgaattttaaatttagcatttgaacatctgtccaatagtgaattaatcagtttttttaaaattgatttttaagttgttccagaaaaaaatatatatatatgttttatatatatagtctttttatatatataaaaatcttttttataaattttattttaaaaatcttttaagaaagatttttatatatatataaagactatatatttatatatagtcttttctgttcataatggcattagtctctgagtacattttatattatctttgttgcnacatgtcaggatacaacacaatagttttataaataacaactgtactttgattttaggtactaatttaatgctttagtttttactactttgaagggaggttcatctaagtattactgataacagggatccaacttaaagtaaaagttggaaagggcaagagtcttttaagcggaacttcaattctgttgtcatggttacttatatataatgaatataaatagacaantaggacttggaaaatgtggtatattctaagtcaagatgctatgaagttgttatagtttaagggacattcttaagaaggaattacttaagtacattactcttctcatttcaaggacatgaaaaagtaaaggatggtctggcactattttattttatttttttttgacttgtactgaatatatgtactttgaagatttacatctataactagaaagtatgctaatccgaggtctggttattaggccagattcttgttcagttattttttaaactaatgttgcctcctttttagtaagattctacgaaagttttttaactattaaagttatttcttaaggggtagctcttatacttcctctgctctctttttcagtttccataaaaagctgttttcttagctattactccaaataaagttctttggtttgcttaaaaatgtagtgtaatgcagttgttttctctccgctaacctgagtgtccacagtagatatcgagacagctttaggaaggtgacggtcatgggtaagtgacggctgtgcctgtcatcttcagattcttcaaatactgcaaactatgaaacatgttaagaccaatataaacccaaagatgtgagttgattatactttaataattacattcataaaaagtttactatcttcaatgccaaaaaagtcttaacctataaatgattatatacaatcttagaaaatgtgcttaacagttatggcttctttatttctatgaggaaagattagtaagaaacttaaaattaacatccttttaagattttctgttccattttaatgtattttaggcatttagaactagcctggcataatgaagaaagaaataaaagaattaaagataactgagttttgatcctatgtttatctctaaaatgggctgtcttgttccaattttcaaaattagaataatttttacgtgccttacaagaccaagaattagtaggaataaagttggaaggatgatgtcagttatttctgtctttgaaagtatttacatggaaaagagtttgcttaaaattatattcttaatcagaatttctttaaactacatcatctaattgcttctgtaaaattattatggtactacaatacagtggacactcttacagcttaaagaaatgggcttcttgttgttgttgttgttgtttgtatttttgagatggagtctggctctgtcccccaggctggagtgcagtggcacgatcttggctcactgcaacctccgcttcccaggttcaagcgattctcctgcctcagcctcctgagtagctgggattacaggcacacgccatcatgcccggctaattttttgtatttctagtagcgatggggtttcgccatgttggccaggctggtctcgaactcccgacctcaagtgatccgcccgcctcggcctcccaaagtgttgggattacaggtgtgagccaccgcgcccggccaggaaatattttttaaaaggagtcatgtatgtcatgtacattgatgtacatgaaatgtacgtcaacatttcatatgtattctatataataaacacactaaagcttgctgcaaaacatcagtttaggaattttttatgagggtttaataaaactagcgccattggaataaattcccgagtagcccctgcagtagcgtatctgagctctcaacagcaaagagcaagaatgctagagcaaataggattgtgttatggcagaaaattttatttgatttttcagttctggtgatggatttttaattcatttacagatatctctggagccaccataatagactcttaagattctgtgcttccatttcaaaatttagttggtaaatccagatggagtcttgttctgtctccaggccggagtgcagtggtgcgatctcagctcactgcaacctccgcctcccaggttcaagcgattctcctgcctcagcctcctgagttgctgcgactgcaggcgcccgccaccatgcccagctaatttttgtatttttagtagagatggggtttcaccatgttggccaggatggtctcgatctcctgaccttgtgatccacccgcctcagcctcccaaagtgctgggattacaggtgtgagccatcgcacccggcctgattaacatttttcttccatgtc

SEQ ID NO: 584225 - DNA, 4892 bp, Homo sapiens
  misc_feature (17)..(17): n is a, c, g, or t
  misc_feature (2519)..(2519): n is a, c, g, or t
  misc_feature (2745)..(2745): n is a, c, g, or t
tttcggcaatagaaaanaaaggccacaaaaacatcatttgaatcagccttcagtagcaccgggaaaaactacttctttcccaaagaaagaggtgagacagatcgatcgggaaaaatcagaggcttttgaaagaactgtcaagacaggcggaaaagccaggagaaaaaagtacaattcctagatcggctgatcatcccccaaagttatatcacagtgctctcaacagacagaaggaacaacaaaggattgagagagaaaacttggctttattgaaaaggcttgaggccgtgaaaccaacagttggtatgaaacgttcagaacaactgatggactatcatcgcaatatgggctatctcaactcatcaccattgtcaagacgggccagatccactcttggccaatatagcccattaagagcttccaggacatccagtgctacgagtggtctcagttgtaggagtgagcgatcagcggttgacccctccagtggccaccctcgaagaagacctaaaccccctaatgtccgtacagcttggttataaaacacttttttactttaaacattgttcacacaacttttcttgaagtgctcgtgcatattcctataattctctgtgtaaacatctagaataccgttttagcaattgaaggtgtacaacagtgagttgtaatgtattgttattcagtgcaaaattattgtcaaaaaacgatttaatgtaaaaagtgtttcctgaggatgtatttatatgagatgtatgtgttcttaatagagaaatagtggtatgcatgtgtatcttctaattattcagttgtcatgctttcaatttgtgttattttcatttctttataagtgttataccatgagctcagctcctaaatttggctggctttgtttttcatttgctttagaacttatgtggcatgacatagctcgattgtatgagatttaacacttattatgaaacaaatcttgaaatttgttttcactggtagagctgatctagatttgatgagcagattgagagacgcttctattggagcaattcttgtaattcaccagaggtatctagttgttgtataagtgcactgagttagatcttaaaagtttgatcaatcattccaaaccatttcaaatatgaatattagaaagttcaacttagaagcttcccttttgtgttttcatgcattcaggtaaagtcctatttatgactcttagaaatgaggtaggttttagagctagtcttctaactcgtgaatagtttaaggaccacatcagttgcaaaccaagtatttgttgaatcagtaaaatggcactatcagcatgaagagccgagaagcagatcctgaggtgtgtcggacagtgttttaggtaattcagtatttattatgttattagagaagacttagcgtaagaaagaaatgctttagaaattccagcaagtatttataaggcctgaaaaaactaaaatttgaacaaaaagggaaataaatcacacatttgttgaggctgctgctttaagtattagctaattttcttgttttggtttacttgatttatttgattgaaccctggaagtattatttttaccagtcccacatttaaagacctagtaatcttgatggaatggtaatggcagatagggtttaatgttgttgacttttcaaattagaattttttttctatgaaacttaggcttttatataacaaagtatgttatctcattgttaccgccgtttttcactactagccttttcagtatgcccttaaaatgtattggaaaggttccatgttaaatgacaaatatctttttcagtatgaatttttgatctgtagccacaataagattttcatttttcagtgctcaggctctgtagcatgtatgctgaatgcttttttccttagcacctttaacagtaaggtgttactgcattttacaaaacatcaattcaacatgtcttggatttagtttgtattcatagattttgttaaggatcaggcctgtgaacatgggcacagtgaggttaaataattcacgtggccacaacctggctttgaggttctgcttttgggggccataattttcattcaatgttattcgatgctctgttctggtgaacaagttactatacctgctgtgtatataagcttgagctatactaaaccaaggctttattttcttttgttttttaacttactgtacttttactgtttatataacctatatttcaagagagagaagataatgctgaattttaaatttagcatttgaacatctgtccaatagtgaattaatcagtttttttaaaattgatttttaagttgttccagaaaaaaatatatatatatgttttatatatatagtctttttatatatataaaaatcttttttataaattttattttaaaaatcttttaagaaagatttttatatatatataaagactatatatttatatatagtcttttctgttcataatggcattagtctctgagtacattttatattatctttgttgcnacatgtcaggatacaacacaatagttttataaataacaactgtactttgattttaggtactaatttaatgctttagtttttactactttgaagggaggttcatctaagtattactgataacagggatccaacttaaagtaaaagttggaaagggcaagagtcttttaagcggaacttcaattctgttgtcatggttacttatatataatgaatataaatagacaantaggacttggaaaatgtggtatattctaagtcaagatgctatgaagttgttatagtttaagggacattcttaagaaggaattacttaagtacattactcttctcatttcaaggacatgaaaaagtaaaggatggtctggcactattttattttatttttttttgacttgtactgaatatatgtactttgaagatttacatctataactagaaagtatgctaatccgaggtctggttattaggccagattcttgttcagttattttttaaactaatgttgcctcctttttagtaagattctacgaaagttttttaactattaaagttatttcttaaggggtagctcttatacttcctctgctctctttttcagtttccataaaaagctgttttcttagctattactccaaataaagttctttggtttgcttaaaaatgtagtgtaatgcagttgttttctctccgctaacctgagtgtccacagtagatatcgagacagctttaggaaggtgacggtcatgggtaagtgacggctgtgcctgtcatcttcagattcttcaaatactgcaaactatgaaacatgttaagaccaatataaacccaaagatgtgagttgattatactttaataattacattcataaaaagtttactatcttcaatgccaaaaaagtcttaacctataaatgattatatacaatcttagaaaatgtgcttaacagttatggcttctttatttctatgaggaaagattagtaagaaacttaaaattaacatccttttaagattttctgttccattttaatgtattttaggcatttagaactagcctggcataatgaagaaagaaataaaagaattaaagataactgagttttgatcctatgtttatctctaaaatgggctgtcttgttccaattttcaaaattagaataatttttacgtgccttacaagaccaagaattagtaggaataaagttggaaggatgatgtcagttatttctgtctttgaaagtatttacatggaaaagagtttgcttaaaattatattcttaatcagaatttctttaaactacatcatctaattgcttctgtaaaattattatggtactacaatacagtggacactcttacagcttaaagaaatgggcttcttgttgttgttgttgttgtttgtatttttgagatggagtctggctctgtcccccaggctggagtgcagtggcacgatcttggctcactgcaacctccgcttcccaggttcaagcgattctcctgcctcagcctcctgagtagctgggattacaggcacacgccatcatgcccggctaattttttgtatttctagtagcgatggggtttcgccatgttggccaggctggtctcgaactcccgacctcaagtgatccgcccgcctcggcctcccaaagtgttgggattacaggtgtgagccaccgcgcccggccaggaaatattttttaaaaggagtcatgtatgtcatgtacattgatgtacatgaaatgtacgtcaacatttcatatgtattctatataataaacacactaaagcttgctgcaaaacatcagtttaggaattttttatgagggtttaataaaactagcgccattggaataaattcccgagtagcccctgcagtagcgtatctgagctctcaacagcaaagagcaagaatgctagagcaaataggattgtgttatggcagaaaattttatttgatttttcagttctggtgatggatttttaattcatttacagatatctctggagccaccataatagactcttaagattctgtgcttccatttcaaaatttagttggtaaatccagatggagtcttgttctgtctccaggccggagtgcagtggtgcgatctcagctcactgcaacctccgcctcccaggttcaagcgattctcctgcctcagcctcctgagttgctgcgactgcaggcgcccgccaccatgcccagctaatttttgtatttttagtagagatggggtttcaccatgttggccaggatggtctcgatctcctgaccttgtgatccacccgcctcagcctcccaaagtgctgggattacaggtgtgagccatcgcacccggcctgattaacatttttcttccatgtc

SEQ ID NO: 584226 - DNA, 176 bp, Homo sapiens
gtgaccacccacagcaaatcgagaaaaactccgcgagctgatcgtatctgtgtccccaagatctatgtgacggatctcctgatacaactgttgaccagccactgaaaatctgccagagacaaggtggtgggaaaggattacctgtttgtgtgactactaacagacgatggggactc

SEQ ID NO: 584227 - DNA, 257 bp, Homo sapiens
cttttggggtctttgctcaaatttacaaacaaacaaaaaaacaaaaaaaaaaggggaggatggaaggccacccttggccttagtgaaaagggagagggaaaggaattaagggggggccacaggtcccaggtggaattaaactgcaaaacccggggggaaacctgaaagaaccctgagcgggcacagggtaaccgggggggggaggggccaaacgggaaaatgagaggggttcccccagcctgagcttatcagttgtc

SEQ ID NO: 584228 - DNA, 4897 bp, Homo sapiens
  misc_feature (17)..(17): n is a, c, g, or t
  misc_feature (2524)..(2524): n is a, c, g, or t
  misc_feature (2750)..(2750): n is a, c, g, or t
tttcggcaatagaaaanaaaggccacaaaaacatcatttgaatcagccttcagtagcaccgggaaaaactacttctttcccaaagaaagaggtgagacagatcgatcgggaaaaatcagaggcttttgaaagaactgtcaagacaggcggaaaagccaggagaaaaaagtacaattcctagatcggctgatcatcccccaaagttatatcacagtgctctcaacagacagaaggaacaacaaaggattgagagagaaaacttggctttattgaaaaggcttgaggccgtgaaaccaacagttggtatgaaacgttcagaacaactgatggactatcatcgcaatatgggctatctcaactcatcaccattgtcaagacgggccagatccactcttggccaatatagcccattaagagcttccaggacatccagtgctacgagtggtctcagttgtaggagtgagcgatcagcggttgacccctccagtggccaccctcgaagaagacctaaaccccctaatgtccgtacagcttggttataaaacacttttttactttaaacattgttcacacaacttttcttgaagtgctcgtgcatattcctataattctctgtgtaaacatctagaataccgttttagcaattgaaggtgtacaacagtgagttgtaatgtattgttattcagtgcaaaattattgtcaaaaaacgatttaatgtaaaaagtgtttcctgaggatgtatttatatgagatgtatgtgttcttaatagagaaatagtggtatgcatgtgtatcttctaattattcagttgtcatgctgtcaaaatagtagtgatagtatcattgcatgtcgtacccaagatggtcactatatagttttcaatttgtgttattttcatttctttataagtgttataccatgagctcagctcctaaatttggctggctttgtttttcatttgctttagaacttatgtggcatgacatagctcgattgtatgagatttaacacttattatgaaacaaatcttgaaatttgttttcactggtagagctgatctagatttgatgagcagattgagagacgcttctattggagcaattcttgtaattcaccagaggtatctagttgttgtataagtgcactgagttagatcttaaaagtttgatcaatcattccaaaccatttcaaatatgaatattagaaagttcaacttagaagcttcccttttgtgttttcatgcattcaggtaaagtcctatttatgactcttagaaatgaggtaggttttagagctagtcttctaactcgtgaatagtttaaggaccacatcagttgcaaaccaagtatttgttgaatcagtaaaatggcactatcagcatgaagagccgagaagcagatcctgaggtgtgtcggacagtgttttaggtaattcagtatttattatgttattagagaagacttagcgtaagaaagaaatgctttagaaattccagcaagtatttataaggcctgaaaaaactaaaatttgaacaaaaagggaaataaatcacacatttgttgaggctgctgctttaagtattagctaattttcttgttttggtttacttgatttatttgattgaaccctggaagtattatttttaccagtcccacatttaaagacctagtaatcttgatggaatggtaatggcagatagggtttaatgttgttgacttttcaaattagaattttttttctatgaaacttaggcttttatataacaaagtatgttatctcattgttaccgccgtttttcactactagccttttcagtatgcccttaaaatgtattggaaaggttccatgttaaatgacaaatatctttttcagtatgaatttttgatctgtagccacaataagattttcatttttcagtgctcaggctctgtagcatgtatgctgaatgcttttttccttagcacctttaacagtaaggtgttactgcattttacggatcaggcctgtgaacatgggcacagtgaggttaaataattcacgtggccacaacctggctttgaggttctgcttttgggggccataattttcattcaatgttattcgatgctctgttctggtgaacaagttactatacctgctgtgtatataagcttgagctatactaaaccaaggctttattttcttttgttttttaacttactgtacttttactgtttatataacctatatttcaagagagagaagataatgctgaattttaaatttagcatttgaacatctgtccaatagtgaattaatcagtttttttaaaattgatttttaagttgttccagaaaaaaatatatatatatgttttatatatatagtctttttatatatataaaaatcttttttataaattttattttaaaaatcttttaagaaagatttttatatatatataaagactatatatttatatatagtcttttctgttcataatggcattagtctctgagtacattttatattatctttgttgcnacatgtcaggatacaacacaatagttttataaataacaactgtactttgattttaggtactaatttaatgctttagtttttactactttgaagggaggttcatctaagtattactgataacagggatccaacttaaagtaaaagttggaaagggcaagagtcttttaagcggaacttcaattctgttgtcatggttacttatatataatgaatataaatagacaantaggacttggaaaatgtggtatattctaagtcaagatgctatgaagttgttatagtttaagggacattcttaagaaggaattacttaagtacattactcttctcatttcaaggacatgaaaaagtaaaggatggtctggcactattttattttatttttttttgacttgtactgaatatatgtactttgaagatttacatctataactagaaagtatgctaatccgaggtctggttattaggccagattcttgttcagttattttttaaactaatgttgcctcctttttagtaagattctacgaaagttttttaactattaaagttatttcttaaggggtagctcttatacttcctctgctctctttttcagtttccataaaaagctgttttcttagctattactccaaataaagttctttggtttgcttaaaaatgtagtgtaatgcagttgttttctctccgctaacctgagtgtccacagtagatatcgagacagctttaggaaggtgacggtcatgggtaagtgacggctgtgcctgtcatcttcagattcttcaaatactgcaaactatgaaacatgttaagaccaatataaacccaaagatgtgagttgattatactttaataattacattcataaaaagtttactatcttcaatgccaaaaaagtcttaacctataaatgattatatacaatcttagaaaatgtgcttaacagttatggcttctttatttctatgaggaaagattagtaagaaacttaaaattaacatccttttaagattttctgttccattttaatgtattttaggcatttagaactagcctggcataatgaagaaagaaataaaagaattaaagataactgagttttgatcctatgtttatctctaaaatgggctgtcttgttccaattttcaaaattagaataatttttacgtgccttacaagaccaagaattagtaggaataaagttggaaggatgatgtcagttatttctgtctttgaaagtatttacatggaaaagagtttgcttaaaattatattcttaatcagaatttctttaaactacatcatctaattgcttctgtaaaattattatggtactacaatacagtggacactcttacagcttaaagaaatgggcttcttgttgttgttgttgttgtttgtatttttgagatggagtctggctctgtcccccaggctggagtgcagtggcacgatcttggctcactgcaacctccgcttcccaggttcaagcgattctcctgcctcagcctcctgagtagctgggattacaggcacacgccatcatgcccggctaattttttgtatttctagtagcgatggggtttcgccatgttggccaggctggtctcgaactcccgacctcaagtgatccgcccgcctcggcctcccaaagtgttgggattacaggtgtgagccaccgcgcccggccaggaaatattttttaaaaggagtcatgtatgtcatgtacattgatgtacatgaaatgtacgtcaacatttcatatgtattctatataataaacacactaaagcttgctgcaaaacatcagtttaggaattttttatgagggtttaataaaactagcgccattggaataaattcccgagtagcccctgcagtagcgtatctgagctctcaacagcaaagagcaagaatgctagagcaaataggattgtgttatggcagaaaattttatttgatttttcagttctggtgatggatttttaattcatttacagatatctctggagccaccataatagactcttaagattctgtgcttccatttcaaaatttagttggtaaatccagatggagtcttgttctgtctccaggccggagtgcagtggtgcgatctcagctcactgcaacctccgcctcccaggttcaagcgattctcctgcctcagcctcctgagttgctgcgactgcaggcgcccgccaccatgcccagctaatttttgtatttttagtagagatggggtttcaccatgttggccaggatggtctcgatctcctgaccttgtgatccacccgcctcagcctcccaaagtgctgggattacaggtgtgagccatcgcacccggcctgattaacatttttcttccatgtc

SEQ ID NO: 584229 - DNA, 133 bp, Homo sapiens
gggaggtcaagactgcagtaagccatgattgcaccactgtgctccagcctgggcaacagagtgagaccctgtctcacaaaaaaaagaaaaagaggcacgtgggacacagacacatgcagagggcaggccacgt

SEQ ID NO: 584230 - DNA, 4200 bp, Homo sapiens
  misc_feature (1827)..(1827): n is a, c, g, or t
  misc_feature (2053)..(2053): n is a, c, g, or t
ctctacgaggatcccgaaagcttatagtggtatgcatgtgtatcttctaattattcagttgtcatgctgtcaaaatagtagtgatagtatcattgcatgtcgtacccaagatggtcactatatagttttcaatttgtgttattttcatttctttataagtgttataccatgagctcagctcctaaatttggctggctttgtttttcatttgctttagaacttatgtggcatgacatagctcgattgtatgagatttaacacttattatgaaacaaatcttgaaatttgttttcactggtagagctgatctagatttgatgagcagattgagagacgcttctattggagcaattcttgtaattcaccagaggtatctagttgttgtataagtgcactgagttagatcttaaaagtttgatcaatcattccaaaccatttcaaatatgaatattagaaagttcaacttagaagcttcccttttgtgttttcatgcattcaggtaaagtcctatttatgactcttagaaatgaggtaggttttagagctagtcttctaactcgtgaatagtttaaggaccacatcagttgcaaaccaagtatttgttgaatcagtaaaatggcactatcagcatgaagagccgagaagcagatcctgaggtgtgtcggacagtgttttaggtaattcagtatttattatgttattagagaagacttagcgtaagaaagaaatgctttagaaattccagcaagtatttataaggcctgaaaaaactaaaatttgaacaaaaagggaaataaatcacacatttgttgaggctgctgctttaagtattagctaattttcttgttttggtttacttgatttatttgattgaaccctggaagtattatttttaccagtcccacatttaaagacctagtaatcttgatggaatggtaatggcagatagggtttaatgttgttgacttttcaaattagaattttttttctatgaaacttaggcttttatataacaaagtatgttatctcattgttaccgccgtttttcactactagccttttcagtatgcccttaaaatgtattggaaaggttccatgttaaatgacaaatatctttttcagtatgaatttttgatctgtagccacaataagattttcatttttcagtgctcaggctctgtagcatgtatgctgaatgcttttttccttagcacctttaacagtaaggtgttactgcattttacaaaacatcaattcaacatgtcttggatttagtttgtattcatagattttgttaaggatcaggcctgtgaacatgggcacagtgaggttaaataattcacgtggccacaacctggctttgaggttctgcttttgggggccataattttcattcaatgttattcgatgctctgttctggtgaacaagttactatacctgctgtgtatataagcttgagctatactaaaccaaggctttattttcttttgttttttaacttactgtacttttactgtttatataacctatatttcaagagagagaagataatgctgaattttaaatttagcatttgaacatctgtccaatagtgaattaatcagtttttttaaaattgatttttaagttgttccagaaaaaaatatatatatatgttttatatatatagtctttttatatatataaaaatcttttttataaattttattttaaaaatcttttaagaaagatttttatatatatataaagactatatatttatatatagtcttttctgttcataatggcattagtctctgagtacattttatattatctttgttgcnacatgtcaggatacaacacaatagttttataaataacaactgtactttgattttaggtactaatttaatgctttagtttttactactttgaagggaggttcatctaagtattactgataacagggatccaacttaaagtaaaagttggaaagggcaagagtcttttaagcggaacttcaattctgttgtcatggttacttatatataatgaatataaatagacaantaggacttggaaaatgtggtatattctaagtcaagatgctatgaagttgttatagtttaagggacattcttaagaaggaattacttaagtacattactcttctcatttcaaggacatgaaaaagtaaaggatggtctggcactattttattttatttttttttgacttgtactgaatatatgtactttgaagatttacatctataactagaaagtatgctaatccgaggtctggttattaggccagattcttgttcagttattttttaaactaatgttgcctcctttttagtaagattctacgaaagttttttaactattaaagttatttcttaaggggtagctcttatacttcctctgctctctttttcagtttccataaaaagctgttttcttagctattactccaaataaagttctttggtttgcttaaaaatgtagtgtaatgcagttgttttctctccgctaacctgagtgtccacagtagatatcgagacagctttaggaaggtgacggtcatgggtaagtgacggctgtgcctgtcatcttcagattcttcaaatactgcaaactatgaaacatgttaagaccaatataaacccaaagatgtgagttgattatactttaataattacattcataaaaagtttactatcttcaatgccaaaaaagtcttaacctataaatgattatatacaatcttagaaaatgtgcttaacagttatggcttctttatttctatgaggaaagattagtaagaaacttaaaattaacatccttttaagattttctgttccattttaatgtattttaggcatttagaactagcctggcataatgaagaaagaaataaaagaattaaagataactgagttttgatcctatgtttatctctaaaatgggctgtcttgttccaattttcaaaattagaataatttttacgtgccttacaagaccaagaattagtaggaataaagttggaaggatgatgtcagttatttctgtctttgaaagtatttacatggaaaagagtttgcttaaaattatattcttaatcagaatttctttaaactacatcatctaattgcttctgtaaaattattatggtactacaatacagtggacactcttacagcttaaagaaatgggcttcttgttgttgttgttgttgtttgtatttttgagatggagtctggctctgtcccccaggctggagtgcagtggcacgatcttggctcactgcaacctccgcttcccaggttcaagcgattctcctgcctcagcctcctgagtagctgggattacaggcacacgccatcatgcccggctaattttttgtatttctagtagcgatggggtttcgccatgttggccaggctggtctcgaactcccgacctcaagtgatccgcccgcctcggcctcccaaagtgttgggattacaggtgtgagccaccgcgcccggccaggaaatattttttaaaaggagtcatgtatgtcatgtacattgatgtacatgaaatgtacgtcaacatttcatatgtattctatataataaacacactaaagcttgctgcaaaacatcagtttaggaattttttatgagggtttaataaaactagcgccattggaataaattcccgagtagcccctgcagtagcgtatctgagctctcaacagcaaagagcaagaatgctagagcaaataggattgtgttatggcagaaaattttatttgatttttcagttctggtgatggatttttaattcatttacagatatctctggagccaccataatagactcttaagattctgtgcttccatttcaaaatttagttggtaaatccagatggagtcttgttctgtctccaggccggagtgcagtggtgcgatctcagctcactgcaacctccgcctcccaggttcaagcgattctcctgcctcagcctcctgagttgctgcgactgcaggcgcccgccaccatgcccagctaatttttgtatttttagtagagatggggtttcaccatgttggccaggatggtctcgatctcctgaccttgtgatccacccgcctcagcctcccaaagtgctgggattacaggtgtgagccatcgcacccggcctgattaacatttttcttccatgtc

SEQ ID NO: 584231 - DNA, 3670 bp, Homo sapiens
  misc_feature (17)..(17): n is a, c, g, or t
  misc_feature (2578)..(2578): n is a, c, g, or t
  misc_feature (2804)..(2804): n is a, c, g, or t
tttcggcaatagaaaanaaaggccacaaaaacatcatttgaatcagccttcagtagcaccgggaaaaactacttctttcccaaagaaagaggtgagacagatcgatcgggaaaaatcagaggcttttgaaagaactgtcaagacaggcggaaaagccaggagaaaaaagtacaattcctagatcggctgatcatcccccaaagttatatcacagtgctctcaacagacagaaggaacaacaaaggattgagagagaaaacttggctttattgaaaaggcttgaggccgtgaaaccaacagttggtatgaaacgttcagaacaactgatggactatcatcgcaatatgggctatctcaactcatcaccattgtcaagacgggccagatccactcttggccaatatagcccattaagagcttccaggacatccagtgctacgagtggtctcagttgtaggagtgagcgatcagcggttgacccctccagtggccaccctcgaagaagacctaaaccccctaatgtccgtacagcttggttataaaacacttttttactttaaacattgttcacacaacttttcttgaagtgctcgtgcatattcctataattctctgtgtaaacatctagaataccgttttagcaattgaaggtgtacaacagtgagttgtaatgtattgttattcagtgcaaaattattgtcaaaaaacgatttaatgtaaaaagtgtttcctgaggatgtatttatatgagatgtatgtgttcttaatagagaaatagtggtatgcatgtgtatcttctaattattcagttgtcatgctgtcaaaatagtagtgatagtatcattgcatgtcgtacccaagatggtcactatatagttttcaatttgtgttattttcatttctttataagtgttataccatgagctcagctcctaaatttggctggctttgtttttcatttgctttagaacttatgtggcatgacatagctcgattgtatgagatttaacacttattatgaaacaaatcttgaaatttgttttcactggtagagctgatctagatttgatgagcagattgagagacgcttctattggagcaattcttgtaattcaccagaggtatctagttgttgtataagtgcactgagttagatcttaaaagtttgatcaatcattccaaaccatttcaaatatgaatattagaaagttcaacttagaagcttcccttttgtgttttcatgcattcaggtaaagtcctatttatgactcttagaaatgaggtaggttttagagctagtcttctaactcgtgaatagtttaaggaccacatcagttgcaaaccaagtatttgttgaatcagtaaaatggcactatcagcatgaagagccgagaagcagatcctgaggtgtgtcggacagtgttttaggtaattcagtatttattatgttattagagaagacttagcgtaagaaagaaatgctttagaaattccagcaagtatttataaggcctgaaaaaactaaaatttgaacaaaaagggaaataaatcacacatttgttgaggctgctgctttaagtattagctaattttcttgttttggtttacttgatttatttgattgaaccctggaagtattatttttaccagtcccacatttaaagacctagtaatcttgatggaatggtaatggcagatagggtttaatgttgttgacttttcaaattagaattttttttctatgaaacttaggcttttatataacaaagtatgttatctcattgttaccgccgtttttcactactagccttttcagtatgcccttaaaatgtattggaaaggttccatgttaaatgacaaatatctttttcagtatgaatttttgatctgtagccacaataagattttcatttttcagtgctcaggctctgtagcatgtatgctgaatgcttttttccttagcacctttaacagtaaggtgttactgcattttacaaaacatcaattcaacatgtcttggatttagtttgtattcatagattttgttaaggatcaggcctgtgaacatgggcacagtgaggttaaataattcacgtggccacaacctggctttgaggttctgcttttgggggccataattttcattcaatgttattcgatgctctgttctggtgaacaagttactatacctgctgtgtatataagcttgagctatactaaaccaaggctttattttcttttgttttttaacttactgtacttttactgtttatataacctatatttcaagagagagaagataatgctgaattttaaatttagcatttgaacatctgtccaatagtgaattaatcagtttttttaaaattgatttttaagttgttccagaaaaaaatatatatatatgttttatatatatagtctttttatatatataaaaatcttttttataaattttattttaaaaatcttttaagaaagatttttatatatatataaagactatatatttatatatagtcttttctgttcataatggcattagtctctgagtacattttatattatctttgttgcnacatgtcaggatacaacacaatagttttataaataacaactgtactttgattttaggtactaatttaatgctttagtttttactactttgaagggaggttcatctaagtattactgataacagggatccaacttaaagtaaaagttggaaagggcaagagtcttttaagcggaacttcaattctgttgtcatggttacttatatataatgaatataaatagacaantaggacttggaaaatgtggtatattctaagtcaagatgctatgaagttgttatagtttaagggacattcttaagaaggaattacttaagtacattactcttctcatttcaaggacatgaaaaagtaaaggatggtctggcactattttattttatttttttttgacttgtactgaatatatgtactttgaagatttacatctataactagaaagtatgctaatccgaggtctggttattaggccagattcttgttcagttattttttaaactaatgttgcctcctttttagtaagattctacgaaagttttttaactattaaagttatttcttaaggggtagctcttatacttcctctgctctctttttcagtttccataaaaagctgttttcttagctattactccaaataaagttctttggtttgcttaaaaatgtagtgtaatgcagttgttttctctccgctaacctgagtgtccacagtagatatcgagacagctttaggaaggtgacggtcatgggtaagtgacggctgtgcctgtcatcttcagattcttcaaatactgcaaactatgaaacatgttaagaccaatataaacccaaagatgtgagttgattatactttaataattacattcataaaaagtttactatcttcaatgccaaaaaagtcttaacctataaatgattatatacaatcttagaaaatgtgcttaacagttatggcttctttatttctatgaggaaagattagtaagaaacttaaaattaacatccttttaagattttctgttccattttaatgtattttaggcatttagaactagcctggcataatgaagaaagaaataaaagaattaaagata

SEQ ID NO: 584232 - DNA, 3616 bp, Homo sapiens
  misc_feature (17)..(17): n is a, c, g, or t
  misc_feature (2578)..(2578): n is a, c, g, or t
  misc_feature (2804)..(2804): n is a, c, g, or t
tttcggcaatagaaaanaaaggccacaaaaacatcatttgaatcagccttcagtagcaccgggaaaaactacttctttcccaaagaaagaggtgagacagatcgatcgggaaaaatcagaggcttttgaaagaactgtcaagacaggcggaaaagccaggagaaaaaagtacaattcctagatcggctgatcatcccccaaagttatatcacagtgctctcaacagacagaaggaacaacaaaggattgagagagaaaacttggctttattgaaaaggcttgaggccgtgaaaccaacagttggtatgaaacgttcagaacaactgatggactatcatcgcaatatgggctatctcaactcatcaccattgtcaagacgggccagatccactcttggccaatatagcccattaagagcttccaggacatccagtgctacgagtggtctcagttgtaggagtgagcgatcagcggttgacccctccagtggccaccctcgaagaagacctaaaccccctaatgtccgtacagcttggttataaaacacttttttactttaaacattgttcacacaacttttcttgaagtgctcgtgcatattcctataattctctgtgtaaacatctagaataccgttttagcaattgaaggtgtacaacagtgagttgtaatgtattgttattcagtgcaaaattattgtcaaaaaacgatttaatgtaaaaagtgtttcctgaggatgtatttatatgagatgtatgtgttcttaatagagaaatagtggtatgcatgtgtatcttctaattattcagttgtcatgctgtcaaaatagtagtgatagtatcattgcatgtcgtacccaagatggtcactatatagttttcaatttgtgttattttcatttctttataagtgttataccatgagctcagctcctaaatttggctggctttgtttttcatttgctttagaacttatgtggcatgacatagctcgattgtatgagatttaacacttattatgaaacaaatcttgaaatttgttttcactggtagagctgatctagatttgatgagcagattgagagacgcttctattggagcaattcttgtaattcaccagaggtatctagttgttgtataagtgcactgagttagatcttaaaagtttgatcaatcattccaaaccatttcaaatatgaatattagaaagttcaacttagaagcttcccttttgtgttttcatgcattcaggtaaagtcctatttatgactcttagaaatgaggtaggttttagagctagtcttctaactcgtgaatagtttaaggaccacatcagttgcaaaccaagtatttgttgaatcagtaaaatggcactatcagcatgaagagccgagaagcagatcctgaggtgtgtcggacagtgttttaggtaattcagtatttattatgttattagagaagacttagcgtaagaaagaaatgctttagaaattccagcaagtatttataaggcctgaaaaaactaaaatttgaacaaaaagggaaataaatcacacatttgttgaggctgctgctttaagtattagctaattttcttgttttggtttacttgatttatttgattgaaccctggaagtattatttttaccagtcccacatttaaagacctagtaatcttgatggaatggtaatggcagatagggtttaatgttgttgacttttcaaattagaattttttttctatgaaacttaggcttttatataacaaagtatgttatctcattgttaccgccgtttttcactactagccttttcagtatgcccttaaaatgtattggaaaggttccatgttaaatgacaaatatctttttcagtatgaatttttgatctgtagccacaataagattttcatttttcagtgctcaggctctgtagcatgtatgctgaatgcttttttccttagcacctttaacagtaaggtgttactgcattttacaaaacatcaattcaacatgtcttggatttagtttgtattcatagattttgttaaggatcaggcctgtgaacatgggcacagtgaggttaaataattcacgtggccacaacctggctttgaggttctgcttttgggggccataattttcattcaatgttattcgatgctctgttctggtgaacaagttactatacctgctgtgtatataagcttgagctatactaaaccaaggctttattttcttttgttttttaacttactgtacttttactgtttatataacctatatttcaagagagagaagataatgctgaattttaaatttagcatttgaacatctgtccaatagtgaattaatcagtttttttaaaattgatttttaagttgttccagaaaaaaatatatatatatgttttatatatatagtctttttatatatataaaaatcttttttataaattttattttaaaaatcttttaagaaagatttttatatatatataaagactatatatttatatatagtcttttctgttcataatggcattagtctctgagtacattttatattatctttgttgcnacatgtcaggatacaacacaatagttttataaataacaactgtactttgattttaggtactaatttaatgctttagtttttactactttgaagggaggttcatctaagtattactgataacagggatccaacttaaagtaaaagttggaaagggcaagagtcttttaagcggaacttcaattctgttgtcatggttacttatatataatgaatataaatagacaantaggacttggaaaatgtggtatattctaagtcaagatgctatgaagttgttatagtttaagggacattcttaagaaggaattacttaagtacattactcttctcatttcaaggacatgaaaaagtaaaggatggtctggcactattttattttatttttttttgacttgtactgaatatatgtactttgaagatttacatctataactagaaagtatgctaatccgaggtctggttattaggccagattcttgttcagttattttttaaactaatgttgcctcctttttagtaagattctacgaaagttttttaactattaaagttatttcttaaggggtagctcttatacttcctctgctctctttttcagtttccataaaaagctgttttcttagctattactccaaataaagttctttggtttgcttaaaaatgtagtgtaatgcagttgttttctctccgctaacctgagtgtccacagtagatatcgagacagctttaggaaggtgacggtcatgggtaagtgacggctgtgcctgtcatcttcagattcttcaaatactgcaaactatgaaacatgttaagaccaatataaacccaaagatgtgagttgattatactttaataattacattcataaaaagtttactatcttcaatgccaaaaaagtcttaacctataaatgattatatacaatcttagaaaatgtgcttaacagttatggcaagattttctgttccattttaatgtattttaggcatttagaactagcctggcataatgaagaaagaaataaaagaattaaagata

SEQ ID NO: 584233 - DNA, 159 bp, Homo sapiens
atcgctctacaattggtcttatgttattacaaaggcagcgaaaccggtttgggcaggacaggagacacacccttgtttatcttttctaatgtcccttgggaaatggattaaacagtgcagagcagttttactttatgctgtcgcattgagtacagatta

SEQ ID NO: 584234 - DNA, 284 bp, Homo sapiens
ctcacacctgtaatcccagccctttgggaggccaagatgggagtatctcaagcccaggagttcgagaccagctcaggcgacatgacaagaccctgtctctacaaaaacaaacaaacaaacaaacaaaaaacaaaaaaaaccaccacaacaaaaatgagctgggtatagtgttggacgcctgtagtcccagctacccaggaggcatgggaggattgattgcttgagcccaggaggggcgactgcactccagcctgggaaacagaatgagaccaactggaaaaaaa

SEQ ID NO: 584235 - DNA, 641 bp, Homo sapiens
gttctagaggagtccccggattggtgacatttcaagatctataacatcagaaataaacagataataacatgattgtcaatcacatgtgagaatgtgaccacccccaccagaatggctatgatcacaaagacaggcagtcaccagtactggccggcctttggcaattagagccctcatacagtgctggtgtctggaagtctaccggacacttcatagaccatctctttgttcctaaaaacactgtaaggtaggtacatttgtgatctcattttacagatgcagaaattggaggcccagcgggtgatgacctggccaaggtcacagagccagcaagatgtgctgggggggacagaacatgtaccaggctactcagtgagcaccagagcctatgctccctccctggtgtgcctcattcaacacccaaaaacatgtgagcaggagcaggagctggagccgcaggtctgtctgtgagcatcagcaagcagttcacccctctgcactccgaggtcctgctctaaaatgaggcaaggcagcagaggctacacctgtaatccagcactttgtgaggccaacaggaggatcacttgagccggagtgagacagccgggaaatggactaccattctaaaaaataaagtagga

SEQ ID NO: 584236 - DNA, 134 bp, Homo sapiens
tttctagaatgtgctgagcctgggggagataggaggctgatcagggagaaagctgaaagttggggatgagatccagagcttcttaattactgtgcccgtgacatgttacttgtgcgcccaataggctataggtg

SEQ ID NO: 584237 - DNA, 811 bp, Homo sapiens
  misc_feature (231)..(231): n is a, c, g, or t
ctgggttcgcgcgggcttcctcccgcccgcgttttagtgggggcgcgcctttcgtggcgctcccctcttggcaatggaaggtcgtctccttgccactcgcccggcggggttatattcgccgccctgtggtggatggtctcccccgcactgctcgcgggagatactactaacgccgcggatttttcatctcgcgcgcttacggaggggctttgtctcgagtgctcacacccngggtgcgcgcctccccctatagtgttgtgttagtgagtgagacaccccttccgcgcgtccgcccttatattatatcgggcgcgcccggcgttttattccgccgccggttattgtactcgcgggggtctctctctctggttgggtaccgcgtcccgttgacggaaggcccctcccgggtattccgttaggagctcttccccgcgtgcacccgccttgtgtctccgtcgccgggcagttctcttcggtcagtcgccgcccgcttgtcttcggtgacgccccacgcggcgtctcactccgcggggctactcactggcctattgttgtgggtcgccaccatgtgacgcctcctcaagttattcgttgtgtagccgcccccgcgatgtagtaatatttcgcacctgcaacaccgcccaacgatctcccacttggcggtttttatggaaggcctccgccgccggagaaacctggctcattgtgttgacataagagtggtggtgtgtgagctcaactgatacttgatgatggcaccagtacgactttggtaaggagagggtgcgtctaacaagaacattatacagaa

SEQ ID NO: 584238 - DNA, 916 bp, Homo sapiens
  misc_feature (35)..(35): n is a, c, g, or t
  misc_feature (81)..(81): n is a, c, g, or t
  misc_feature (92)..(92): n is a, c, g, or t
  misc_feature (95)..(95): n is a, c, g, or t
  misc_feature (127)..(127): n is a, c, g, or t
  misc_feature (140)..(140): n is a, c, g, or t
  misc_feature (146)..(146): n is a, c, g, or t
  misc_feature (183)..(183): n is a, c, g, or t
  misc_feature (190)..(190): n is a, c, g, or t
  misc_feature (194)..(194): n is a, c, g, or t
  misc_feature (199)..(199): n is a, c, g, or t
  misc_feature (203)..(203): n is a, c, g, or t
  misc_feature (207)..(207): n is a, c, g, or t
  misc_feature (218)..(218): n is a, c, g, or t
  misc_feature (226)..(226): n is a, c, g, or t
  misc_feature (232)..(232): n is a, c, g, or t
  misc_feature (244)..(244): n is a, c, g, or t
  misc_feature (259)..(259): n is a, c, g, or t
  misc_feature (275)..(277): n is a, c, g, or t
  misc_feature (280)..(280): n is a, c, g, or t
  misc_feature (311)..(311): n is a, c, g, or t
  misc_feature (349)..(349): n is a, c, g, or t
  misc_feature (357)..(357): n is a, c, g, or t
  misc_feature (363)..(363): n is a, c, g, or t
  misc_feature (384)..(384): n is a, c, g, or t
  misc_feature (396)..(396): n is a, c, g, or t
  misc_feature (498)..(498): n is a, c, g, or t
  misc_feature (502)..(502): n is a, c, g, or t
  misc_feature (837)..(837): n is a, c, g, or t
  misc_feature (840)..(840): n is a, c, g, or t
  misc_feature (908)..(908): n is a, c, g, or t
atagcaaagttgctcccttctgcgtcctgagaacncagaagtctaggtcctgtactttcactaaggctccttgtttttgcnaatcgcgtttntgncaaataaccataaggctacgtttctttggcgngtggttatgcgtntttccngggtccagccaggtcttccccctcgccccccagttcngcctttnaccntttgntccntccntttcttttgtnttgtttcngggggnctctcgggcggnggggttttctagttntgtttggggggggtannnggnttgggtgggggggaggggaggtttttttgtntggtggtctgttgggagggggtttgttttacatatacntgagacanctttantttttgccgcttttcttttanacctgggttatnactgacacccgatataaaccggtggctgcccctggggtgtgggtcgcactggctggccagctggcccgcctgcccaatgccagtggctcaccacagctgtgnttcntctggcacatgacagacaacactggcctgacagtggctgggtagggagcaaacagaggcagtggcatggcccactgtctcaagacactcagggccaaattaaagaacagaaaatgcaagagagatgagatgcgtgcttctgttgctgtgttaaaggtgacctctcccacaggttttctgtgcctgcctgcaactgaggccccagctttcaggtgctggagagtgtccgcacctctttgggggtgagggactaacgctttttatagctggtttgctatagagttctgaactcactttgccgtccttccttccacgcggtccttcttcgcaattttnttngtaaactggtagcagcatttcacaaaaagagttttgaggggagagcgcgagagaccgcgtgacccccncccccccc

SEQ ID NO: 584239 - DNA, 370 bp, Homo sapiens
  misc_feature (15)..(16): n is a, c, g, or t
  misc_feature (94)..(94): n is a, c, g, or t
  misc_feature (96)..(96): n is a, c, g, or t
  misc_feature (98)..(98): n is a, c, g, or t
  misc_feature (100)..(100): n is a, c, g, or t
  misc_feature (104)..(104): n is a, c, g, or t
  misc_feature (106)..(106): n is a, c, g, or t
  misc_feature (108)..(108): n is a, c, g, or t
  misc_feature (110)..(110): n is a, c, g, or t
  misc_feature (149)..(149): n is a, c, g, or t
  misc_feature (160)..(160): n is a, c, g, or t
  misc_feature (170)..(170): n is a, c, g, or t
  misc_feature (181)..(181): n is a, c, g, or t
  misc_feature (310)..(310): n is a, c, g, or t
  misc_feature (340)..(340): n is a, c, g, or t
gacaaagggaatttnntcctatttaaaaagacccaagtcacagaattcttaatttagaaatttcaaggtattaattaacatatgtatatatatntntntntgtntntntntgtgtgtgtgtgtgtgtgtgtgtgtgtataacaactttntgtatataggntctgccaggnaaactgcaggnattgagtatgtcagattttggtatacgtggagatcctacaaccaatccctacatacaccaagggatgactatagttacgtgtggataaactccccttaataaaatgtcttatgttactaaattttgagnattatgagatagctatttttatatattccntttgtcatctaaatactccaaaattatttt

SEQ ID NO: 584240 - DNA, 102 bp, Homo sapiens
tttttgctaactaaagtagtttaaacactggaaattgatgagattgctcatctgctgggtgatcctctataagtcgacctttcattgcagtcaatgcttgtg

SEQ ID NO: 584241 - DNA, 220 bp, Homo sapiens
atccaaagaattcggcacgaggtgacgcccatcaccgttgtgaagcaaggctttgagcctccctcctttgttggctggttccttggctgggatgatgattactggtctgtggaccctttggacaggccatggcttagctggctgcctgaggaggggcaggcccaccccatgtacccgttcagtgcctttggactgtccttccttaagaggccttatgagt

SEQ ID NO: 584242 - DNA, 188 bp, Homo sapiens
  misc_feature (45)..(45): n is a, c, g, or t
  misc_feature (78)..(78): n is a, c, g, or t
  misc_feature (110)..(110): n is a, c, g, or t
  misc_feature (185)..(185): n is a, c, g, or t
gaccagcagctgtggacattatgagaaagtgaaacctgagatccnctgttgattgagaaatgcaacacctcaaaatgngggacagctcctgattaccaggtagaagatgnaaacaactggggtgtccattcaggaggaaacaattgcaagctaagaactgttgagagtgaagctgcattttctgnacc

SEQ ID NO: 584243 - DNA, 155 bp, Homo sapiens
tccttctgccttctgtagtgtgatgatgcagcaagaagacccttaccagatgcaggcccctcaaccttcgacttcctaacatccagaactgttaagaaataaaatttattcctttccttttcttcctcctttcccttctcctcccttttcttccc

SEQ ID NO: 584244 - DNA, 105 bp, Homo sapiens
tatctagagatcctgtgctaggtgagtgatggacatctcggtcactgatcctcgctccgggtcaagtattctcatgctcagctctgagtagtggattacaggtct

SEQ ID NO: 584245 - DNA, 351 bp, Homo sapiens
gtggtcagcagcctgcaggactgacccctcacttgaccagtcccattcagatccggcttggacatgcacctgagatggtgccagagtgcggctgagtcttggcacgacagacataccctttgcgagttgcgcgctaaccagcccttctttgcaactggtctcaaactgctctgtttaattgaaaaagagagctatgcctttttttctttttggaagtaaagcagctaaaaacatgtttctctaggtgagtgttggacctcacaccctccccttccctgtacatttgtctttggtgctggacgtggccatgtgaggccaggttgaggccctttgtagacaacatacagttgc

SEQ ID NO: 584246 - DNA, 278 bp, Homo sapiens
tctgagtgcttcctctcctttgcccgccgctgcgcgctatggcatctcaggctgccccgctggcctgctgctttgccctttcttccgagcctggggcccctggggcgagatcgtctagcgctggctagctggcgccagtccctgcggcctgacatgtcctctgctgtgcggctggcagctgtgaggctgctacgcaaatcgggtggcgggccctgacactgagcccatgtggcctccttttatcagctctatgtgactccccatcaccaacagcactc

SEQ ID NO: 584247 - DNA, 934 bp, Homo sapiens
  misc_feature (309)..(309): n is a, c, g, or t
tttgcacaattttgaaattattcaactgctttttttgactacatgtttccatactcttagagtctaacctcttctcgcaccacccctctgtgctccttggcaacactggcaacaggcacattccggtagggtgccacaccatccagctcgacatgtgtccgaaactattccccccgactatctcagttggttcaaagccaaacaaatcgcatcttcctcaacgagtcgcttacagaaagattggtcccccgagcttaattccagctacttcccttcatagaagggggcctgttgggcaccaaccggaanaaacggtgctacacaagacagacgtgacatgccgatcgatgtgacaacaacaacatttcgcgtcttgcataaaagggtcacccccttctattctgcactggcgggaaacccacgaaatgtgtttaggaaccaagttcttcctagggccaccctccctccattgtgatacacacttcaagtggccccctcttccccaattttttcgccccattcaaatgcgtaatacttgactttcttcctctgtgcccccccttttgtacgccatctccctatccagctcagtccacttatcccatgttcccctccggctgtcacattcatctgctaatcaacgaaccacgggttgttaatattcaacaccagaagacacggttctctttaaatcgccccctttaaaacatcggcgcaacgagggttggatactccccgacccgtccgtaccttgtattcccttgtaataatcatagagcaagtattttccttatttcctcgatacaaagcctcttcttagtgaaagagatcgttcaggcaaacaatcaatcattctccttttgcaaagggcccctatctacaaattgaatcccaacaaacatatcttttttctttcaccgcccaacaaatacaa

SEQ ID NO: 584248 - DNA, 814 bp, Homo sapiens
  misc_feature (2)..(2): n is a, c, g, or t
  misc_feature (191)..(191): n is a, c, g, or t
  misc_feature (366)..(366): n is a, c, g, or t
  misc_feature (397)..(399): n is a, c, g, or t
  misc_feature (516)..(516): n is a, c, g, or t
  misc_feature (535)..(535): n is a, c, g, or t
  misc_feature (587)..(587): n is a, c, g, or t
  misc_feature (656)..(656): n is a, c, g, or t
  misc_feature (662)..(662): n is a, c, g, or t
  misc_feature (671)..(671): n is a, c, g, or t
  misc_feature (675)..(675): n is a, c, g, or t
  misc_feature (685)..(685): n is a, c, g, or t
  misc_feature (693)..(693): n is a, c, g, or t
  misc_feature (729)..(729): n is a, c, g, or t
  misc_feature (737)..(737): n is a, c, g, or t
  misc_feature (804)..(804): n is a, c, g, or t
antactgtttaagtagttcaaataggcttcctcactattaatttgcttcagtaaactcttcagcttaactcattatcttaaatttcagaattaatgaggttttactgtaaaagtagaaaagcaaacacttcaaatgataagactccagtatcacccatactaaaaacttagcaataaaactgcagtttganaagctactgtacaatgcagccagggctaggtgtccatcctgctgggggcgggccgggtaagggccggggaatctgcccggttttttccctgtggttcttagactccttcggcataccggcctgccatctccccatggcacccacctactgctttttggggggccctccggttccngctttttggggcgggggggggggtttttttnnntgtgggcgcggtggtgggctgttccccttcggttgggcgtccccctccccccttggcggccgggtgccgccccccttccggtttctggctggcctgggtgcgggcccccttgggccnctccccccccccccccccnctcccttccccctgggcttccgccttcccctttcccctggggctcttgccgnccgtcctccttccgggccctgtggctttcattacggtcaaatctcaacatgtctcccgcagagtttatnacatcngttattctnaacntgtacatttngctttggnatgatggagagacacagagatatatgtccgcgtccngcgtctcnctccactccgcgtctgggtccacacccttccaggctttgtctggcacattatgtggctggtgcctgnttccccagtg

SEQ ID NO: 584249 - DNA, 257 bp, Homo sapiens
ggtgcgacataaaccttgcttgagataatcaccagttttttgttcatcttcaactaatagtattctcatttccgaatcctaagtcattcattaaaactatgataacgttataaaacatctgatcgagatagattacaaaaatgtcattttcaagtcacttagatgttcagtgcttcactttattgtagtagcaagaaattaacttttagagaaacttatgaaaactgtagtgcgtcgtattacaattgtcgacgcgg

SEQ ID NO: 584250 - DNA, 1285 bp, Homo sapiens
  misc_feature (1036)..(1036): n is a, c, g, or t
  misc_feature (1116)..(1116): n is a, c, g, or t
  misc_feature (1119)..(1119): n is a, c, g, or t
  misc_feature (1125)..(1125): n is a, c, g, or t
  misc_feature (1140)..(1140): n is a, c, g, or t
ggaaagagaataaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaacaatgacatagaagaacaagtctctgaccttgccagtagaggncaggaacccagtaagagtacaaaccacaaggcaatgattctctcatcgatgactctaaactagccagtgcagatgatatnggnacttgnatctgtaagaaccanaaaaaccgtctcatacaggcaggcaagtgaacaccatcggtccttctatcaagagtgcttacacattcatcaatgcctaaaaagctccatgactacagatgccccactcttgaacagagcaaaggctagcatgacatgcatgtga

SEQ ID NO: 584251 - DNA, 1513 bp, Homo sapiens
  misc_feature (1264)..(1264): n is a, c, g, or t
  misc_feature (1344)..(1344): n is a, c, g, or t
  misc_feature (1347)..(1347): n is a, c, g, or t
  misc_feature (1353)..(1353): n is a, c, g, or t
  misc_feature (1368)..(1368): n is a, c, g, or t
gataaagtacatcttcctggcaaatttacaaagcattggtttatcttagaatattggaggcttacaaggccaatttgttgaaattgttataaaactgtaaaattgtgttacattttacatgctaaaaaggagtattagttcattaatctttgattcccagtgaaaactaaattgattagtaaattttttttgtccccacttggaaaaacctggggatgattagtaaatttcatttgcctgactttgaaacttgtttggtaaaaatgcataaaaccacatgtggtttataagcattgttattcttattgtttaatcaaaatgttttcatttacaccaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaacaatgacatagaagaacaagtctctgaccttgccagtagaggncaggaacccagtaagagtacaaaccacaaggcaatgattctctcatcgatgactctaaactagccagtgcagatgatatnggnacttgnatctgtaagaaccanaaaaaccgtctcatacaggcaggcaagtgaacaccatcggtccttctatcaagagtgcttacacattcatcaatgcctaaaaagctccatgactacagatgccccactcttgaacagagcaaaggctagcatgacatgcatgtga

SEQ ID NO: 584252 - DNA, 1328 bp, Homo sapiens
aaaaaaaaaaaaaaaaaaaaaaaaaaaaaaaaaaaaaaaaaaaaaaaaaaaaaaaaaaaggggggggccctttaaattttcccccgggggggccccatttttcccttcccccttttttttttaaaagggggccccctagatgagaggccgctatttattataagcactacgagaacgacggggcgacgctggtataaaacaacagcttgtggacgaggggggaaacaaactccggtctacctggggactacttctgcggtggagagaaaacctctatatccgtgcgggggggggcgaaccaactagtgtgggcaactatcctcctctcgacatgagtttataaagcctctcaagaggggaaacattatataaaacttctttacacagcggtgtgtttatagctggggtgtgtgtctaacaacccaaccaagcagcaggcatataattctagccgtcgcggaggcggaattagaacaagaaattttgcgtggtctaagctagcgagtagtgactttgtttatttcttctagtggaggaaacattttttttttatccccgcggcggcctcttttcttttgtctaacatactactccggaactataggagaagtaacacacaaaaaaaagaaaaaagaaaaaagagaagaaaaaagaataaaggaaaaaaagcaagcagtacgacagaagaaatcaaagcaaaacaaaaaaatataagatagaaggtaataaacagaagacagacaatgaaaaaagtaaagcagagagaagacaaaaaaagagaaacaagaaaataaaaaaaagaaaaagaacgaacaaaacaataagaacccaaaacagacaacaagacacagaaaatacaaaagaaagaaatagaaaaaaaacaaaataaacaaagacaaaaacaaaacaagctaaaaaaacagaacagaaggaggaaaagacaaaaaaaaaacaaacacaaaaacaaaagaaacaaacaaaacaaacaaacaaaaatcaaatacaacaaaagaacaacaacaaacatcaaacagaggacacagaagacagcaacgaagagaggagaaaggagaaagacaactagcagaaccagaacaagccgcgagcacacgacgtcactacgagaggacggaagacagaacaggcaagaagaagaagagagagcaaggaagcacaacaaaagaaaagaaacacaaacgaaaagagagaagaaacgcgaagaagaaaaaacaaaaaaaacaaagacgaaagacagagagaagaggagcaagggacgagaaaagcgaggcaagcagacgaagcacaagagcacgggaaaacagacaagg

SEQ ID NO: 584253 - DNA, 1052 bp, Homo sapiens
gcgtatgcacctcgctgctccagcctctggggcgcattccaaccttccagcctgcgacctgcggcagacacaaaaattacttcattttcttgccccataccatcaccttgcaggcgcagcaaaaacacattacacattttacacccatgcagggcaaatcgtgcacatccaggctggtccagtgtggcaacccagatcggatgcccacagtactgggcaggtgcatcagtgcatgaaccatggccatcgcacccccaccggcaacctcaccacggggcacagcgcaccatgcaagcatggcaccgccatctcgtgctgtcactaccaaatgaacgccaacaggatgagcaaactatgatatcctcgatgaccaatccatggatgagatcataggacaccatggagaccaatggacctctgattcagctacaggatccctttatgagccagcatcatttcagacccagcacacactattgatcatttggatcagatcatggggacagcgtaaccaacctggagccaaaaggtccacataccacagcaggagcgccggagcatgagttgaatatcatgtaccatggactgtagagtactggaacggagagccagagtcgcatgtcgaccatgcctgacagggccttcacagcatagacccacatctactggcgcgggaggcacacacggactctgagcaatggggcacctcaatcctagatccagcaacgatccagagaaagaagtacccctgaaacagcatcatcgaataacctacagaagagagagccatccacacacaaacgagtcatgacaaccgtgagacgagaccctacgagtgacataccatctccgacacaacaagaggacaagaaacacgatgcaaacatatggcatgacacacgagagcccacataagcgaatctgactcccgacatcgagagctaaccaaacaaaacaacgaggaccaaccaccagacacagcaacacgagtggagaccacaggcccggaaccaagaacatcacaggaacacacgaaaatgacgcacatgagc

SEQ ID NO: 584254 - DNA, 185 bp, Homo sapiens
agaaattgtgggatcctgtggggaaggagtagactcattcccagtacagcgaatacatcctatcggacgggaactgaggcggacagccccgtgtacccaccgtcatccggataaagcaagagcctctggactaaatggacatatatctaatgcaaaaaggaaaacacacacaaacaattcctcat

SEQ ID NO: 584255 - DNA, 845 bp, Homo sapiens
tgcccgcttttctgactgaggctctccgtgcagtctgacctttgactcgtggtttctggagtgcagcctcctgaccccatgtggacctgcctgtgtggctgtctgcggacccagtgaggagctcgtccgccagcccccaggagcaagaccaagaccgcaggaaggactggtggccacgtggagctgctggaggtgctccagtgcgcgggtgcggcagctgcagtgctgagagcgtgtcggaggtggtggtgaacagggtggatgtggctgcgtgctcccagaatgtggcagtggacgatggtagcctccagccacccaggaaggtccagatgggtggccaaggatgccagcaccgtgtgccctgtggacagctgggcaaatgatactggagaacggataagcggacccatcagatgcgtatgcagcggttgaaggcgaatctgcagattgccattccagagcggggagttcaacggcgctgagacaggcgcactgcaggtggagccccggctcctgagcaagcagatggccgggtgcctggaggactggcagcgcaagggccgccgagagcccactgggaggcagcagctgggacacgggactgcatgccgggaggcccccgtggcaaggcttgaagcccacagaaggtgcatcaagggccgacggacaggggcaaggcacgtccgcatgggcacaacgcacacgagtggtcagccaagccagaggcggccataggcgaattcgatccaacagctgcttgccatgaaccaactgacccagagtagccccctcgaaccaagcaacatggcaggggccagccgcaccccagggcacgcggcacggaa

SEQ ID NO: 584256 - DNA, 417 bp, Homo sapiens
ggtgggcgagagagagctttgacatttactcactgaatgcgccctgatgcttaatgagtggcacgggtcagcagcaccgttgtggagctggggctctcagctggtgtggggggggggtcatgtctctggctaaggagcgtacctagcctgcctaagccatgagcctgttggggtggcatgaacagtgactgctcttcaccccaaatgcagtgtttctccttaaggaggcactcagacatttaggaaacggggggaacgtagccacggtgctgttctgggatttgggggctcccccattctgggtgcatctcttgcaaatatgttatgtgctccctttcacggatgagcaaactgaagctttgagagtctcaaagaatgttctttactagactgaaataaaaactagaaacaaaaaaa

SEQ ID NO: 584257 - DNA, 774 bp, Homo sapiens
actgtcaaatttccgggtggggataaatgtgcattgccggtttggtttgggatatggaagatgagggacgcaaggcacgggaggttgtgagtggagttgttttggtctgtaggccatcccagcccacccaggtcagagtacacattcaccaggagccagctttgccataactgcttaagggtgggggttctttgtggaagaacatctgttaccctggacacactgggccttccaaaggccggattggttatgagcatgtgggtctaggggtgactcagatattgctgggaggctgtgagtggagatctgggagtgacactgaactcggagccctggactgtgctaagtgcctcatgctgtgccttgtgaccgaaatctggggagatcgcatcaggatctggggccattgaccattacaaggactcggtcatacttgctggttatatagccagccatggtcacactgaggagactcagctacgagctatggagtggtgtcgatctctgcgtgaatagctacatctgacgaactagaccgtgtttatacatagcccactgtgtgtgatcgctgagaccatgcctttcctagccctggatacagatggatgccgggtattcatgactaccactggcagcacgaggtgggcatagcttacatgcaattgctgaggaagttgctacagcagtccctgccctgttacttggtgaactgtgccttgaaagacattgcgtccctggcttccttgggagtacggcttagaacttgattgtgca

SEQ ID NO: 584258 - DNA, 105 bp, Homo sapiens
tatctgactagcatacttcaaacacagcagaaggtaaatgagtctgttattgtaagtaaagccgtttcttgcgaacagcgaatggtggtccatgactgagtacct

SEQ ID NO: 584259 - DNA, 436 bp, Homo sapiens
cgcgggtgcacatcacttgtattgtctctgaggaaggcggcgacagctcatgggaggtcaagggtcgagctcatcgtgtcttgtgcctcttatcccacgacctacagttatcatcccctcctctgcccaccattggggaccgggcagtgctgacatgctcagaacaagatggttccccaccttctgaatatacctggttcaaatatagtatcgtgatgcctacgaatccccaaatcacccgtgccttccccaactcttcctatgtcctgattcccacatcaggagagctggtctttgatcccctgctcagcctctgatactggatcacttccgctgtcaggcacggaatgggtatgggacacccgtgacttcgaatgctgtgcgcctggaatgctgtggagcggaatgtgcgggtcatcgtggctgccgtccttgt

SEQ ID NO: 584260 - DNA, 325 bp, Homo sapiens
tgcaccgtacattcgtgtccacataagagaccacctgacaggcttagtgtgagcaacatggctgtttattcacttgtgtgtgagtgggctgagtccgagaaaggggtcagcaaaaggtggtgggattatcattggttcttataggtttgggataggcggtgtagtcaggagcaattttttacaggcaggggatggatattacaaagtacattctcaagggtggggaggatgttacaaagtacattcacaagggcagggagggtgtatcgtcacaagggcagggaggatgtattgtcacaagggtgggggacacgaatgttcaggt

SEQ ID NO: 584261 - DNA, 242 bp, Homo sapiens
  misc_feature (6)..(6): n is a, c, g, or t
  misc_feature (70)..(70): n is a, c, g, or t
  misc_feature (157)..(157): n is a, c, g, or t
ccctgncaactccttgcatggactgatgctggaaactgggtcagggagctccaggaggaaccagacaggntcctgttagcaggctcaccacaagttctaaagggcaccagccttgagaagggcagttgggatgtggccaaatgtgaagccaggtttnctgggatcctgactgtcccaggttacaagttcctggccactctgtgaaccttgggcaagttaacttccaacctctttacaagttc

SEQ ID NO: 584262 - DNA, 249 bp, Homo sapiens
acgttatgtgaaaatatccgaattcaaatcacactcggatcttcaatgattcgagtgtgtatccgacacagcgcgcctggagactgagtgaattcctcccatgcatgcccatccccagtcaagtccttcctcatcaccgtccaccagctcacacagtgtcgtagctggctgctcgagcaatttccacagatggtttctccgtgtctttggccactcttgacgtagccaccctatgccccgattcttcag

SEQ ID NO: 584263 - DNA, 1009 bp, Homo sapiens
tggaaatttcctccttttttgccccttgtggctttgaggtattgctatggtgccagttacttgaatgcttgtttttcaaatggcaggtgacatggggtcagttattctcttttttttttttttggaaagggattctcgctctgttgctcaggcgggagtgcagggacatgatcttggatcactgcaacctctgcctcctgggttcaagcaattctctgtctcagcctcccgagtaagccggggttacaggtgcctgccaccacgccgtggctaactttggtatttttagtagagacagggttatcatcatcttgaccaggctggtcttgaactcccgacctcatgatccaccgtgcctcaggactcctaaggtgctgggatcacaggtgtgagctactgtacccggcctgcttgggtttcctatctgtggctctgccacctagctgtgggttcctgtggccaagttacttcatctctcgggtgccctcaggcttcttccaaatgtaaaatgggggataatgggatctgctctcatagggttgtgacaacttactgagtaatgctcttagaagagtcacctcattttgtatataaggcacgcaactgtactctatcgtaatgcacgaaggttactcctgttgtatacactcacataccctggggccaagattggtttgttttgctcgaaaagcagggcaattggagactcactttaggtcggccctgtcgtagaacacgtggtctaaattgccactttgtctattggtaccctggccactaaggagcttgtttaccacactgtggctggtggtgagtgtccaaccaccggttgtattgcaaggttttaaacacttgtcggggagaaacacggaaacgccagacacatctttccaacgcttggtgcatgaacacgccatgcgtggacaaacaagggactagatcagagcaacagccacgtaagcagcatatagagaaacgacatgcagctgtcgtaccctgcactaatacg

SEQ ID NO: 584264 - DNA, 999 bp, Homo sapiens
gccaggccctgtgctttggagtcctgggagtcctcttcatggtccgctcagtctaggctttatgtttgccaactgtgggccacttaggccacgagccgcatgtctggacactgatcaggccctgctggcccagagtccctgtgcgcatgcacatggaggggtcagggccgctccctagggtccctcctgcccaacatgtgcgcaggtggttggttcccatgaacgtggttgtcagaggcggggagacatgcagaggctgcagacatggcccacttcaactctcctcccccagaggatgctcaatggtcttggatcatggcccataatcccaagccgcgaaccccatgggaggaggaggatggaggaagacagaggaggaggaggaggaggaggaagagagaggaggagtgcggacatcgcttaggttgcaacgtactctgcggcagtccaaggttgctgctcatgctcgtaccgtatcagtgtcgagcaaggcatgtgtggtacacgagagttcactgctccgtggcgttgcagtatgagtatcactgacagaatggtggaaattaccagactccgagacccaggtgagggggctggtcgcaggacaaacagcccggaactcaggggctcctggtggcgagcaccggggacacagctgccaagacccaccaatatggatggggcccgtgggctggatctcgtgggcaccctctcacagctctgccaggagaccctgtcttccccagggccatcggctctgcgttggaaaactcgtctcaagaagcccctttccccagaagagggtggtcttcaaggaagtctcgtttctttgggcctgaaaggtcagtttcaggagaacgatgtgaaaatttccggggtagaggtacacgcttctatgtgtggagtccagtaccaaaaggtgtgcaacgtgcagcacagcatgaggtgagtcggcaaaagaggccagtccaagcaaaggggcgttgtgccttgtgacgg

SEQ ID NO: 584265 - DNA, 534 bp, Homo sapiens
gagaaggcgtgtgtcttattctttccctgcgtaagcggcccacgaggaaagggaacccctcccccatatcaggcgggtgttcccaaatggtcccggttgccacggcccacgttggctgccatagaggcccactgtcccccatacgagggatcgaaccccccgccctcgcaaaatgtttggcttttgtgatacaatcacggtgatggcacaactgccagtggtggggcttaacccagtggtaagacacccttgtaggctgcgggtgcctgcccccggtgaggaggcctaagcccaaaagcggtatcccccctccagaacgagaaagcagagcaacactcttgaattcccaccatccgggatggcacaaaaccctttgggcttaaaaagggaacggccttggggttccgcggcccaatcctttgtgtttggccgcccatgatgggaatgatgccccgcaaaaaaggtgccaaaagttccttaagggtttcccccagtttgaaaggtcccccttttaaaaaattgggagaaaaacca

SEQ ID NO: 584266 - DNA, 1560 bp, Homo sapiens
  misc_feature (1014)..(1014): n is a, c, g, or t
  misc_feature (1088)..(1088): n is a, c, g, or t
  misc_feature (1147)..(1147): n is a, c, g, or t
  misc_feature (1186)..(1186): n is a, c, g, or t
  misc_feature (1290)..(1290): n is a, c, g, or t
gttgatatcttgctcgtgggtgtgccccccctcattcggccagttattttaagggtttgttcgcgcacaccaagaggggggggtttttcgcctgtgtttgcaaaaagaggggggccccagctttttcccgcggggatatccccacgggggggtctcgccgccaccgttggggccttttataggatatgttcccttaaaaagtgttgtgtttgttatacgcaccactaatcgaccctcgtggaaacggcgggaggaattatttcctatatctccttgggcggcgcaaacgacccaccagtagtaaattttggctccgcccctcgtccgacacgtgcctgggaaaattttgcttctcgccgcgaccaaattggtcccctggcgctctcctatattggaaaactgttataaagggtttccggaaattctacaagcgcccagcccacagggttatatgcgccaacccaccctcttggaaggggatattccgccgctctcgcgccaaaattggtatataaaagggacagatatgggccgcttcttaaaggcacctttgttaaccacacaggggggttttgcctccccccctctctcgggattgaggcgcccacgatttcccccttgagcccccccttgagtggaaagatgttccgcccctcgcgtttttggggaccccggagctctgttttgggacgcgccctcggggagcccacagtgttttgtggggtgttcgccttaatggccccctcccgccccgctggagaatggtgtgcacagacaggccaccgagagccacgcgctttgcggtgtggggagaagacacatatttgttaagagccacgcggtgttaaaccaaataagagccttcgggagagtttctcttttgggtggccacacatcgtggttgtgttgtctcccacggcccgctcgcgctcgagatgtttctcgtgtgcgtataataactcgctgtgtttggaataataaaaagagaataaaaagagtgtaccccccactggnctcttctctctgcgggtggcccctctcccagagagagacatctgggggatattttaaaagaggggtgttatagnggacagagcggactctgtgtgtggggcccccctgtatatctcatcacactcgagatttngggtgaacccctcgagactcgcgcacactcaccacgctnggtgtttcaattctatatgagactctccgctcgagaagagtgtctaactctccacgagactcttcctctcgcgacctctcctcccaccccgcaagagagaggcnccacagagagttcttctcgagagaaagaaagagctctgggtgtaactcccgctagattaggatccaagcccaatagtgggactcgaatatctggctctgttggaacacgctgttggaagaaaagatgcccaaagaggactctttataataatttggaccgctgttagggaattgtctatatcctggtaataaattcaccgtagtactcttgcttaaaggcccagagatttccagatttactgcttggaattaaccccactcttccatgga

SEQ ID NO: 584267 - DNA, 235 bp, Homo sapiens
atacccagtgggtgagagacaacatgacacaattatattctattgatttaaataaaactatccttgacattttagtgtgtaaatacatccaaacataactgtaattatcttgaaaacatatatgttatgggtattgggatacctggactttctgctgtttaggagtgtgtccttgtaggtatctgtaggctgttcactcaactgtaaatatcttcttaatgtgggtagtcacaga

SEQ ID NO: 584268 - DNA, 143 bp, Homo sapiens
tctgaggatcccagcagccgtctgagaactcgtgatggtggtgtgtcgtgataacgggtggacgacggttaaaggacgccactatattacgtaatcgttgatagctcgaactgactggctcaggcgtgacttcactatgagat

SEQ ID NO: 584269 - DNA, 318 bp, Homo sapiens
acagggagagagggggcattcagcgcctgtctcatggcccctgggaggaaattttaacacaagaaagaggaaaacccaaagacactgttgccaaacggcttaagctgtagcacgaaagaaggctctgggcaccaactgtgtgttctgaaacggccttcaaaccaagctctgcaggcacagggccttgggagggctgggctctgacctgggggtagccaagtctttaccaactcccaagaccaacctgcagtgggtccacccaagggtggtccctcccctaccggcatggaacacaccctaaggcacctgccacctgaa

SEQ ID NO: 584270 - DNA, 335 bp, Homo sapiens
cgtggtatccctagggtctagcctccacattggcacacaaagtaatcaatatatgtttctcaaatgcatgaatgggcaaaggcacatgatgataaataaatacttcaccacagtgagagaacagtttttaaagcgtgttgttgcagaaccaaactgtggcaggccttactcagattttattcggtgggcaatgaggaactactatttttaaatggggcagtgatacgaccaaaactgagctaaaagaagaataaactgacaaaacataaaacaggtgacagctaaaagagaaaacctgcccttaactatgctattgaccttatctgcatctgagg

SEQ ID NO: 584271 - DNA, 169 bp, Homo sapiens
gtcacctataggaacctgagcactcgtatacagagcttcgggagatcaggccatagatcccatgcatcgtggtggctatataaattgatgcagactaacgtgacccaataaaagcttctaatttgccaacgaagtctccctggccctgtttttcgtctcggctgctgat

SEQ ID NO: 584272 - DNA, 574 bp, Homo sapiens
agcggatgggtctgacacggaacgaatctactgatgacgattttttacagaacctagatggcgtgagcagtgccctggtacaacgtggatgcccgatgttcatggaccgccgctgtggtatactaccggaagccattgctggagtcaggcacactgggcaccaaaggcaatgtgcaggtggtgatccccttcctgacagagtcgtacagttccagccaggaggcacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcaccctggtgctgcagcgaccacagacctgggctgactgcgtgacctgggcctgccacaaatggcacacccagtactcgaacaacatcgggcagctgctgacaatttccctcctgacagctcaaagctcagagcgccgtctgt

SEQ ID NO: 584273 - DNA, 253 bp, Homo sapiens
aattcgcggccgcgtcgactcgacgcgagggaccaggacatcctcgtaatgggagcgatcaaacacaccaagcattccgggttccggcagagccttcttgacgcgccaaaggaagtcatgtctgagttcctcctgcgtcggggctttgaagctgtgatggttgatgccttgcgggtcgaccatcgcgacaacatgtcgtaccactccgcctttgccggcagtgtccagcccctgtgtcgacgcggccgcgaat

SEQ ID NO: 584274 - DNA, 788 bp, Homo sapiens
aagggacaaagaccaacgccccccaccgcgcgtgaacaacagagcgggctctaagcaaagtgggggggaacgcacacaccccgccaagaggggtgttctctccgcgcgaacttccccacagaggtgcctcacggcagagacgcgcaccacaagggggacccccactccaacagcagacatcttttccatcgcgcagggacaaacggctacgaacgtagtcacaaagaggcacacgagacccaatcggcggatcgtccttagttggggcccccccactctcccctctctcaacacaagcgcggacgaggaaactgagcgagggaccgacgggttagagagaaacaagaaggagtgagagcatgcagagaacgcacaacatacaaggcgcttcccacccagagaggccaccggccggcacccgtccacttcggggcgcggactgtgtgaggcaaagcacccacccgttcgagagaataagactcgatcgagggagagcaggcagccctatggcacacccgcagcgcccacactatacaatatgtcgacacagggtgccaacagcgcggcgaaacaaaagtgggacggggcggactactagaatgcacgcagaagaggatggcgacagatgggcggcacgcctccacgcagaaggtgacctcacctcaggtactcctctagagggccccccaagcaccggagacaggcagtatcccttgaccctgccccgcgcacccactgggggggaacccccctcatcccccaccatttcggttgaccccaacataaca

SEQ ID NO: 584275 - DNA, 651 bp, Homo sapiens
gagagttagagagagagagagagagagagagagagagagagagagagagagagagagagagtgtgtgagagatagagagacagagacagagattgagttctatttttatatccatattcttgtccttgtcatatttatattcttcctgattctgatatccgcatctcaattccattacctgtctctgttctagttcatatttatttttgttctgtgtgtggttcttgacagttcttgtacatgtacatatacatatacgtattctttctgctatttctattcctactactactacgtccttactttcactcttaccataaccctacttactatcacttcactttattcatcctctagctcgctcccgattcccatctctagctatacttatccctattactattccctttcccttgatttacacctttgtgactggcatggccctgcccttaccaatctcaatccccttcttcctcctctcctttctgcctgctttcgctatagcgtccactcccattcctatttccatatccatctctttcccattctcctttgccatttcttctgtagcgttgtctttcgttctttcccttcagttttgcttcttcctctttatctcttccccttatctcgtcatcgcgcctttctttt

SEQ ID NO: 584276 - DNA, 170 bp, Homo sapiens
  misc_feature (37)..(37): n is a, c, g, or t
  misc_feature (96)..(96): n is a, c, g, or t
  misc_feature (137)..(137): n is a, c, g, or t
  misc_feature (148)..(148): n is a, c, g, or t
agctcggcacccctagtgccactactctggtgaccgnagcagcactgcgctgtcagtcctggcaatgctgtttgattcccgtcccatcggcgggcngtgcaactagccaagagctgcacaagacatgtcggagcggntcaacattgcnaccacgttgcagatgcatttgg

SEQ ID NO: 584277 - DNA, 122 bp, Homo sapiens
ggccccattgtatgcaggacgcgcgctccatggtcgataagtacttccgaactgagctccggacaggctctggaagtgctttagacttctttcctacacagcgggacccgccgagcttccag

SEQ ID NO: 584278 - DNA, 748 bp, Homo sapiens
  misc_feature (443)..(443): n is a, c, g, or t
  misc_feature (492)..(492): n is a, c, g, or t
  misc_feature (499)..(499): n is a, c, g, or t
  misc_feature (537)..(537): n is a, c, g, or t
  misc_feature (548)..(548): n is a, c, g, or t
cctggacaagttttggatcggttcatccctggcaccaccaaaagtggatgcactgaagaagatgttgttgatcaaggggcgtttgccccgtgttttctagcctgctttctcccactggtaggggcaacttaatggactgcagcccagggacaactgggccaaactacagcgggattatcctgatgccccttacccccaactactatctatgccctcctgtgcagttagccaacttctacctggcccccctccattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccccggggttgggttgccggtcanagcttaaaaggactagcaccctgcaatgccccttttcactttaaaatgnacactgnctgctttagagcccttgataatagttttattccccccncatactaggcnctccataaatatttgttgaaccttcatggccttatcaactttacacccatatcccagcaaatgccactcatcccccctttttataaacacatttgttactttaaccctgcctaggctttttgtagctccagctttttaaaaactcccggaaccctttatatggggccccagtaaatatgttattaaatatgtaatccgga

SEQ ID NO: 584279 - DNA, 169 bp, Homo sapiens
cgacttagaggatccccccttcagtggggagctctttcttctgcttctccttcttgccttctccttcttcacttgggcttcttggccttgccggggatgctctcgtgctgcttggagccagcagcgtgggacttcacatccgtgtccgaatcgctggagctgctgctgg

SEQ ID NO: 584280 - DNA, 263 bp, Homo sapiens
tgccaggacataccaataccaattttttcgaataaaataaattttttaccatcggtgtacctccttccgtaagcaaattcatcaagctccccatgttaatccagttgctgtatgagtgttgggtaggtctatgggttaccttctcattaaaacttattcctgggcaggcacaggggctcacacgctgtaatcccagcacgtttgggaggctgcggcaggaggatcgcttgagttcaggagttgaggaccagcctgggcaacat

SEQ ID NO: 584281 - DNA, 217 bp, Homo sapiens
ggtaagagcggtcttccaaatgaaaagaagctagatattttgtccacactggtagcaaatgtataacacacatagagcaattctgttcctgtgcccccagcagacatcactaatcaattacagtatccattcctccctagttcaaacagcttggattcattctttttttgttcgtttgtcttaatctttttaaggccacacccatggcatatggacg

SEQ ID NO: 584282 - DNA, 228 bp, Homo sapiens
ggtagagatgatcgcttcgtatgataccaggagctaatgacattcaactcttcatctataattctattcgataaaaactataggccacttgacgtctcatgacgtctaaataaattgacgtccagacgtcaaattaatagctcaactattgttaattaccagtattggagctaggtacgcaatgatgactgtatcataaaacagtatgcgggccacgacttgatcggt

SEQ ID NO: 584283 - DNA, 970 bp, Homo sapiens
agcggtcgtaagggctgagggattcatggtccgtacgctcctgctacctgcactcacctgctgttcgcctctcggccgaggaacatgtcggtctaggaacgcccgggcgcaatgagccatggtttctaatggataccggaaaaacaccgcgtggcagccgggaggtggctagttcgaagccgaatgtcgagatcagcccatagcagacgaccagctaacgctaaataatcgcttgagaagaacgggtgtgctgcctgatcatatgaataacgaggcgctagaatgaaaagaatttcgtcatcatgttgaatatggaccacgttcagaattgcacttaggccataagtacttttgagaattcgacgtacgagagagagaaacgtccgtatgatgggtgaaggggtcctacaagacggatggggagtcagttttcgcagattgagaattcaacaagcgacgtcattgcacattgacatcagtcacttctgaaggattgtaacacgtcagtcattcacttcactatcagtctcattgcagtccgaggcagtgtgcaggtggtaagtcaaccgatttgccagaatgcttgttagagtcgacacgtcattgttcacataaagttgcatgaaccgagtgggtctaaatacttaagccaaaaaaagacatcataaaaaaagacctctcttataaagtgggggggcgccgcctaaaaaaagtttccccttggggcggtgccatttcttgccgtatccctttctttgttctctagtcgtggcccccccttgagttctacatatgataaggcaggccctggcgatatttaacccccttagctcctggtgccctgtggggcaccgagcgactggctaagcgcggctggctcgggggggcggctcatgggcccctctttcccccaatttacgctgaggtttgcatacccagtgtcggtgaattggtgcgcccctgcatatgg

SEQ ID NO: 584284 - DNA, 131 bp, Homo sapiens
gccatgcgccaagcattcatctgtgcctgggggtcgacgtgtatacaccactgcggtgcttgcctccctgtaccgttccgtcgaccacgtgagcaccgtgctgacctccaaatatcgttacgctggagcct

SEQ ID NO: 584285 - DNA, 250 bp, Homo sapiens
gttaacttccaatttacatactctgcttagaattatgggggagaatttagaaatataattgacaggattattcggaaatttgttcataatgaatgaaacattttgtcatataagattcatattatacttcttatacattgtgactaaagtaacggcatggctcgtggttaatctggtttattttagtttccacaagcttaacaactaatatcatataaacttgcataaaaagaatgagaatagagggcct

SEQ ID NO: 584286 - DNA, 338 bp, Homo sapiens
gtcatggaccggaaatagaggtatcagggcgcacactaagaccagtacataacgtcagctccagaaaatggagcgaacaggaggccacataccatccccactaaacgcaaggaggactcctcggccgaccgtctggtaccagggctgggacaggaaagaacaagattagcctgaacacactcctgttttagcccatgtcagaaagtgtttaaagaaagacaagagctgtcaaaaagatgccagatgcacaacatgaatattcttggtgctattgaactgtacacttaaaaatggttaagactggccgggcatggtggctcacgcctgaaattccagca

SEQ ID NO: 584287 - DNA, 1555 bp, Homo sapiens
  misc_feature (651)..(651): n is a, c, g, or t
  misc_feature (1320)..(1320): n is a, c, g, or t
tggtatttaaaggtaaaaacggggtttcaccatgttagcaatgatggtctctatctcctgtgaccttgtgatccaccgtgcctcggcctcccaaaggtgctgggattacaggctttggccaccgcgcccggcgaatttttttttcttgagacggagctttggcctctgtgtggcccaggctggatgttcgcaggtggcgcaactctctcagctctcactgtggaagacctctccactcctccgcgggtttcaaagcccaatttctccttgaccactcaggccctccccaagtatagccgtggaatatacaggccattgtcaaccacacaacgccccttggacctcaaaattgtgagctatatttatagagtatagagaccaccgagggtttttctctccaagtgtttgtgggactcagagagccgtggctcttcgacaacttcgtgtgcactcttccaggggtgaacttccaaccgcgaccttttgggctttccccaaaaagtggtgcgtgggacatttaccgggggcatttgtagcgcacaaccttgttgcgcgtggtgcccacaatgaacgcttgtgatttttttgaaaacccatatatagggccatccaagcggggtaaaatgtggcccccccaaagtatctctccanggcaaaaaacgcatgtgaacgggaggtgtcccccgggcggtgtccccgctactggggggggcaggtctcccgttgtgtccgccccgggtttgtacaaccatacgggggggttcctccattgtggcgccccgagaagtcaccatttcccggtggaccccttctcacacgactttcgtgtaaacatgtgttgcatacaaaagggccccgttgtaaaatacttctcgccagaggtctggggggcgccacagcgggttcggtacttattagaacgcgctcacttttgtcgagcctgccccccagggggaggcacttggcccgtgtggtgcggctctgattatagtacccctccccgctttggctttttggcgggccgaggagcaacacacggggtcgtgatcgttcccccacgtgggtggaggaggaatcacccattttttctcatcaccgccatcatacgaggagaccccccgaggggagatacacaacgacgatgtgtgttcttcagtcaagacaggcggcggcggtttcatcggaggtagtagtcttgcaaacacgtacgatatatgacgtagccacgtcttggtagcagccagttgtataataaaaccccccacggtaagtggaatgaaggcggcccacctctctagtagtagtagacacaccaccatntcattagtaaggagaaaagaactcctccccgcatgtggaagaaagagagggacattcctccatttagtagggtggaacaacaacgtcgtggcatctgaaacacaacagttgcttgtaagaacaaaacttgactcagcgagcacacataagaagccacgccgcaccagcctaatcatatgacataggagagaaaacaacatcgcttacagtccatcgactagagacggaagaaggg

SEQ ID NO: 584288 - DNA, 535 bp, Homo sapiens
gaaaacaccaaatggtggatgacgccggtgcagcgggggggcccgggggccctggtggccctgggatggggaaccgcggtggcttccgcggaggtttcggcagtggcatcacggggccaggaggtctgctggccggtggggacagtgcggcctgtgggccctgaggaccagcgagagcatcgacggaagggcaatggccgatggataagcgacgttggatgcccgtcaccaagttgggccagcttgtgtcaaggacatgaagatcaaagtccctggagggaggatcgtatctcgttcgtcccgtgccccattagacgggcaatccagcagcatccattgcatttcttccctggggggccgtcttcttccacaggcattgcagcggtttcggacaggactttaattgcccaagatatggcaagcaaagcccagagaccccggttgcccgagcccaaggcgacaaccaagagttcaaaggcaattaagtcggctatcggggactacaatggcacgtagtctgggtggtaggtgtcca

SEQ ID NO: 584289 - DNA, 84 bp, Homo sapiens
ggtcgacagggcccagaggtggagtatgaacctgacgcctcaagggctgaaccttggtgtttcaggacccaaggtggacattga

SEQ ID NO: 584290 - DNA, 683 bp, Homo sapiens
aagggtcgaggaggctggtagcgtgaccggtccagattcctactcacgcactgcggtgaatgcccttgagcccaataagcagccttctctttgttctcttccttctctctgtaaaaccgcgtttcctgcgcttgttccctcgcactgaacatgctcgttcacctgggcaagcagaggaagctacgttgggatatgtgagcagtgtgctccgtggtgctgctagtgtgacccgccattccctgtaggccccttgccccgcgtagctcccagctaggccctctttcctgcgtcctgcctctttccttcccctgccacatcccaattctgtaggcctgtcgctttcctctttcccatgcccgcgctaggacttcaagcgacgcatttgagcgtgacgggcatggaaagcagggaaccaggaagactcgctggcatgagctagacagaaaaagaccaagggcgtggtggacaccacggagggccaatattccatccaggacactcacacggcacacacaaggaggaaaatcccaaggtcggcggcacctccgcacgcaaccgcgaccccccaaacactaggcgtcggccaggccccccggcacccgttgcgcggcacatcgcacgggtcgggcacggcgcgcggcacgagcaagacgcccagacacaccataggcacacggatggag

SEQ ID NO: 584291 - DNA, 134 bp, Homo sapiens
caatgattacagaatctgtattaactattaaaatttacagcctaggaacaaatagagagaaatgatcttttcaagcgagtactttatttttgctagaagcaggtgattgagtcgtgttgttgatgtagatattg

SEQ ID NO: 584292 - DNA, 195 bp, Homo sapiens
gccagaaagaagtacaaaccgaagaggtggaacagatcccacaatgtccctggccccgaagaaggatcgcgtcgctcaaaagaaggcaagcctcctcagagctcaggagcgggcagctgagagctaaacccagcgaattttctatgatattagacagatatagatgataaacttatgaacagcgtaccacagggt

SEQ ID NO: 584293 - DNA, 1545 bp, Homo sapiens
  misc_feature (363)..(363): n is a, c, g, or t
tcagccccatgttgggggagaaacaagttcgatcccgaacaggcgggggccacccccccacacagaaggggggcggtggtcagtagacgtcgtcgaagccagacgtcctgggggttgtgcagagaaccacccgcggtgcacaaggaagtccgggggttggaaaaacttgccccccacaaagtggggggggagacacaccctacagcgagtgatctactgtctctattcatatatgcccctccttcttcgcccccccctggtagtaagggagaatggtttcccaccaaacattggccctacacaataggcccccgcgtggtaagcacacacaattcttgggccggtttaaattctacgacgacntttggggggggagcgtcccctcctaggagaggtgttggatatagaggagatacgccccgctgttatcccttcatatgagacaccgaggcggggattaataagaagggccccttctgaaggaggggggcccttataaccgcgtggtagtacagcaccaacatctgtagctcttgtggcggcttctcggcggggtacaaccgcgtgggagatgtagaacagagaagagagggcttcttcaccccgctggtacggggcttctctcacagagagagtgtgccaactctgtgagagtctttcgtgtgtcacaccgcacactctgtgtggggagagacacccctcctctggagagaaatagggagaataacaccccctctctgggtgtttctctggcctccctcttcctctcggtcactaaagctacagcacaccatcagttttggcgacactcccacacagagaagctcttggagacctctgtgtgagagatgtctttgctccgcgagagatagttctttcacttcacttcacacacttctgagagaacccgtctgtgtgtcgctcacacacaccacacgtgtgtttgttcctcgcagagagagagatagtctcgggagacaacacctctctcgcttgagagagtttttccctcatctccgcgagagaccttcggagacttttctctctgcgagagttttggtgtcactctccacacggccacacacagagaatagagagtttcgagaatctccgcgagggcgtggtacaacacacaatatatggacacactcatcttttgcgcgcggtttttctcacacaccacatatatatgggggcacacatggcgcgtgtaatgtgagacacactatacaccacacacacattgtgtgcctgtcaccaccaaggagacacgcggcgccacagtggcacactatactttgagtgaacacaaccgcggtttctcccactgtcacaatgaggaaatcaagaattgagagtccacaaggccagcctaatgtcctttttttatccacaacgccacaggagacgtggggcgaacgcctgctgtccccggccggctcactttggccgcccccagcctcccctgcctgcagctccccacacccacgctttgaggttcacatggagatgttaaattgaggagccctgggtcctgcccacaca

SEQ ID NO: 584294 - DNA, 1175 bp, Homo sapiens
  misc_feature (6)..(6): n is a, c, g, or t
  misc_feature (64)..(64): n is a, c, g, or t
  misc_feature (86)..(86): n is a, c, g, or t
  misc_feature (95)..(95): n is a, c, g, or t
  misc_feature (103)..(103): n is a, c, g, or t
  misc_feature (288)..(288): n is a, c, g, or t
atccgncctggaaagttccccaatttgccaagccccattcctgtcctcatcctgtctcctgaangatcctgtcatcccggtgaaanactggcatnacgtgcgngctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtggcagccctggggctnagctccagcactggacaggcacagagcaggggctgcccaggaaggagcacactccaggccaggggtgcatggcagaggaaggtggggagagcccagaaggacattgcagacagacagcctgcatggggactctggcatcagaaagccgaatgtttttgggaaacgggtgggtcacacaggcaggggtgaaacatgggctctgaggttggctacctgattcaaacccggccgcgctgtgcacctgctgggtgacttggccaggatcccccacttcgctgtgcccatatggaaaagagggcaaggccagtcctcactgccgagggccgagaaggcggtgccgagcccctgctgctgcatgaaccttagccgctgtcactgatcccaattactctgatccttttgcccttccttcccataacggcctgctggacgccacagcctgaatactggagagagctgggcattgcccaggtcacaggagagagtccgtagagacctgcgcaggagccgggacccctgctgagcagtgggagctttctgtcatccccatggctcaaggataacctacctgcctgcagagaagtgcgaaggtcttgctggatgacttttcacccgcactcacccaggagcaggctcccaagtgaagaaaccaccgaaccatcaccagctcctagaagcctccctcctaccaccttctagtcaccatcccccagaagtaatgactctcaaacctgggggatttgaggccagggggagagccaggctctatgctttctgtaattgtgtctcgtttgtgtgcacgcaggtttgttttatgttttggccattaagattttccccagccctctgttttttgttttttaaactaaatagagatgggatcttgc

SEQ ID NO: 584295 - DNA, 165 bp, Homo sapiens
  misc_feature (23)..(23): n is a, c, g, or t
tttctaaatattctttattgatnaggcaatccattcttgaatccagctacatcaaataatcaggaaaaaaaaacttgacaaaatgttatccaattgaaatgacagtggataaaaccctttaactttaagtatgcataaaagaatatataacaacacagacagatc

SEQ ID NO: 584296 - DNA, 902 bp, Homo sapiens
  misc_feature (1)..(1): n is a, c, g, or t
ntgtttgcttctctcgatttttcccgacgagtgcgtctcagggtgtcgcccagcaccttgtgtctctctgggttttctgctgccgggagacgtcttccgtttggtgcagagctggtggtgtgggtagacagttgttcgtggcgcgtcgtggacccccgtttgggtgccaatcgtgttgggctaggcgcacggtagtccgcgtgttgtgtcagcccaggcggttaatggcctctgttacagcgggtggacaccaggggttggttggtctgtgggcgcaacaggaagtttgcccccctcagaggcttaggggcttctcgccgctgtgggcccaacgtgtagtgtaagcaaccgtatctgcccgaaggaggggggcaagcacgtgtggcttacaccacctggggttaaacacccgctttgatcattcctctattgaccgcggatggtatttcacttgtgaggaccacttgggggtcggtttcgtccaaacactcccacaaagggaactgtgggtcaggagacgacatgtatggtcgcacgatcagaacatgttaatttttgatcaacacgccctttgtacacgtctcgagggctttaaagcgagctttccccaaatatattatgcacagggtcactatgaaaaattacaccttgaggtcaaccccacagggactatatgaacatgatcattcatccaccgataccctttgttcttataaatcaggggcgagcttcatatgcccaaaaagtataagacccatttaatagctcccagccattacccacaccgaatttaggtgttttcctccctccccccctactttttgcaattttatttatagagagttaataccacactttcaatttgtttttttaaaaaataataaatttttttccacataaca

SEQ ID NO: 584297 - DNA, 854 bp, Homo sapiens
ttttttggggttcccaagttattattcaaaaactcatacaaaatttccccaaataaatagaaattataactccttcggttttccctccttctttcttatcggtccgtgggtaaactcttggagaagtatcaactgtaatttcggaaactcttcttatggcatggtatacgcaacttcaccgcgcgcacaccaaggtccacggtaagatatatctcttctcttctaaaaaattatttatatgtgggagtgaagaatatttatacaacatattaccctttatgtgagagagacaaacgggacaccctctcgtgtatgtgtatccgcgtggatgacatctgtgtgacatcatgtgcccccctatattcagacgtgagctccccacaccacccttctcacaacacaaggagtatctcccacaagcaatttctcacagtgtctcaccttgtgagatctcacctatgtctgtgtgagacacaacacgtgtgactctcaaaaacaatatgtgaggaagagaatctcacacttagatctctcacatatcttatatactaacagggagaggtgaggtgtcgccacacactcacagggaggtgtgaaaccttcttcaaaaacatctgttgctctttctctttatgtatgtttgtggaccacccccccatctgtaacaccaccacaaagagctctttttctataccaccgagagacagcacccagttgtgcgatgagctcccagcagccgagaactgataatatgcaccaacaagagggaggcaccctagcatactatctgtagagcatcattgcgcacggaaaccccgggcaccccgcattttccttaaaaagaggttatatac

SEQ ID NO: 584298 - DNA, 1001 bp, Homo sapiens
  misc_feature (675)..(675): n is a, c, g, or t
  misc_feature (679)..(679): n is a, c, g, or t
  misc_feature (685)..(686): n is a, c, g, or t
  misc_feature (688)..(689): n is a, c, g, or t
  misc_feature (693)..(695): n is a, c, g, or t
  misc_feature (698)..(698): n is a, c, g, or t
atagaaggaaagtcatggtcaggtgaattttttacttgtaactggaaaatgaagtatgtcacatttgaagatgaggaacaggcaaacttaatctatggtaactccaggttcacagatttacactcaattatcagaaatattcagtcttgcaaggaggtaaaaggcagaactgccttcaatggagtttcattcaatctgctccagtttgtgcaactcctggagacatttgttggtgaagacgctcccttgagtgtcagcgagactctcacctccttttttaaggagggctatgttgaaacagaacaagagaaaatgaatgccttagaacagtttagccaaaatgctttccaagtccgacagaggcttctcctagaagccatctttcagaagtgggacagtgatggctcaggcttcctggatctgaaggaagttgatgaactcttgtacacatacaaggagggaatggaaaaagaatctatgaagaaaggtaaaatataagaatgttcttatttaaactgtggtaattaacttggcttcaagtttctcagtacacatatacagttaaaatactggttatgctaaaaccactagataacccttcatgtctaccagtatagatatacatttatcttatttatttttaatttctaaaaatagagataggagtctcactgngcgncaggcnngnntctnnntcntgggatccagtgatcctcctacctcagcctcctgagcagctgtgactgcagtacctgccactgtgcccaactctggctataatcttttaagtagaaaataacaagtgttggcaaggatgtgaaaatattagaagccttgtgcatttgtcaacacagtcaaaagtggaatatgttgcagaatgctttgtccaaaattttaaatctatatagttagattccttcagtatacctggctactttcactatgtaactaacctgcacaatgtgcacatgtaccctaaaacttaaagtataataataaca

SEQ ID NO: 584299 - DNA, 362 bp, Homo sapiens
caagaactcatgaaagtttattatggaaccagaaatacactgacagtagcctgagctgttatgagcaaaaagaaccaatctggaataatcacattaccttacttcctttagcatttcttgtagaacacgtctggtgtggattaaatcactcagcttttgtttgtctgggaaagttgttatttctctctcctttgtgtttgaagaatattttcaccagatatagtatcctagggtacaaggatttttaccatcaacacttttaatatatcatgccactctcccctggcctgcaaggtttcaactgaaaggtgtcctgccagaagtattgcagctccatcgtatattatttgtttattttctct

SEQ ID NO: 584300 - DNA, 286 bp, Homo sapiens
ttccgctgggcaatgcacatctccgtttcacgtgaactcgctccctggttcaagcggttctcctgcctcagccttccaagtagctggggttataggcacccaccaccatgccgggctaatttttgtatttttagtagagatggggttcaccatgttggctaggctggtctctaactcctgacctcgtgatccacctgcctaagcctcccaaagtgctgggattacaggcgtgagccagcgtgcccgtcgaaactttgggttagagtcctgccattgggccagcgag

SEQ ID NO: 584301 - DNA, 229 bp, Homo sapiens
agacggtctctaccgacccttacccactactttaaactctcctaactggctgtgaacgtacggtgggacttactacgtcttccactacttacccgactgacggcggtttctacgctgtcattctaccttcctcgtgtctactgactgttcttctcccttttctctttccctgctttgacggcttttatacacagatattctcctgagtcttcttactagctttacaacg

SEQ ID NO: 584302 - DNA, 911 bp, Homo sapiens
  misc_feature (8)..(8): n is a, c, g, or t
  misc_feature (61)..(61): n is a, c, g, or t
  misc_feature (98)..(98): n is a, c, g, or t
  misc_feature (136)..(136): n is a, c, g, or t
  misc_feature (142)..(142): n is a, c, g, or t
  misc_feature (287)..(287): n is a, c, g, or t
  misc_feature (354)..(355): n is a, c, g, or t
  misc_feature (369)..(369): n is a, c, g, or t
  misc_feature (375)..(375): n is a, c, g, or t
  misc_feature (393)..(393): n is a, c, g, or t
  misc_feature (396)..(396): n is a, c, g, or t
  misc_feature (483)..(483): n is a, c, g, or t
  misc_feature (564)..(564): n is a, c, g, or t
  misc_feature (573)..(573): n is a, c, g, or t
  misc_feature (603)..(603): n is a, c, g, or t
  misc_feature (621)..(621): n is a, c, g, or t
  misc_feature (627)..(627): n is a, c, g, or t
  misc_feature (653)..(653): n is a, c, g, or t
  misc_feature (661)..(661): n is a, c, g, or t
  misc_feature (701)..(701): n is a, c, g, or t
  misc_feature (707)..(707): n is a, c, g, or t
  misc_feature (743)..(743): n is a, c, g, or t
  misc_feature (760)..(760): n is a, c, g, or t
  misc_feature (768)..(768): n is a, c, g, or t
  misc_feature (773)..(773): n is a, c, g, or t
  misc_feature (825)..(825): n is a, c, g, or t
  misc_feature (863)..(863): n is a, c, g, or t
  misc_feature (900)..(900): n is a, c, g, or t
cgtgcccntgatttaggggcacagctgccccagcagaaacacactttcatacgcactcacnccccacccccagacacacccccaggtctctggaactngcccagggtcctgctgctctcacagccgctggacaggnctcaanttctaccctcacccccacccggcttcctagcgccctggacgcccacggcccctcttggacttcttggtccctgaggggggacggatggggagaggggcggtggtcgagggcggcggcggtggcaggagtggaggaagaggtagcnccgtgggccccggcaggctggggctgggccgaaacccctcaaaaggggagaacttgagggggctganngggacccgggggcnactgtngaggcgcctgggtgagcncanttgggctggaaggagaagccctccttgatgctgttcaggacagaaggcgccacgtatgttaagcccaggaaggcctggttggcactntcgctgagggctgtttcatcaggactgttcaccggcgtctgcgtttgaagcgggtttcaaactggctcacgtcctcctctnactgcaganagggcctgaaagggggtccacacgccaggncagaaggtcgtcccaatncatgtnccggaaaaagggatgtctctgcacancagccgcntcccctgggccacccccaatccgctggctgggattccgtntcaganactttttgacaaggtcccgggcatctggggtgaggnaggggggcagtccagcntgcccctnaaganctaatccatggttttcttccggttctctgcggtaaagggcggcgatccagtnagcatgttgtacataagggcccccaggctccaccagtncacagcccgcgttgttgccactgcgcaccagagtctnaggggccatgt

SEQ ID NO: 584303 - DNA, 961 bp, Homo sapiens
tccagatggttatggggcctttaatgaagacggcttcaattcaagcccgcacagtagcccgttttagcatacccaagacgatggcagcacatcatgagtgcatgcatgcatggtgtgggcaatctgtgcaaccattggcagcatcagacaaagcgttgggtcattaagaactgccaggcactcagcaagcaacaacatccacactagcattgcccagcatgtataggttcttgctacatgctcaagagcagttcacaaggcacaggctatgtggcagtcaccaccgcaaccaggattgtcaacaacatgcatggtcccgtttacatgacacattagttaattatccaccgaagtgagatgatatcagaagatggacacgaatgacagagagagtcccaatgacacatactatcatcacatggagagatgatgcaaacagaagatcactgatggatcacttgacgataatcatcaaacaagcacggacatggctggtgcccacatatagagacagtagaatgagtcgcactggccatccgttaacattgtcaaacgggcgcgaaatatagggaataaccatgacaagcacgaagcacatattcaagacacgggtccccgatcgtacacggacaaaagtcacaatggccagtctccctatataatggcacaaaaagtattggccacacttcaggaccacaggacaaccacatcgggggagaacggtcacgttgtggccagtggccccgtacgaacagttaaccgttggatacaccacccataataatggcacaacgcaacaccattgggcgggcacggggaaaacataactatagagaaacaacacggaccccacacaagcacgttcttgcaaacaagaccacggaagtcatgtgccaaaccagaacacctcacagagacaacattaccacgcgacaccgcacagagaatacaagaaccagga

SEQ ID NO: 584304 - DNA, 314 bp, Homo sapiens
gacatcggcacggcggtcgccgacaggatcgagcgcggcagatcgatgtccagacggacagcggcagccaggatcattcccggtcgcggcttgcggcactcacaatccgcatccggcgcgtgaggacacatttcgacggcgtccagcaccactccggactgcgccaactgcgcgcgcaggtactcttccagaacccggtaatcaccctgcgtatacaggccgcgcgcgatgccggattgattggtcacgaccaccagcagaaatcccgattgctgcagagcctgcaaggcggcgacggcaccgggaataaactc

SEQ ID NO: 584305 - DNA, 222 bp, Homo sapiens
taaaggcaaggtttgtgcagatacctgtggagcaatggaactgtccgggccggcacttgaaactcagggcagtccgggggctcgtctgagttagtccccgcagtcgtcctcggtgtcacacttccaccagaaggggaatgccttgtcgttcttgcatacaaactggctagccgtgcagttggacacaacagtgtgcgaacaacgctgctgggaaattgctga

SEQ ID NO: 584306 - DNA, 424 bp, Homo sapiens
agctcggtaccccaccacctgagtctggaagcactagggcgggaagccaccctcagcctcagctccaaatacgcatacaagccctccccgctgcagccacaccaaatggcgggggagtcaaaagctgggtagcacaaggttcctgggccagactgcatggagtctctggatctacttcccttggacatgtccactggggggtagggaggcacagacacccaagcctttgcctcaggcccagcaaacctgaaaggatgagaacagaggaaaccaataagcacgctagaagcctgggacccagggcagggtcaaccctcctggctgcttacctgtcacttgcataaagggatgtgtcaacttaacatcctacatttcctttttaccacaatgatacagggcattgcagtaaatgctaggaaagctc

SEQ ID NO: 584307 - DNA, 383 bp, Homo sapiens
  misc_feature (61)..(61): n is a, c, g, or t
  misc_feature (266)..(266): n is a, c, g, or t
tttttttttaatatagaatctctgtacgtcattttattttattttatttatttattttganacacagtcttgctttgtcacccaggctggagtgcagtgcagtggcatgatctcggctcactgcaacctccacctccagggttcaagtgattctcctgcctcagcctcctgagtagctgggactacagatgcccgccactaagcctggctaatttttgtatttttagtagagacggggtttcaccatgttgaccaggctgttctanatcttctgacctcatgatccgctcgccttggcctcccaaagtgctgggattacaggtgttgagccactgcacccagcctaaaatcattttaatttgtaagatatgtttactgtttta

SEQ ID NO: 584308 - DNA, 383 bp, Homo sapiens
tcctgtctctgtgagtgccttgctgcctactatccgtcaatatacaatgccctgggacagcgggtgaagtgggatgccagcctttcatttattctttcacctatttgtcctctttactctgtgtataaaaaaagagaggattatactatcatagactgttgcttctaaacagaaactcaggctgagcacagttatagttcactgcagcctctacttcccaggctcaagcagtctgcccacctcagcttcctttgtagctgggtctacaggcatgcaccactatgcccggctaattttctattttttgtagacagggttttcctgtagtgcccagactgggttcaaactcctgggctcaaatgatcctcccacctttgcattct

SEQ ID NO: 584309 - DNA, 188 bp, Homo sapiens
  misc_feature (92)..(92): n is a, c, g, or t
gcattaggcaaataacgcgcgaagagctcgccctgacgacgtgacgccctgacgacctgacggcgggacctaggctgaccggcatgacccangtgctctccgcggtggcctggccctacgccaacggcccccgccacatcggccacgtcgccggtttcggcgtcccctccgcgcgttattgcctaatg

SEQ ID NO: 584310 - DNA, 793 bp, Homo sapiens
gcgccgcatccgcacgtcagcgtattctctgaccggatcgcaatgagaagaagagatcgccgcgctggtcattgacaatgtgctccgtgcatgtgcaaagctggttttgcatggggacgacgctccccgagccttttttcctatccaatcaggtcagggctgccccagacaccaagaggacgtcactggtggagccatgggccagaacgtgatttcctacgtgggcgacgaggccccagagacaatgcgtggccatcctgaccctgaagtacccccatatgaggcatggacatccgataacccaaactgggaccgaccattgggacgagaggcattctggcaaacagaacacttactacgaaacgaagcattgcagctgttgggcaccccagagacgagaagccacacccaagtagactagcctagaacccagaagagagccacgcccagtagaaacggcccctcaaaaggaccaacaacaggacgacaggacacagaacttgaacataccagcagtataattgctacatagaaagaaccccataaccaaaaagaatacacacccaggatagaccagatagataacagctaagaggaccaaagtccaacaaaagagaccagcaagggcacatgtcacccaatacagtaaacagacaaatacaatagggggagcagagcaaccacaaagataggcaaaatatgcgtcaaaatgggaaacgatcatagaggacagaacaagagggggtacacacaccacaagaacaggggaggcaccccaaaactctaacgagaa

SEQ ID NO: 584311 - DNA, 278 bp, Homo sapiens
tagctgcatcttgattgtaaacggacgggagtagtggctcgatcctgcttgattacgagtgtacgagctggtaccttgctcttggcgccggagactgccggaggcgtgcccttacatttggcctgtgcttgtagggcatcattgtgcaatatctgagatgaatacctgggcagctaatggagatgagccgaattatgcgtgggtctgaggcctcgaagccagcacggttcaggtagtaaccagtcactgcatctgggatcgtaggcgtgtaatcttcc

SEQ ID NO: 584312 - DNA, 138 bp, Homo sapiens
ctcatagcactgcgcgcgcgccttggcactaaacttctaactcttgttttctagtaataatatgtgtattcgagaccatgaagatagtgggtctgtacagtctggggaccgccaggttcatccatgtgtgtggcctgg

SEQ ID NO: 584313 - DNA, 464 bp, Homo sapiens
gtatcgcgtaccgtctgagcagctgggaagccatccaaatgtggtcccggatcagggtgtgcccctatcctaccttcaatccatcctcggatgtcgctgccttgacttaaggccataatggttaaaggtgtggatgaagcaaccatcattgacattctaactaagcgaaacaatgcacagggtcaacagatcaaagcagcatatctccaggaaacaggaaagcccctggatgaaacactgaagaaagcccttacaggtcaccttgaggaggttgttttagctctgttaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcaga

SEQ ID NO: 584314 - DNA, 549 bp, Homo sapiens
aacaaaaggaatataccggtagtgccgcccgttctaatataataaagagacgcagcttacagagatcattgcggtccactgtggctttgacctcctgggctgaggcgggaggttcccttgagcctaggagcttgaggcctgcgtgaatatgatcgggccacttcactccaggctggccgacagagcaagacgcccatgctcagagaaaaataaagaagagacccgagaaccggaagggaggggcagagaaaaaaacaaaacacaaccgagcccgcgcgggaacgcccttgctcccccccacggcgggggggcgccagaagccctcagcaaagacgaaaccacacagaagcaaggtgcggggccaccccgcggacagagaacgcgctcccacatacccccgcaaacagagcgacaagcaaatcaggagacgcaacaacagcaaggcgaccaccacgcaccacacaccagagcccggtacacagaagacctagcaaccgcccagcgtaaccagagcccgtgcacacgcaccgaaccgactcaccccacccg

SEQ ID NO: 584315 - DNA, 104 bp, Homo sapiens
tacacgattcagctcccatgtgctgttccaaattccaagaaaacaggatggtgagcagcacagaaccctgtgcaggaccccgcttcttctctacgcgtgcctca

SEQ ID NO: 584316 - DNA, 246 bp, Homo sapiens
aatgtgcgcccatccatccaggaaagcagtgaacaactacagctgcatggcgccaacgttgtcgggccatccagtaaaaaaccgacaagcctgccttcgaccaggcggttgaccagagatagagggtgtcatgggtaacgaaagcatcaattgggacaagctgggttttgactacatcaagaccgacaaacggtttctccagacctggaaaaacggcgagtggcaagcgggcatgggacccacatt

SEQ ID NO: 584317 - DNA, 620 bp, Homo sapiens
  misc_feature (31)..(32): n is a, c, g, or t
ggatcttttagcacgaatgtcccagcgtcannccaccaaaccggtcaggcgacgatgacacccgtcgcgacggcgcgtctgcacggcatgaggaaatagcgctgcagcatcggcaccaggaacgagttgcacgcataggtggcaaagttaaagcacaacccggccagcaccagccacagaaaggtcggcacagccagcacgcgacggatcgggcggtcgacgcgctcttgggagacttgcaaggtttccgccgcaccacgcttgggttcttttatgtagaacataaacaccgcaaggatcagccccggcaccgccgcgataaagaagggcgcgcgccagctgtcgaacgccttgaccatcgcaccgatcgtaaagaacgccagcaacaggcccaacggcaggccaagcatgaaaatccccatggctcgggcacggcggtgggcgggaaagaggtcgccaatcagcgaattggccgcgggtgcataagctggcttcgccgatgccaatgcccatgcgtaccagcaggaaggtccagaaactggcgaccatgccgttgaacgccgtcagaccgctccaggggaacaggactcaacccacattcggggctcagggtacgagct

SEQ ID NO: 584318 - DNA, 299 bp, Homo sapiens
  misc_feature (264)..(264): n is a, c, g, or t
gatcatgtgaggcatttggagttgggcctgcactgggtaagtctgagtgaatgataacttgtaattatagggaagataagagatgccatttatgatttaaattgactgtccacaaaagtcatcaaacatttattgtgtgaaacatgctaaatggtaggactagatgttcagctgttcctagttcctggtggttctgtagcatgtgtttctgaactgtcatgttttcaggactgtgaactgtgtttccgttgctttcttttgtangacagctctggctctggctattgctcaggagcttg

SEQ ID NO: 584319 - DNA, 213 bp, Homo sapiens
gtataaggcgaaagaagttctgtgctaatctatgaaatctgagtatctgtcatctctctgcccttgactgtcacatctgctatatctctacttctacttgcatttgacctattccatgactcccacaagaaatgcattttatttaccatttacaaaattatgagaggatcatgattttagatcacctgacgtgtaaaacgcttgtggtgccga

SEQ ID NO: 584320 - DNA, 191 bp, Homo sapiens
gtgttgccaaataggccatgaaggctcctccatcactaataggattaaggcccttataagaggcttcacgcagcattcagctagcttgctttcttgcccttctgccttctgccatgtgaagatgcagcaggaaggcccacaccagacaccaaatgccagctccttgatctcagatttctcagagagagaaa

SEQ ID NO: 584321 - DNA, 225 bp, Homo sapiens
ccggacccttcggcgcgagcacaggattgtgggtgtgatccactgtgcctggcctgtgtaaactttaaaatagtgtctttaccatgagggatgatattgtaatggcagaactctggacagtgagttgaaagatcgaaagttgtagttcactttttccaccatcttgaagcttttagaggcctgctgggaataggacttctaaaaggcaaatatgtctggaaggct

SEQ ID NO: 584322 - DNA, 315 bp, Homo sapiens
gtcttcatagattgcaatgtggaaagacgtacgatagatacacgttcagtatataaggacaaaaaagaaggggatgcgttcaataccaaacagctgcttgatatggagaaataccgacctaacgatgcgattacgcttcacagataccaatgggcattgctgtgttcatgctagaaggaaatgttcaccagggctgacttgatttgtgccatttatagggaactcttggtaccttggaaaatgtgaatctggaatattacctgtgtcatctaagtagttgatggcttcagtactcctcagccactctcctagtga

SEQ ID NO: 584323 - DNA, 1099 bp, Homo sapiens
gatgactttgaagatgctacagaattggggtggatgatggagaagtattatggcatggcgtcatctgccttgagaaaatctccaatgatgccagaaaacgcagaaaatgaaggagatgccttattacaatttacagccgcgttttcttcacagatatggtgattgccatccgtgtcattaataattggctcattagaagctgcattttcaagaggccttcgtatgtgaaagcccgaggatagaacgcttcttgctatctacctccgaccatgatgcacgtgtgtaaaccaaccgatgtactgctcaccaaaattgctatggaggctgcaatccaaggtgcctatatctgagtcacaatttcactacccgtgggcttgggatctgaccacaggactccaacagagcacgctttctcactatgtgcaatagacacatttggaaagtgtatgtggacacaaaccattcggacactcaagacacacggatcaggatatccggtttatcctgattattatgggaaagtcgatcattgtaatgacgttgttgaatgtgatacaagggaacacaaagcagatacagctgcaggataactgaactgacgaccgcacatggcaggacaaacggcaagaatcaaaacaacagccccaaccaacaaggcaacggaatacaaaaagagcaccgacggaattgccaccgctcaacggccccgcacgcacaacatggtgaagagcagaaaccaacagatgacagacaacacaggccaaaacacacctaagaaaggacacagaccaagaagccaaaaacaaaaggagcaaatcaacagaagacgacacaaacgacacacaaccacgcgaccggcaaggcacgcacgaaacccacaaaacaaacacggggaaacaaggcgacaccatgaagacaccgacccgcgggccgacccctaaagaccaaatgccccggcaccccatgaaacaaacgacaccaaacaagggacacaacaaagagacgcgaaaacagacgacagaccaggaaccccccgacaacaggagaaaatgaggacaggcgagaaacacaaggcacaaaacaagagacacagaacagc

SEQ ID NO: 584324 - DNA, 1519 bp, Homo sapiens
tgcgctgcccagcatatttctgttgcgccacacttggaagcgtatacctcacgtccgtcgcgtggacgattaccaatacactcggggctgtttcttttcttagtccatagccccatatttggtaacggatatagtatcactgaggggcgggcgtacaacttcctctagcgcacaccgcgcggggtgggatcgcccccgatcataacgggggtgtcaactccatttgcttacgtggcccccacccacctttcgtctgcccctatgaagtggccccccccacaattggattttcggcttcatacacggggcgatcgctgtgcaataccctattagaaaggaaatatgctgaactcgaccaataccaagggctccttccatacacgagctgtcaatgttcaccgtctaaactcgtccagcttcctctctgtcctacacctctagccccaatacatctctcgctccttcgaacgtccatgcctcccacttggtggcccatattcgtgtttcaattccccaattggaaccatagcttctttgggcaacttcccctgcgggaatgggtaatccctcccaccttggatcacatgcaggtttcccaagttggaccccaatttccatcgtcgccccaacctccccatgatagtaagcctcgcctcgtgaaattaggccacccatctttgcgccgggagacaaatccttgtttgggacgctcgtactggagtcctcgcggaggggtttactttcgcaggaaacgcatgttcaagtggcctcattgcagctttcataccttgggacggcctgggcacatacgagtacatagttgtgcgcccacaggagctacactcccctcttgaaggtgcttgacacacgcgggatagtctacatcctcgtgtcatttggacacctctccactgtgtacgcccacaccctgcacaaatgcgtggcttcacgatgcgctggaccttgaccttgccgctctagagaacaacactgccatacactactgaatgacactcaagacagacgtggttagaagcacggacgctcaggaagggcccgcacttgcaaagggcatctctttgcggctctaccacatgagcaccacagcgctgcgtcttcgcttctgtagcattctctaccatgttgtacacgccactgcctcgccaccatgttgaccaggctcggtgcgcctgagcagtgtgccactcatacagaccacatttgtcaagcctctatttccttggtagagacaacagaattgtggactacagtcaacagggtggtggaaccttcatggcactaccatgagctctcccaatggagtaagagcgccctggacacatcagcacccagcaagagcatcaagaggaagagagagaccctcactgactggccactacctgcacactcagtccacccacacactgaatctcccctcctcacagttgccatgtagaccctttgaagaggggagggacatagtgagccgcatcatgtcaggacatcaattataaccttg

SEQ ID NO: 584325 - DNA, 124 bp, Homo sapiens
  misc_feature (53)..(53): n is a, c, g, or t
  misc_feature (64)..(64): n is a, c, g, or t
  misc_feature (78)..(78): n is a, c, g, or t
  misc_feature (88)..(88): n is a, c, g, or t
caagcacaccctgggagacagtgataatgaaagctaagcctcgggcttaattnacacaccaatnagccagtggggtgnacattcaccntggtccacccaaggccagtgcaatgcaatgttgggg

SEQ ID NO: 584326 - DNA, 414 bp, Homo sapiens
tgtatccagacattgtcaaacgctgttgtctgcccagcagtggcactgctgcagtggcccatcgcagggtttatcagatcccccagtgatgcaggctgcagggcaaagacccccgcttggccaccatggcttgacctagaagatgcaggctggtgaatgtgagatcttgctacgagtgtggacctgtgcttgacttcctgccatgggctgggcatgtgatttgacgtgccctgtgcctgccctcaatgatgctgtgtgagcttgtgtacgcaccctactggcaatgccagacttgcgcccggacgacgcctgtgagtggctgttggcccggtgactgtcttgggacactgtagtgcgactgacggacgtgctgttggacgctggccgctggtggtggcatgtgacgggacggga

SEQ ID NO: 584327 - DNA, 165 bp, Homo sapiens
agatacgaaatcgagccggtccctatgacagccaaattatcgatagtctggctgatttttctgtgcgtaatgtagatccatagggtaaacctgaataatcagtatgaagcatacccggcggatgggatccatacctttcatcgaatgggcacataaatcaggcta

SEQ ID NO: 584328 - DNA, 671 bp, Homo sapiens
  misc_feature (91)..(91): n is a, c, g, or t
  misc_feature (107)..(108): n is a, c, g, or t
  misc_feature (131)..(132): n is a, c, g, or t
  misc_feature (246)..(246): n is a, c, g, or t
tgatggtcctagctgactcttgagtataccctatatccgcaatgtagccaacgacgaagcctgtgccgacgtttatcgacaagttcgtcgnactgcaccaggtcganntaccacgcctgcggcctggccgnnttgggcaagcctgaaggctacgtggcgcggcagattcgcggctggggcgagcgctatgaaaaagccctgacgcccgacgcgccaaaatgggaggcggtacgcgcctggctcaangacaagatgcctgccgaccaccccacctccagcatcgtgcacaacgactaccgcttcgacaacgtgatcctcgacccgcacaaaccgatgcagatcatcggcgtgctggactgggagctgaccaccctgggcgacccgatgatggacctgggcaacaccctcgcctactggatcgaggccgcagacccggcgccggtgcaattgatgcgccgccagccgagcaacgcccccggcatgctcacccgcctgcagttttgtcgactactacgccgagcgtaccggcatccagatcgacaatttcgatttctataacacctacggactgtaccgtctggccgggattgtgcagcagatctactaccgcttcttccatggccagacccaggacaaacgcttcgcgcagttcatccacatgaccaactgct

SEQ ID NO: 584329 - DNA, 149 bp, Homo sapiens
tgtgactcgtggataccttttacagtggattgatattataatacccacttcttatgatgtacaggaactgaatgagtgtggaatccctaggaccccgggggaatataatgggccctcggggctttagtttctttccttcttgccggtgg

SEQ ID NO: 584330 - DNA, 186 bp, Homo sapiens
gaatgctgctgaaattcagaccaagactgaggaagaagagatgatcggacccctggggggaactggaaccactctgatgaagaatcctcagaagaagaggaagaggaagaacagctgactgaagacaaaccacgatgagacaggctatacttatcccctgcagacagctggccttactcacctcca

SEQ ID NO: 584331 - DNA, 279 bp, Homo sapiens
gaattccccccccccccccccccccccaaagacatcctggtggggggggtctactggttaaaaatcccctgggtttcccttaaagattgtttctatatttcaccttcatccctaagggttatttccactggatttggattcctgaatggagggtttgggtttagaatttaaaaatgttataccactccctcctggaatcaaccatttttggggagaattccaaagacccccaattttttttccccccatgggggatgtttaattggcccccctggatga

SEQ ID NO: 584332 - DNA, 154 bp, Homo sapiens
tgcttctggatcagctgaaggaggcacgcacattgctgaggattcagaccgcaactatgaagaggtggccaggaagctggtgatcctggaatgggagctggagcgctcggaggagatgggctgatggtggcctgagagcctgagccatgacagc

SEQ ID NO: 584333 - DNA, 446 bp, Homo sapiens
  misc_feature (3)..(3): n is a, c, g, or t
  misc_feature (21)..(21): n is a, c, g, or t
  misc_feature (37)..(37): n is a, c, g, or t
tcncctccgggaataaatttnccttttaatttccccntgacttttagaatacacacagtttttcccgacttttcaaaaaatttgattaaatggttttatagtataatattgggacccccataccgttagccccttgtatgtatcccaacactgcccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagccctgggtgacaagagcgaaact

SEQ ID NO: 584334 - DNA, 173 bp, Homo sapiens
gggctttttcggtatcagattcaagctggcattgctccctgaagatcgaaattcataacgtagctgcctaagggccggattggtgacaggcgcgaagccatctcctgtgcatgttcagggtatgtctctcggaatggcaggtgagcccggcgcaactggctttgcccaccgaa

SEQ ID NO: 584335 - DNA, 389 bp, Homo sapiens
  misc_feature (352)..(352): n is a, c, g, or t
aagttcttgggaactggggtccacttttccctcccttggggtcctcaagttttacttaacctgtgacgtaatgatctcttaggttacattcagccctaacattctgtgatttggtgaagctaactttaactagagattaaaggtgggatgtgaatgtctttagaatatcgtgctttaaaaaaatcaggagaaatatggagggcatttaagagactttctaggaaatagcgcttaacctcaggtaaatacttaaaactttgaaccatttcaccctcttaaggagctgtacaaggagctgaaagggcctcgttctagtgcctttgcctcctaaggaaggaatttttgttggcgntcaagggacagcccagaggagaatcattctccatcga

SEQ ID NO: 584336 - DNA, 1840 bp, Homo sapiens
ttgcgtcgtcgctgtgtccgcgattgtttatagggggtcgaccaccgccgtgtggtgtgtggatcctttctcgtctatggggtgttgcctccccccacagacgtgtggtgtgggttcgccccgactaatgtcgtcccactggggtcctcttggtggttagtaaagcgcggtcgtgcgctgtggccccgcccttgttgtggcgtcctttgtcttggtcccgtcgttgtcgcccttatcaatagggaggtgttgagtctggaagtgttgccccttcgtggggtgtgtggtccgcgaaagtatttttcccgtgtgccagacgccaggtaagtgcggcgatctgtggagtggttttcatcgcttgggcgctgcccacatgagggtatgtgctccccctgccgctatcgtgggggggccccccgcttaatggggtcgccacagattcccccactcttgtgggtgcggtcgcccccagcatcaatctccccggcaggaagaaattagtgtggggcgcccactgctgttgggtgtcctgttgtggtaataggtgccccccccccccacgactgttgtttgcccccgcccacaccatgagggtaatccttctggtgaccaaagagcaggtggggcggaccagatgtggtgtgccaccacaaccgcggtgggtgggtgtttctcacaaatcccccaccggtgctccggagtgtcgactcccgtggtgattatgagaatatctctcctccgcaccatgagaaacatcgtgtatgagtagggccggccccccggctgccaataaatagccccccacaatggtgggcgtcggcgagctctccacgctgacaatttcttgtgcacgcctcctacggctgacgccatccacacacggcgactggttcctaccgtggtgttgcctccccgccttatccttcctcggggccagccccacaaattctcgtgttgggcggcggcgctttgtgtcctcccctcatcccagcggttatttctccgtcggttgattatgctccacccgcagcggcgcagaatatggggtgtgggtcccggctgccgcgcctcggcggtcgcctcgtccgctgctgacgccttgttctcaacaggcgcctcttctgcggagaggggagaggctcttctacatcgtcggggttgtgtggtcccccgccgccaacattttgtcatctcacatcagagaagaggtggttgttgtcccctcagcgagtcttcactttctggcgacacacttttttctctgtgtggtgagattcctccgcagcagagaagagtggccgcgtgggacgacaccacagggttctcaacatcgtgagagtgtctccctctgctcacaggagcgcgacacacgctgtggtcacagctctgggcgctgtgataaaagcagagagtagtctcctcgcgctctccacacaactttcactctctctctctattctccacacaggagaagacctcttcccgggcctcccacacagagtaagtggagagaccacgctgtgtctctgcgctctgagaagagacactctgagaagactctgcgccacacccacagctctgtgagccgcgagacccggtgcacttgcccccgtctccggagaccgtcttaataaagagaaggagagaaaagctctgaggtctatcccctgagggagaagaagaaagaaatttccaaagcccttctcgctaagtttcccgtattggccccgtgcccaccgccccggcttttcggcatacgggcccaaaagagcccaggaagcccccaggaccggatggttgtataaagaaaaaattaagccctcctggggaccttggaatc

SEQ ID NO: 584337 - DNA, 426 bp, Homo sapiens
gaaatgaccacctcctccagtctgattgttctagtaccagttgaccttctgggtcttatgtcaagtattccagtaggtgggtctgaatagacattggccaaccaactacttggctggccttgggtcacatgtccatctttgaatgagccatcagaggtgaatgagccatcagaggtgccagatagcatcctgaaacatccagtgttacctgtcagtgggtaaatggggcaggttccctagaagaaggtaggggcagtagagacactatccccctaaccaagttaggtcatgtaaggccaggctgaacaaatttatttggcctcactgctgttttggcaatcattttactttcagatttttttttccttttaatctgaccctgacaataaagaaaggactggcgatttggtttcagaacaggatctg

SEQ ID NO: 584338 - DNA, 476 bp, Homo sapiens
  misc_feature (46)..(46): n is a, c, g, or t
  misc_feature (60)..(60): n is a, c, g, or t
gcttggtgtatgcccaaatggctgccagttttgtgcttgaaaccgnggcctggtggtgtnacacctgcaggaatttctggtctgcaggttgcaaaaccgtgagaaaaacatagtatctgggctggataacaccgtctctcatggcacagtccctcatggcttcccttagctaggggagggagttcccaactccttgggcttcccaggtgaggtggtgccccatgttgcttctgctcaccctcggtgggctgcacccactttctaaccagtcccaatgagatgagaagggtaccgcagttgaaaatgcagaaatcacctgccttctgcattggtctctctgggagctgttcctttttggccatcttgccagatcccatgaataaggacttttatagctaaagaggagaagtcagtacctgacttgagagcttcaaaggacaggctgactctcttgttagaggctaatgtagttggtg

SEQ ID NO: 584339 - DNA, 185 bp, Homo sapiens
agggttacaggtgttggagctggaagtactcgagacgagcatgggttggccggacagcttgtcggtgggtcacagggactgcgatctcctgatggtcatggctcggggccgcaacttctaccacattactgtcgtctttggctccctcggtgcggcagcgcatggttcgtgccaccgtgccacaa

SEQ ID NO: 584340 - DNA, 177 bp, Homo sapiens
tttttttttatttccccccccttttttttggcgggttttttaaaaaaaaaccgcccttggtgggtttttccctggggggggggaagaatggtcccttgaaccccaaaaaggggatttttgccctttaaggcaaaaccggtgggttggttccccaaacccataaaaacattaatggga

SEQ ID NO: 584341 - DNA, 842 bp, Homo sapiens
agcgggttgttgaatttgaaaccgcttttaatgaatgcttcttaacagactgatgtctattttcccaagaaaacaactgtctctattggctgctatagcctatgggcaaagaggcagttcttctgggtcttgacagcagatgttggacaaaataaccaaatctgttcttttgggagaaataatttacatttattagtacctatcatgttccagacatttaatatgtcttcttgcatcatagcaaaacaattgttggaggtagctattacaaccttcatttttacagataaggacattgagattcagaggttaactagcttaccccgtgtcatatagcaaagaaggatcagaagtgagaggtaaaagcaagtccatctgcctttttgatccatgcttcctctttgtaaactgggttgtcttttaggagtatatgtgtccctaatttagaactcaagaatctatatgctacaaaatgtaggagatgcaagctcttaaactattctaagttatttatgttatttatagggcttccttggcacccaagtcatcctattaaacattttccaggcaattctgaaagcatagattttttttaaaggagtatctaatttaatacttctcaagagtctttcaccatagaatccaagcaatttgacctgacctggtttttctttgacctgtagccatccaaagagaatcattattcctgttaactgattttttttaaatacatctttaagtataatccttcaatgagtgagagtaggaatttagaatttcaaattacttttcctttatctgcttagtgtcttttgcatgtaaaagtctttgctgttggatca

SEQ ID NO: 584342 - DNA, 263 bp, Homo sapiens
ccctgacaacttgatttttgctagttaaatggaagattttagcactcatcaccagtatgttaattgtagtacctaaagttctgaattcgttatttcagtttttctcttggttgtctgaacttttgtgatcctgaaccagctgtggtcagagaagaaacgccttaggaagccaagcaagtggcttttgatatacagaggagtatagtcagatatttgctcctagaaacaagagggacaggagcaggtcacaaggtagtccgctt

SEQ ID NO: 584343 - DNA, 199 bp, Homo sapiens
  misc_feature (129)..(129): n is a, c, g, or t
cccccagcttcatgtcttgccccatccctatcctgcctgatccctggatctccctcagatcccctcttttcagacagcgccaggccggggtggggccggggttggggccgagccccacagctcggcccntttcccttcttttttgtataatttaataaagaaatggtcgcgcttctgtttttaaaaacccccaaaaaaa

SEQ ID NO: 584344 - DNA, 139 bp, Homo sapiens
actaccgggatgcaggtttgacccccatcccagtgccaggtgttaaggatccagcaagtccgcagctgtgacctagatcacaactgtggctgggatctgatcgctggccgggagctccacatgccgcgagaccgccaaa

SEQ ID NO: 584345 - DNA, 646 bp, Homo sapiens
ttaaaagcttctacatatcaagggacactatgaagaaagtgaaaagacaacccacagaatgggagaaaatatttgtaaatcttacatatctggtaaggaactaatacctagaatatataaggaactccgatgctcgacaacaaaaagacaaaccaattttaaaatgggcaaaggacttaaatagacatttctctaatgaagatatacaaatggccgacaagcacatggaaagcactcaacctcatcagtcattatgcaaatcagcgccacaagaagataccacttcacacctattagaatgacgaaatagacctaggatctaaacctacaggaaaaaaaaatgaataatagagaaaataaatgttagagaggatgtggagaaattgaaaaccttcattcgttgttggtgggaatgttaaatggtgtagccactgtggaaaacagtttggcagttcctcaagttaaaaaaaagaattaccatatgacccagcaagtccactcctgggcatatactgaaaagaactgaaaacaggtgttcaagcaaaaactttcacgcaaatattcatcgcagcactagtcacagtagccaaaaaagaggaaacaacccaaatggccatcagctgatgaatgaataaacaaaatgggg

SEQ ID NO: 584346 - DNA, 1349 bp, Homo sapiens
gggctccataaacctggttagggttcttctactattaggacttttcgcttcgaatgcgaagagatcctaatagtatgaagaaatacgtacgcgataaagcgtggagatgactatatggcatgccctccatccatagcacacattcggagagaacccgtatacataaaatctagacgaaaaaggaaaggaatcgaaccccaccaaagctggtatgtcaagccaagccccatgagactccatgactttgatcaaaagagagcaaagaagagaaaaaaacaaacacacacaaaaaaacaaaacaacccgacgaaaaacaaaaggcgccgacgaggcgcggcgaaagaacaaccacgagtatactgcagaacactgcgcccaaggcgaacacagaaaacgaacacattgaaccccacaagaaaacacaggggacaccccacggctagacacaccaccagcaacccaaaaaccccccataaaagagagacaccaagacataaacatcaatcagagaaacaaccaacaggataaccaccggacaacataacggacgaaacgcggcaacaaaaaagcagagaacacaacagaagacaaaaaaacgaagaaacgaaacaaagcagagacacacagaaccaaaagaaacacaacacagacaagacaggacaacacgcaaaagaaaacacaaagaaaccccgagagacgaaaagaacacaaaaaaacaaaaggaagaaggacaaacaacaacaacaaaccgcgcgaacaccggagacaacaaacccaccgccgcagaaacaccccacgaaaaacaaaaaaagagaagaaaaacagcaaaaaaaaagaacgagaagaaacgaaaaaggacaacaaaacgaaacccagagaacaaaggccgaaaaaaacaaagaagaaaaaagacaaaacaaacaaaagagcagaagaaagaaaaaacacgcacggaaggaccgacaaggacaccagacaagaacacaagacaaaaaccaaaacaagaaaaagaaagaggcgacaaacgacgaccacaacgaacgcaacgcaccacagcagggacacaaacaaaaacaaaaacagacagagaaagacgacagagacaagcaaacagaaacgaagagcacaagaacgaaaccaaccacgaagcgacgaggcagcagagagacaaagggggagaaagggagagggaacgaggcagaaagagagaaaaagacgaagagaagaaaggcaagagagagaggcagcggacccgaggagacagcaagacggggagagggaacaaagcaaacacgaagacaggaagacagcgacaggcaaggaacaaacgaaagggcgcaaaaagaaga

SEQ ID NO: 584347 - DNA, 1162 bp, Homo sapiens
agaacaaacatcaaatatatgttgacacttgggtggaagaatggtgaactaattgatgctttatgaaaagttgatagggacagtgctccaaagaaatcagtttacaaatggataactcgttttaagaaggcataaggtaatgttgaagaagaagcccacagtggcagatcatccacatcagtttgtgagaaaaaagttagttcatggcgtaattgaagaaaaccaacaattaacagcagaaacaacagccaacaccatagacatctcagttggttcaccttacacaattttgactggaaaagttcagcaaactttatacctgataggtaccaaaaccattgcacccagatcagctacaaacaagaatagagctttcaatggaaattttaaataaatgggatcaggatcttgaagcctttcattgaaaaacttgtaacaggagatgaaacatggctttaccagcgcaatcctgaagacaaaacaaagcagtggttaccaagataagtagttcagttaaagcacaagaggactggttgagagcaacaggtcatggcaacagcttttgaatgctcaaggcactctgctgctagacttctgtacgggccacaagaatggtacgtgcttatcatgggagggtaacgagaaactttagccaaagcttcagcagaaaaaaccccgagaaagaacaagaaagtactccagcacaacaaggttcctgagacaatccctctcaatcaacacaggtccatatggcagacgtacgacggggaaacaccacggccgctcaaccccaacaggcactggactgcgaaccccatcatggacacacgggatcccaaccatatacaccaaataagaagggaaagacattataaactaagaaaaagggttaaaaacaaaagcaagagacaatcacaaataactccaaacaccgaagaggaccatcaagccaggggataaaagaacaggagaaaaccacaaagcgagatgaccacaacaactaaacatagatcaagaactcgacacattacatactaagagaagacgaaagtctacgaaagaactgaaaagacaccacgcataatacttatctatcctaccgcagagaccacgacacacgaacacacagatacaaatagaagacatgactgacgcagacaca

SEQ ID NO: 584348 - DNA, 232 bp, Homo sapiens
gggggggggggcccaaggggggtatttttgggtttggcccccccccccccccccttttttcccccggccccggcccccctggttttgggttgggggggcccttggggccccccccccttttgtttggcttggtgccccccggggggggggggtttgggttggccgggggggggccgtgtttttttgcccagcttttttttaaaaaaaaaaaaaagaagtttcccctttttta

SEQ ID NO: 584349 - DNA, 734 bp, Homo sapiens
ttaaaagcttctacatatcaagggacactatgaagaaagtgaaaagacaacccacagaatgggagaaaatatttgtaaatcttacatatctggtaaggaactaatacctagaatatataaggaactccgatgctcgacaacaaaaagacaaaccaattttaaaatgggcaaaggacttaaatagacatttctctaatgaagatatacaaatggccgacaagcacatggaaagcactcaacctcatcagtcattatgcaaaggacttaaatagacatttctctaatgaagatatacaaatggccgacaagcacatggaaagcactcaacctcatcagtcattatgcaaatcagcgccacaagaagataccacttcacacctattagaatgacgaaatagacctaggatctaaacctacaggaaaaaaaaatgaataatagagaaaataaatgttagagaggatgtggagaaattgaaaaccttcattcgttgttggtgggaatgttaaatggtgtagccactgtggaaaacagtttggcagttcctcaagttaaaaaaaagaattaccatatgacccagcaagtccactcctgggcatatactgaaaagaactgaaaacaggtgttcaagcaaaaactttcacgcaaatattcatcgcagcactagtcacagtagccaaaaaagaggaaacaacccaaatggccatcagctgatgaatgaataaacaaaatgggg

SEQ ID NO: 584350 - DNA, 968 bp, Homo sapiens
gcttctttggcgtcgccagtccgagccacatcgctgagacaccatggggaaggtgaaggtcggagtcaagcggatctgggtcgtaatgggcgccatggtcaccgagggtcttgcttgtaagctgctggtaaagtggatattggtggccatcaatggaccgcttcattgaactcaactacatggtttacatgttccaatatgattccacccatgggcaaattgccatgggcaccgtcgaaggctgacgaacgggaagcttgtacatctagaatggataatccacatcaccaatgcttccaggagacgatgatccctccatagaatcaagtggggcgatgctggcgctgagtacgtcgtggagtccactggcgtcttcaccaccatggagaaggctggggctcatctgcaggggggagccagaagggtcagcatctctgacgcctctgctgacgcccccatgtgcgtccatgggtgtggaaccatgaggaatgtatgagaactagctcgaagatcatcatgaatggctcctggaccaccaactgattagctcccctgggcaatggtcatccatgacaagctttgggatcgtggaaggactcatgaacgcagtccatgccatcactggcaccagaagactgtggatggccctccgggaaactgtggcgtgatggcggggggtttctccagaacatcatccctgcctctactgggcgctgcaaggtgtgggcaggtctcctgagctgaacggggaagctcactggcatgggctttcgtgtcccactgcgacgtgtccgtggtggactgactgcgtctaaaaaacttggcacatttttgctccagaggggtgaccaggtttgaggcccccaggttcggtccctgggcacggggttcctggttgggaccacccacttgggggggttgctcacagcttgggctctctgtgccatgtgccgggcgtgccgccgtac

SEQ ID NO: 584351 - DNA, 479 bp, Homo sapiens
ccttgctgggcgcggtggctcacgcctgtaatcccagcactttgggaggctgaggcgggcggatcacgaggtcaggagatcgagaccatcctgactaacacagtgagacactgtctctgctaaaaaaatatataaaaaattagctgggcatggtggcaggtgcctgtactcccagctacacaggagtctgaggcaggagaatggcgtgaacctgggaggcggagcttgcaatgagctgagaccgtgctactgcactccagcttgggcgacagagcgagactccgtctcaaaaaaaaaaaagacccgtctctctacaaaaaatgaaaaaactagcagggcatagtggtacaacctgtagtctcaactacttgggaggctgaggcaagaggattactggctgcagtgagctgtgatcatgccactgcactccagtctgggcaatggaacaagaccctgtctcaaaaaaaaaaaagttgtca

SEQ ID NO: 584352 - DNA, 1474 bp, Homo sapiens
taggtggacagaaagtaaaattaatgggtgagtataaaaaggggggcccccctttggaacccctcatgattgcaggccccgccatttgtccaagaggcgccacgagtgggggatgtacttgaccccacaagccatctggggatagacgccgctatttatcagccaccaatagtctccaaatatcatcacgcatgtgacacttggtggaacgccccatttctattagaaatgtgggatactatctgggccgcgccaatgaacaatctgtggacacttagggcccttgggcaggggctctcacaataccacttgcgctccactatggtattctgagcaagctagaggctcgcgagatgggcgactatagcataaaatccttgtggcacatatgtgtaagcacacccctggtggcccacaatgtacgccccatggaggggtctataccgccagaatgcgccacctcttccgagatatgacgccctgtgtgtcagcgggaccgccctgtgtaccaagcaccccaaatgcaaacaaggagcagaaacataactatatccttgggtcgatcagaatactgcacgagactaacgacgtgcggcagaccagcgggtggcgctaagagatcagccgcctagccacctccacgctgagactaaactgaggaaacacacagctcgcacatctcatgttaggcggcacgaaccacgatcgtgttctagatcatcaaccccacagtagatcacactacctatatgagggcggccccaacacacatatccgtccgacgagcaaacgcacctcacacaaaccgagggcacctactaccaaacaaacgacgaaacaagaagacgagcagccgacaatacggtaaccaagtaccatgcggacagaccacacaagtagcttaggagcacacaacaaaacaagcgcggaggacaaagaccgatcaacatctccacaataaattaggcgggccgcacatagatgcagcccaaggccccaccgccgaggaggtctacaccaaaacagatacgcccagaacaatcacgttcgcgcggccaacctccgacgggaagaaaccacacccccacactgcggcggaaccaagacacagcgcagcgaaacaacacatgtgaggagaagctaaacaagcggaggatgaggacatgcaacataaacacaacatacaccacgccggaggcagtaacaaacacaacacgcagagaagtgggaacgtaacgagagcaccgtcccccacacatgtgagctaacgaacaaccacacacagcaatggaatactcacctaacacaagagagtgcgacgcacccccgtcgagcacgccgaccagaacaatagcaccgggagcagccggcaaccgcgagtacaaacaacgaacctaaaccaacacgcaagctaacaacaatgagacacccaaccgcaccacgaccttcacaacaacaacaccaacaacgacgc

SEQ ID NO: 584353 - DNA, 173 bp, Homo sapiens
tacgagtcggcgagtgatcccgtgtgcgtggctctatgctgcctagagcggatatgaggggaggggtctgtgtagccacacaggtgagctgaaggggttgcgtgcccgacatgcttacttggccacgggtgtatctgaaggttcctgcctggcaatactgtagccttgcttgc

SEQ ID NO: 584354 - DNA, 693 bp, Homo sapiens
agcggattgtctccacctgacccctccatgaccatgcgtatccccaccgcaggtgaggaccctggtggaggacggtgtgggcacgagcgtgtggacatgtcaccttccccacctgctcagagtccaagggtcctgggctgtgaccagtgctctcttctgacctgcgggagatcatgcacgcttccttgtaatttcccgactgcagctgagcgctggatgtttggatgtttgacccgattggaggctctactcaggcatgcgggacatatagggaggaatgggtcatctgctgtctccggaagctcttgtgctgcaaagagagaaggatccgcgggtatctccctcctatactagccaccagtcatactacctagatgccttacgaagtcgcatctgacagactaccacacggagcaagagtgagcacctgccactctggaataatggagtcctaggaggtcttcgtttcaggacgaatggatgagcggctacactagcagcccatcagcgctccactagttaagatctcccatggatgcgtgacccccagtaagggcattgagagctctggggacaatctgcggtgctaagttctgtagcttcctctttgtcctggctgtatggactatggtccacagatgaatgaccaaaagagacacagtgagaggctacgttcctggctggaggggacat

SEQ ID NO: 584355 - DNA, 250 bp, Homo sapiens
ggcaaaggcagaagcccccgcgtggatgggcagcttccccagcagcccggctttcgggccgggcagtcgattcggggccagggaccaacctgcatggactgtaacctcacctttggagccggggctgggtgaccgccaatacttgccaccccgtcgagccccatgggccgtgcccccatgtgcgtgggcagggccggcagccctggaaggggcacttatatttttcaataaaagcctttgttttgcactc

SEQ ID NO: 584356 - DNA, 582 bp, Homo sapiens
ttccacagtgactagacattttttagacatttgctgttcttgcttagttttaaaaagggttatgggtatttagcccacatttcctcacatcttaccttgcctctaagtacaaactggatcgtaaaaacagcaacacaccatatttttctgcctccactccacccataattgtggcacctctattctcctgaatgtgtagacattcacccttttagcttcgttggctgtcaacccctactccgtgccctcccctaaaatactagaaaaacatcactgatccatcaaagtgaagtatcttatgagacttactgcagtatgagagaactctgccttaatggtgtctaggcagtgtctcagaggggaaatgacaggataggttattagggactaagttgggtggtttcagggcgggtcttgcaaggcaggcctctaatagggattgggtagattttgtgacgtaatagctgtagatcggtgggcatagcaggaggagaatattgaagcaagttttgatggggaaggtggtattcttgttaagtaaactcttttagttggtttacaattttcattttcaggaaaaag

SEQ ID NO: 584357 - DNA, 518 bp, Homo sapiens
tgtctcatggccgagctcgccccgcgagctggcccgagctcgcgccttgagttccgtcgcctgtcgatatttatatttaagacatgtcatataactacacagagaaatagaacatataaaatctgaggggttggaggaagaaacgtgatggactcatcaggaagaccagagctggagaggtccattcaggccaacttgacctcctccttgagccctttggcgttctggcttctcctccttggtattctcctcttcggtgacttctttcttctcctctgggtctaactccttttcatcctctgttttgactctcttggctcccctgaagtgggacgagtccttgcggcccccctctccctccttcttcagaatcggagaactcttcctcacaggcaatccggaagtcagaggagcagatcgagatgcgcttgtcagggtcgtcttcgtcctcatcgccactctcctcaggcatggcgtcctcaggaatcgcctgcatttgaaccgggggtgcgccgtga

SEQ ID NO: 584358 - DNA, 382 bp, Homo sapiens
aagaagatataattgggacaacggaaaagatgggtgcttgaaaagaacagagtagacaagcacttaaggtgtcagctagagaaaagatgtagatcactacagtgaggaagtggaaaaggagtcatgactaccaaccattatatgacgtagacaaaggcattataaaagacacactatgcaactggtagtgccaacaaataacatagggtagatgaaagggacaaattcctagaaaaacccaaacggttgaaccggactaaagatgacataggacatctgaatagacctcaaaacaagtagagagaacttcccaacaaagaaaagcccaggcactagccaaccacggcggacagcacggtagtcctagctacttcagaggctg

SEQ ID NO: 584359 - DNA, 311 bp, Homo sapiens
cgtctctagagtatccaccccctccccggggtaatactgtagaaggatgagaaacatatctgaggcagcaatcaggacgttaagcagagatctgaactgccacgctgccctactaaccccatctcagctgctctcctcacttcatgtgaaaactactccagtggctgactgaattgcttacccgttcaagcgtctgtccttttccatcacctctagagcagtctcttccttacatatagtctctccagcaaattagaatctatcaattgacactttgagtagcacctaatatgtgagattagtcctgtgca

SEQ ID NO: 584360 - DNA, 452 bp, Homo sapiens
  misc_feature (417)..(417): n is a, c, g, or t
agagtggaccacagtggagaggccccaaaccagcttttggacaggagcatgagcagctgcctaagtcacaagcagaacctctgtcaggagacaaagaaccattagcagacaccagtagtaaccagcggaagaagtttaaaatgcaatcagctgcattttccattgctgcagatgtaaaggatgtcaaggcggctcattcaaatgagaatctaagcgactctcaacaagagccacctaaaagtgaagtctcggaagggcccgtagagccctctaattgggaccagaatgttcaaagtatggagactcaaatcgacgaagcccaagctgttactcagcctgtaccccttgcgaataagcctgtacctgctcaatctacttttgcttcaaaaacaggggggatggagggaggaacagcantagcaacatcatcattaacagcagataatgatttt

SEQ ID NO: 584361 - DNA, 324 bp, Homo sapiens
gtcttttccacctttcaaaaaaggtgggtggaacctggaaacatggtttttaattaaaaattaaaaaaaagggtaggacccggtccgtttcaaagggcccaaacttttaaagtgggtgggggccctttttttttttccctcccttcaatttggaaaaccctttttttttttaggttggtttaatgcttttgggaccatggaaattggggattttttctctctccccccatccctgccatcaccaaaccctgggggtcctttgattgggactttgtttatccccccctgttgcctgctccttttaggaaaaggatattttttata

SEQ ID NO: 584362 - DNA, 143 bp, Homo sapiens
tgacgcctcaactccggcgtatgtgtctgacccaacaggatgcgcacatctcgacactccatcgagttgatggatgaactgttcccccatgccaggtgcctacaccctggaagagttctgcctgtacatcgccgcctaccgta

SEQ ID NO: 584363 - DNA, 762 bp, Homo sapiens
  misc_feature (440)..(441): n is a, c, g, or t
tccaaaaccagccgggaaagggccaggttaaacggtggggcaggcgtggtgtgtgttggcgtgtgtcggctgtggagcgagcgacgcgccgaggccgacgggtttgggagggtgggggaggggggctttctcctcgggaggggagtgtcttttggggcttaaagggccatggcccaggaatgggggcgctgggttggcttggagatccaggctcctgtggatcccggggcatcatgttttacttgccttaccttggtggacaacaggtaatatcccctgtgtttttcagggagctcccatgttgggggtgaaaaccagcaagggccacctgcacgcctcccagaattccgtgggggttttaccttttgattcccttcctttcagcaaaatgggggcggccagagccctttttggttccccccccctcctgggccctgtgnntgggagggggggtacccagtttccccaccattaaaacccggggcccgggagcctcccacagggggggtttcttgccaccagggtgggcctggtgcaggggcaaaccccggggcccctttttaattccgtccccaacccgggccccttagaaatggggccgttttttggggtgggggcccgccttagcctgcatggggccccccagccccgggggggggagggggcccgggtttgctttaaggggggccctcccctttttccgaaagggtttctggttggggccatggggaaggttaataaaatttttgggccccccccgga

SEQ ID NO: 584364 - DNA, 167 bp, Homo sapiens
tattctttgtgggttggcactgggcatatcgggaggatggcaggggctgttctgtggtgtctcgctgcggctggcccggtcagactcagctctgagctctgggagtatggggactcagcgctgggcactccttccagtactctgacgacgagggtcctggagctgac

SEQ ID NO: 584365 - DNA, 151 bp, Homo sapiens
gtagcacaatctcagctaactgcagcctccaccttctgggtgtcagtgattgcttctggctcagtgtcccgtagtagctggtgttataggtatgctcctcaagcctggctaatagtgtatttcgcactagagatagggtttctacatattc

SEQ ID NO: 584366 - DNA, 105 bp, Homo sapiens
gcctagagtactgctggttcctgtcagcattggcatcctgcctgtgccctctcttgtggctccacctacccatctacctgaatgtctggggtgtttggctttagt

SEQ ID NO: 584367 - DNA, 632 bp, Homo sapiens
ggggattcctgcgggatgctcgtcaggctgagggcgtgctcagcagccaggaatatgttctgtctcacacggagatgccagggacactccaggctgctgatgctgccattaaaaaactggaggaattacacatgatgggccaggagaaggccaaggatgagctgagtgcccaggcagaggtgaagaagcaccaggtgctggagcaagccctggccgactacgcgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagagcagcga

SEQ ID NO: 584368 - DNA, 790 bp, Homo sapiens
  misc_feature (422)..(422): n is a, c, g, or t
  misc_feature (507)..(507): n is a, c, g, or t
gctggtcaggggcgtaacggagtggtgcgccaaggtgagaggaaatccgtgacgtcggctgagctattcctgtcgcccaagccgttcgtaggacgtcgggaaatgatgcgtttcgtgaaaggctagactgccttttatgacatgggtgtgcactgctgtgggagaggactagtttgtatcgtagtggctcttgagtcacataatgctatggaccacagttagaggatggcgctcagtggtcacatagtgaggcaatgccaccaagcagatgaggcatcaatcaactcgtacaagagctgtccgttgaactaaagcagacgattatccttgcacacaactgttctggcagcgacatgagcggccatggaagcctcgagatcaaggagccttctcgaagatattacttgtgattatcctgtgtnaagaagccgaaagaatgtggagtcgtgttgggcgtgccagtcaatagggaggactgggaatcgaggacattggtgtacgaacagncagcaggttcttacgaggttactgcaagaagtgttcgaaagtggtaggaagctcgagatgtgactgagtggatgaacagaatggacaatgggtggtgtacatgcatgtagagcaaaggcgtttacgaaaatgagcgccattctgagtacaggtagttagaggaggcacatacgaagcgtggggtatcttccgttggtacgtgcccgcacgtacgtgtttggctatcaattggaacaaggctataagctagtagtttcgggtgaccaaaaagggatgtcgattc

SEQ ID NO: 584369 - DNA, 239 bp, Homo sapiens
gtcccctttcctccatttaaaggcaacattccttacccattagtttcagaaattgttttaagcaacagccccaaatgttgggtgcccccagccaagcattggggcccccatcctgcctggcactggttgatgggcccctttgttggttccatcagccaaagttttgccaaaggccccccagtccctttcccaggaggaccctaaaggcaattaaataatgtcctgttccattggcccca

SEQ ID NO: 584370 - DNA, 124 bp, Homo sapiens
tgttcgttcctgtttatcggggggtgttcaaggcgctgccgttcgccaagcgcctgagcgaatggctgatgaaccacacccacgaagcctgggttaccaacaacaagggctggatgaacctggt

SEQ ID NO: 584371 - DNA, 163 bp, Homo sapiens
accatttctattagctcttagataagattacacatgcaagcatcccgtaacagatgagttcaacctctaaatcacctacgatcacaagggacaagcatcaagcacagcagcactgacagctcaacaacgcttacgcctacgccacaacaccccacggagagga

SEQ ID NO: 584372 - DNA, 436 bp, Homo sapiens
aatctgcgctggacaagatgcgtgatcatatcatagctaagaacgtggctgcagacattgccgtccgagctctgtgaatcgtgacgccaacgcgttggaaggggtgaaggggacgttcagtatggggacttgcacagtgaagcaagccctacagtgaggccctggagcggaatctgcagacacatggacgcagtatacatgcgtagcgggacgtaatggatgcacacgttagcgcgcacttatgtcgtcaccgactggcgcgttaatggagtcggggcatgtactcatatggcccggatctgctacaaggtgatagagtggctttagtggcctgattgcagcctgtgatacattatgcgctggggtcgaggagcagttgcgtccactcacggccgcgtgcgagtgccctacactctccatagcagcatggtggcgt

SEQ ID NO: 584373 - DNA, 373 bp, Homo sapiens
tcgcacttggtgtccttagcgatggcacccagcctgttgaccacgttgatgacgaagctctatctccagtgcgaagatggggtacccaatgctctcggatctgtcgatgacgaacaccacgtgcagggccgccacagcgcttctcacagtcgcagcacccgcagctctccctcacgtaggtcatgacgtcacactccgtgagaccggcgctccagggaggccagactcaccctcgggtcctgagactcctcttggcccccgagggcctggctcaccagggtgaccaggatccgcaggctctcctttctctcctttcctcccaggatctcctttcaagccaaagtcgcctcggtctccctcggggccgctgagc

SEQ ID NO: 584374 - DNA, 469 bp, Homo sapiens
  misc_feature (1)..(1): n is a, c, g, or t
  misc_feature (12)..(12): n is a, c, g, or t
  misc_feature (271)..(271): n is a, c, g, or t
  misc_feature (359)..(359): n is a, c, g, or t
  misc_feature (464)..(464): n is a, c, g, or t
nttcggcacggngacactttactgacttgattcctaattctcacagcagtcattcagaatatcactgggtattgtcctcactgttttgcaggtgaggaaagtgataatcagaggattaagcgagactctaaggctgctaggcaagtggtcaggtcttaggcttcagcttgccctttttccactgccccatccagtcagcagctgactagctgagggattacaagcaaattgcttcatctcttgggtcttcatctgggaaaggtctcaagtngttgttgtgaggattactctgtaagcatcaaaatttagataaatgtctgcaaacacttgtatgtattttcccacctatggaatttctnaatactatggaattaggccaggggcaagtgtaacttaacccattttacagggtgaattaggctggagccttaagggtagtcactttggtcttgggtcagtaaggnccctt

SEQ ID NO: 584375 - DNA, 1051 bp, Homo sapiens
  misc_feature (1)..(1): n is a, c, g, or t
  misc_feature (346)..(346): n is a, c, g, or t
nacacagacgcggttcccgggggttttaacgcccgtggggtgggttcttgcgcccccccgccccccccctgggggggggccaccccctcgcctgtgctatccgtgtgggacacccagggcccataccgcgggcgcccgcacgccgtggtggtgccgccgccggagttttcccccgccacaggccaggtctatccgcccccccccgaagggggggctccccgttcttgcctcctgtgagcccccctttcaatgggccctggaggccccttggccccgcaagagtgtgagagcgttttggccgaaatggggtctgcccccctggggacacaagagacctgtcccccanccatggagaaagggtgtcacacaaagatgtttggaggggcaccttcccggggaaagaccccccctggtcggatttgttagcgccacagagatgcacacaataggctcggcgtttcccgccccctgtgacaggtgcacacgtggcttctctttcggggaagtcgccaccacctgctatgaggcccccgcagcctcgaggtgagggaccacggcccttcttcacgagccccacgtgccactgccccctctgtggggccaccccaccacctcgaggagccaccctcgcccccaccccccacgcttatttgttttgagagttctaagcccctccccacttgttcccagaccccttcccttgcgacttccccaggtggccctcgagacccacggagcccacacacatggtttaagggatcccacggagtcccccgcccctggggttttggtccctctcgcgcccatccctgcaagggattgcccccccgtcttcccagaccaccccccctgaggggggcacccaggtttattgctgctgctttcacctgctgcacccgcgccctcggccggccccccgaggcacgcctttgtagctctgcttgcggaggggctgggaggagccctccacggagcacattcccacccctcccccactgctgcccagttgtagctatagctaccaaataaaaaacaaccttgttttcccaga

SEQ ID NO: 584376 - DNA, 270 bp, Homo sapiens
ccgtggtatattatgcttggttataatgtttcatcttgaccttgcggtactatatatattgcgccaggtgcgaatatctatagcgtatactgtatgtgggtaaatggtttggctaaggttgtctggtagtaaggtggagctctctctctctctctctctctctctctctctctctctctctctctctctctctctctctctctctctctctctctctctctctctctctctctctctctctctctctctctctctctctctctctctctc

SEQ ID NO: 584377 - DNA, 574 bp, Homo sapiens
caggaaggaggtgggctcacgtgcggcctggagaccatcgcggcagctccaagtgccgtgctagacccgctcaaggcctcatgaatcctaggacaaacgtgctgtgaagcgatgagtctcgagcacttagcccacaatgttcccatgatctacggagccaggattctggaacttttcatgtcatgccacggctcccatgcaaggaatatagatgctgaggcagtcttgcactgccagcgagcccacatgtatctgggcccaaggccagagggcctcagagagatagcctgagctaccgtgttacctcctctggccctctggctggccccaggagcctttggattcagtaaacgatcccagggtggttcccagcaaagctgcttcatctctgctctctacgcatcctgtcctggcgggaagagagcgtctgggtcacattcaagactctgatgacacccctcccgaggcactcccactgccggggtcccaggacccattcccccttcacctggtgacaggaacactcctttcctggtatggacgtggctccataacacgaggatagtcatcttcc

SEQ ID NO: 584378 - DNA, 142 bp, Homo sapiens
tatgtcgtcagtggatgtctcatgatgtctcatggatgtctcatggatgttctcatggatgtcctcatggatgtcctcatggatgtcctcatggatgtcctcatggatgtcctcatggatgtcctcatggatccatgagaga

SEQ ID NO: 584379 - DNA, 1018 bp, Homo sapiens
gcttatgaaccacagggtgcctccggatatgattattcctatgcaggcggtcgtggctcatatggtgactcttggtggacctaccacttactacacaagctaactattcccaaagcacttcggctggactctacttatcggcaaaggtggctcagcggacttaaacaaactccgctcactgagctcgcggagccttccgatcacaaacttgatgacgcccttctaccacacggattccgacaccatcggcatccatttacccacttccacagcgcacacaccagcgcacccacgaattacacgcaatgccacaagctatccctgcctgcagcaaaccagccgctgcacccccacctacctgcccccactgctccgccacggcactccttacactgccacagcactactccccctcccctccccccctactacgcctgctcgccacgccacgctactcccctggctccacacgctcccctcccccaccccaccctcagcctcgaccgcacaccttgaccccgcgccgctcccctggcccctccctctcccccccccccctccccactcctcgccctctccctgctccctccccccaaggcccccccccctattcccccttcctcgcctctccatccaccccgccgctcccctcgcccctcctcgacgcgctcgtcccctccgccccctcctcctccgctctgttcccaccccaccacctgcccccctggccctccaccctcccccccttctacacacccccacggccctctgcccccccgcgccccccagccccccccgctccccctcaccaccccctaccccccttctgcccccccctccccccccacacaccccacccccccccccccgccggcgctccgccctctcccctccctcccccgcccctccgtcccgccccgcctcccccacccccttcctcccccccctcctcaccccccctgctccccccccctcgccctcccggggcccccccgccccccctcccgccccccccccc

SEQ ID NO: 584380 - DNA, 273 bp, Homo sapiens
tttcagatgtggatagtgttgtcaccttaggtttgctggtaaatgtatctgctgtagctgggctagagatcacacagctggtcacggcacagcacagcagctgaattaatagaccggacatgaaagtgtttgcttttcaaagaactggtaaaaccaaggcgtgtacagaagctgtgactgaacttcatccagaggacactactccctcaggttccttcttctctctatgcgccgaatttaagacaccttaattggtaggggtatggctctgat

SEQ ID NO: 584381 - DNA, 100 bp, Homo sapiens
  misc_feature (3)..(4): n is a, c, g, or t
ttnntgactacgtctactatctctacacaagggtgttactgaataatgctaaaatcatttttctgcgaaaacataatgcgatatcgctaattaaattggg

SEQ ID NO: 584382 - DNA, 334 bp, Homo sapiens
atggcgtttgtatgttggtttgtttgagacggggtttctttctctcgatcacctaggctcgagtgcaggggcatgatcacggctcactgctggctcgacctctcaggctcaagtgatcttcccacctcagcctcccaagtagctgggaccgcaggtgcacaccatcatgcctggctaatttttaaattttaggtagagtaggggtctatgttgcctaggctggtctcaaactcttgaactcaaacaatccttccatctcagcctcccaaagtgctgagattacagatgtgagccaccacaccatgattgcattcctggataacacgttcacgag

SEQ ID NO: 584383 - DNA, 447 bp, Homo sapiens
atagtaagtggcagataaaacctcaaagttgggccgggcgcggtcgtcacgcctataatcccagcactttgggaggccgaaacgggtggatcacctgaggtcaggagttcgagaccagcctggccaacatggtgaaaccccgtctctattaaaaatacaaaattagcctggcgtggtggcgggcgcctgtaatccaagctgttccagaggctgacaggagaatcgcttagaacccaggaggtggaggttgcagtgagctgagatcgcgccactgcactccagcctgggcaacagagcaagactctgtctcaaaacaaaacacctcaaagtttgtgctctttctactacataaaaatatctcttcattaatgtggctgaattctaagggcctgtgccataggggttacactacacaataaagttcgagaacatttgcctgtaaaaaaa

SEQ ID NO: 584384 - DNA, 414 bp, Homo sapiens
  misc_feature (45)..(45): n is a, c, g, or t
  misc_feature (395)..(395): n is a, c, g, or t
ttataaagaaaagaggtttaattgactcacagttccacatggctngggaggcctcgggaaacttacaatcatggcagaaggcgaaggagaagcaagcacttttttcacaaggcagcaggagagagagagaactgccacacacttttaaaccaacagatgtcatgagaactcactctctatcactagaatagcatggggaaaccatcccccatggtacaatcacctcccaccaggtccctctctcgacacatggggaattacaattcaagatgagatttgggtgaggacccagagccaaaccatatcagggtctgaatttattctgttaaatttgaacaggtaggtctgacctaggcaaaagaaagaattttcggttccttggatggttcaagggngttttttttgcttcattcc

SEQ ID NO: 584385 - DNA, 216 bp, Homo sapiens
gctctcgcggtcacgcatacttactcttctcattgcattcaatacggacgtctcaagcgtgcgctcaccgctttctacttctcccatacttgtcttcgcttgtttttccttttctctctgaaactctgacaactacttttacttttctactcttgtttctactcttccccttttcttctcacgtttggccgtactacaccgcgttgacggggtacc

SEQ ID NO: 584386 - DNA, 215 bp, Homo sapiens
ccacgcgtccgcccatgcgtccggcattattctagcagcatccattcttgtttaagccttccagtgttagagatttgaggttacatgatatgctttatggtcataacttatgtggctggagaattggtattgcatttatagcatcagcagagcagataatgtgatgtattttatgcatgtccattaagggatgacctgttcttgttttacagaga

SEQ ID NO: 584387 - DNA, 146 bp, Homo sapiens
ccgtacattccacctcccttcgcggcagccctggggtggtgtacggttatgtgaccagctgtggatggtcagaagtcgtcgggaactgaagtcaggccccagcccatgccccccagcccagctccagccatgcgctggatcgcgca

SEQ ID NO: 584388 - DNA, 150 bp, Homo sapiens
tggatgaatctgaaatcaagttggtattgcttgaagcagcgccaacaatttttaacatgctacaagaccgtcgtttggctgacaaggccttgaagtacatgactgacaacggtgttgatcttcgcctaggtgccatggtcactggtgttg

SEQ ID NO: 584389 - DNA, 155 bp, Homo sapiens
ttagacgaacccgagctcgtacccattgccaacttctttgtctccgattgcagaaatcgtagcaacctgtgcaattttttcaggggtggtcacaggtttagactgcttttgaagttcagcaattacagcatcaacagctaacatcacacctctcc

SEQ ID NO: 584390 - DNA, 154 bp, Homo sapiens
attagcacactgttaccccgctcccgggagatcacatatagatgccgaacttagtgcggacacccgatcggcatagcgcactacagcccagaactcctggactcaagcaatcctccagcctcagcctcccgagatagctgaggattacagagcg

SEQ ID NO: 584391 - DNA, 343 bp, Homo sapiens
tgtgatctagaggatccctgccaggttcttaccttgcgtcagaagatccggaaaatacaaccggtgatttcggagtcccatatcacaagctacaagcagaaccccgagcagtctgggggatgaagatgctgagaaaaaggaggaggattcagaagggctcttccggatgaggatagaggatgaggaccggagttcaggtgctgcaacttttctggaagaaagaaattcagacagctcgcttcgtggggagagttcgcaagtttcctcaaaagagagtggatgatgacagatgaggacctcagaaagatttcgcgaagatgatgagagccggggaccacagggt

SEQ ID NO: 584392 - DNA, 221 bp, Homo sapiens
acgaacaggctcctcctagagggatatgaagcaccgccaggtcctttgagtttaaagctggtggctcgtagtgtcctgggcgagcagttttggtggattaaactggtggaggttaagtggcaaagcatagtgggggtatctaaatcccagttgtgggtcttaagctatgtgtgtatccagtatatgttaaaggccacttccggtagccaatcaacaggggt

SEQ ID NO: 584393 - DNA, 195 bp, Homo sapiens
tatatactgtgcgggcttgacctctcctccctaagagagtatgtagaacggtctccaagaacacgtggcaacaggctggatgcagcggcctcacagctgtaatcccagcacttgggaggccacggtgagcacgactcacctgaggtcaggagctcaagactagtctggccaaccctggtgacaccctgtctctac

SEQ ID NO: 584394 - DNA, 228 bp, Homo sapiens
cagaggctccaggttcacgtgaaaacgggtagacaccagaactgaccccatcagggtgatagtgaagattagatgatttgtacacagttcactgctacctcatgccttcttatactaatccagtcctggttttgtgttcaggcagcctatcccagagtaatcagatgtggtgcaacgactaagccaatccaggaaaatcctgttccattgaatttccattaccttgca

SEQ ID NO: 584395 - DNA, 759 bp, Homo sapiens
tggttaccaaaatgtgaaccctgaaaatctgacgacaggtctcagttaactttagaaagtttagtttgccaaggttgaggacattatggccatgatcacaacctctaggaggccctgtatgatatatgcccaatggtggtgagagcacagttcggtttgtatacattttagggcagacatacgagacatcaattaacatatgtaagatgaacattggttcggtttggaaaacgcaggacaacttgaagcagggcagggggcttccagagtcatacggtcagatacagagcactacattcggttgcacttctttctcgatgtttctcaattagcctttccaatgggaggcaatcagatactgcatttatctcagtgtgagcagaggggtgactttgcatagaatgtgagcgcaggtttaacctaagtcagttcccagcttgacttgtcccttttcagcttagcgatttggggggcccaagatattttcctttcacaccagtattgcacctgtagcttgcttggctcctcagatagggctgacagcttgaagcaatcaaaaatacaggatgcccaggttaaatgtgcatctcagatttaacaaaaactaatgtattgccagtatacaatatgtccaaagtaattcatgggacacccttatagactggcaactctgctctagggagaacctctaagtactccctgattgggccatttgatgtcttccatcttctgggtggattcaagtcagcgaaagcatca

SEQ ID NO: 584396 - DNA, 492 bp, Homo sapiens
ccaccaggcgcacttctcaccactctggttgtctgtattgttgtctctagtacagatctgccacaagtccttgctaactttgcactctcccatcgccacccctttccctcacctacaactgttcctggcactgacgacagggcacgctaaaatcagtggctctcccatatacagtgacacagtcactcgtgctgccactgctgtgtctccaggcacccaagtctgaccagcgccctgaattgagctaagccaccttctcacaacttccacgatctgggtcctcccagcactcgatggcacagctaatgcgagtcgtatccattgattttgctcgccttctggggaccatagctggttggtcaccccacctcctcgaaaccgggtacgggggacacaggtctctgttgagacatcccataccctcgatagcagcatccacgggtgaagctgagatcagccgccctgggtccgagctcgaagtccttctcatgg

SEQ ID NO: 584397 - DNA, 292 bp, Homo sapiens
gagtgaataccaattaatggactggatacccaatgcccagtgtccagttctggcggtgcttgcctgtttccagtcagcactgcctacgagaggaaggctggcaatatccgtcttcttcaaaggagacaagcattgggtgttgactgaggcgtcctggaacctggctaccccaagcacattaaggagctgggccgagggctgcctaccgacaagattgatgctgctctcttctggatgccacgaataagtaatatcatatggtatttgtctattgccagaaccacaaatatcg

SEQ ID NO: 584398 - DNA, 1541 bp, Homo sapiens
tctgggtacccggctctgcatcgcgctcgccactgcactgggccatcgctccagtgcctcgtgcctcagccagcaacacaaacgcgctgcaactccggcacagaacacagcttcaacctcctggaaaccatcaactgcctgccaagcacctactctgcacgcactactcacctcccgacacactgctattgcggcacccccaacgctccactgcactgcaacgcactgccctcttctgcgcaccccccaacctgcggcagcgcacctctgctgcacctgcacccaaactgcactgcgccacaactgcccattctcttccgcacgcacgcactctcacacgctcccacgccaactcccaagccgcgcccaacgcgtcccactgcacatccgacacaccttctaggccgcgggaaccccatgggcactgcaacacgcagcggcttgcggacgcaactgcgagaaccccagcaagttccagcgctaagacctcttacgtctccctcgtgcccacgcggccgcacacattggccttggttcgctgggatatggccgtggaacggcgacccttatcccggtggcgggaaggcccactggtcgaaagcatttggccattcgcctgcgtaaatgcaagatggctgtgtgtgtgggaagcttcccacaggacttgcgcccctttcttaacctcccagggcgcaacgagcgggtgtcgccacacattctagggcgccaatcttaggcaaaacttcaagcatcggacacttcccgacatgaccagaatcgtacctccggcttacacaacaacgcggtacacaccagcacactattacgaacgctgttaaatgttctgccgccgaaaagcgcgttcctagtgaagcacaacgattccgtaaagacgttgccaaacccaaacgcgtctcggcaaccttaaccttgtcaaacatttggaccgcgtatgtagaaaagcccaatgtttcccaactgttcccagacacgcccagtcgcgcctcattcctcccataaggcttcttacacctgatataaatctccgaagaacaaccggcccccgaagtcttttcccgcaccgctgattccccccgaccggcttggacagactttcccaacacttatcccccttctatgatcgagcggcgcccctttttggaccgtacaacacgcacaacgctttttcacggcgcgcccccctgtagagggccacacatttggcccattggccctccccccaacgccccaaacacttggcggcgcttaaccccacgagggccactcctcccggcacacccgcccgcacaccgcgaacaaccgtcggccggggccacccggcgccgacaccacacccgcgcacaggaccacacatactccgcgcacaccccacacgctgtacatcacgaccgcgccagccactagagcagctgactacgtcgtgctcgccacaaccacgaccacacaccgcccctagtgtcgccgcaccatcaacctagccacgcgccaaactacttatcgatccccactgtctgagtcgg

SEQ ID NO: 584399 - DNA, 313 bp, Homo sapiens
  misc_feature (157)..(157): n is a, c, g, or t
tctactaaatggctgttttcttaaaacatgctccactccaaataaatcacagtcaaataatgaagagctcagatgacatcagtcccatttgtcttaaggtcccggtggtgggtggatgacaagccgaagccagttatgatgaccggtgatagatccnaaataattggcacatttgttaacatttttccatttctaaaccatccttaaagaaaatcatatatggggtcacaccatcctcacggtagtccaatagagcaaccatgccatctggattcatgttttcaccaataaagaactgacagccatttaggta

SEQ ID NO: 584400 - DNA, 429 bp, Homo sapiens
gacttagtctggggaaggccaggctcaggaggctctgccccagtcaggtgccctggacccagaactcaaagtcagccccaaggaagcaggcagcatgggaagcaggatggcagagctgtgccaatgggaaatcacagatccagaaggaaataaaataaagggtaccatggcagacatctgtcctggggaggaaactggagtcccatctgaggaatctggcctcctggctctaacagcaactcggagagaatttttccccacagctcctgaaaaaccactatgccttttagtccatgggcctctggatcacttctttccagaaagcaaaatcccctgcccccaaggtaagcaggccagccagtactttcactctagaaggtgtcagagaactacaaggaccttcagggcttgagccaaggaccagcttag

SEQ ID NO: 584401 - DNA, 124 bp, Homo sapiens
gttcaggaataagccaattaattaaccaagcatggttggtttaaatgcttctggtggccagctgcccccggtcgggcgattcggtccagatctcttggtcccttcggtggtcttttcccaccgg

SEQ ID NO: 584402 - DNA, 296 bp, Homo sapiens
agtagcgggactatagtcggtgcagcatgcccagctaattgtttgtggtgtttgtttggtttttggagacagagcctcgactcgtggtgcccaggctggagtgcagtggcgcgatctcggctcactgcaacctccacctcccaggttcaagcaattctcctgcctcagcctcctgagcagctgagattacaggtgtgcaccaccatgcccggctaatttttctgtatttttagtagagacggggttccaccatgttggccaggctggtcttgaactcctgacctcaggtgatccgc

SEQ ID NO: 584403 - DNA, 152 bp, Homo sapiens
  misc_feature (18)..(18): n is a, c, g, or t
  misc_feature (79)..(79): n is a, c, g, or t
  misc_feature (88)..(88): n is a, c, g, or t
  misc_feature (108)..(108): n is a, c, g, or t
gtgaacctgcggaaactncgcggctactacaaccagagcgaggccgggtctcacatcatccagaggatgtatggctgcnacctggggnccgacgggcgccttctccgngggcatgaccagttagcctacgacggcaaggattacatcgccct

SEQ ID NO: 584404 - DNA, 355 bp, Homo sapiens
  misc_feature (205)..(205): n is a, c, g, or t
  misc_feature (292)..(292): n is a, c, g, or t
  misc_feature (301)..(301): n is a, c, g, or t
  misc_feature (318)..(318): n is a, c, g, or t
  misc_feature (354)..(354): n is a, c, g, or t
tgaaaaccatcagaaaactgggtatagaagaaacatttcaacataataaaagccttatattacaggaccatagctagtatcataatgaaagggggaaaattgaaagcctttcctctaagatctggaacacaacaaggatgcccattctcaccaccattattcaacatagtactgggaagtcttagctagagcattcagacaaganaaagaaagtgcatcccaaattgggaaaggaaaaaagttaagggggggcccgggtacccaattcgcccttttagttgagtcgtatttnccatttcanttggccgtcgttttttnccacgtcgttgacttgggggaaaacctgggggtttnc

SEQ ID NO: 584405 - DNA, 204 bp, Homo sapiens
gtgtattcacgctactgcggtgcatgcctccctggacaaggttccgtcgacacgtgagcaccggtgcttgagctccaaatatcgttaagctggagcctggtcgacgtgtattcaccacgtgcggtgcattgcctcccatgtacaaagttccgtagcacacgtgagcacctgtgctgacctccaaatatcgttaagctggagcct

SEQ ID NO: 584406 - DNA, 351 bp, Homo sapiens
cccgtagctcgatcaacggtagtcggtgcggacatcgtcagcgcctacggcggcacggtcaaagtgctggggttggttgaaaacagctccaccactgcgattgtcgagaagatccgcaacaacgagtgataccccgtggggcgagcctgctcgcccctagcttttcttcggcacgatcttgcgcagcatctgccgtgccttgccggtcaagcgcttgagcttcgagtctttttccggttctgccaggccctgctgcctgagccaatccttccagcgaatccgctcatcgcgcaccagccagccttcttgctgggcaaaactttccgccagatagaggccgcgcgtgctggc

SEQ ID NO: 584407 - DNA, 370 bp, Homo sapiens
  misc_feature (1)..(1): n is a, c, g, or t
  misc_feature (255)..(255): n is a, c, g, or t
  misc_feature (280)..(280): n is a, c, g, or t
  misc_feature (315)..(315): n is a, c, g, or t
  misc_feature (324)..(324): n is a, c, g, or t
ntgctgcaggcccagggtggctgtgatgctctgttagcacacagacctttccatcaagttcctgccagtggcctgccgtgacacagcacccagagttgcagctctgcagcctaactcccccttggtactttctgaactgcacagctgccatcctccactcctcagctgtgaccctgaccattggcactgcaggagctctgccaacctgtagctggtggcgtctcatctgtggaaacctttgtttttgcaccctcnagtggttgtccttgttaacatcagnacatctgaaaggtcaggcagaggtagggtttggcntggtgtttntaccctgcaaagggtagagaaaggtgtttccatgacctgaccagat

SEQ ID NO: 584408 - DNA, 477 bp, Homo sapiens
gcttatccaaaaagaatgtcagcatgacctggtgtagacttaaaaaactacatgtttgtgaatattttataatgtggaatgatcattgaaatatcaaggattctagtaattgtatttcctgaataaatgtatgtttatgtattttctaacttacattttgttgtgtcctctgcctacaatctggttttattattgttgtttccagtttgctagtagtgtttattgcccggttatccatgttatggttaagtagtgagacaaatctctcattatttttcgagaactttgatattgatttgcaccgccccagtttccttcaaccgggccctttccacacccgtccgtgtctgcgctctcggtccacgccagcctgcaaggtagcctccgcccctctcacaggacgcatagtttgaaggcccccttctcgctctcggtgtcttgtaccagtaatctgccatcgtggcccgcccgggccag

SEQ ID NO: 584409 - DNA, 129 bp, Homo sapiens
cccgctcggctgccagtaggccagcggctgcgggtgctcggcgccaggaaggtcatgccgacattgcggcgcgcttccgggtgcacggccagcacgtctgtccagcagatactgcgcatcatccagggt

SEQ ID NO: 584410 - DNA, 385 bp, Homo sapiens
cagtgtatctcccatattattgtatgtgagagtaagacttgggaatagtctatgtcgtacagactgcatatagggctcttgaatctatatggagtctagctcatgtctggcttaacaaagtcttgggacaacaggcatatttcacagtgttcaacctcctctaatatgttcagactagctatacggccctagtaatagtttaggtaagtaaacgttttgtatacaattagaaatagtgggtggcctttgtaagttatttatatgtagtgtacacagctcttatagtataaagtatgtggttggtcatgataatatctatgataccctaatagtagttttatttggtgagaccgggtcacacgatgacgatcagagtgtagagcat

SEQ ID NO: 584411 - DNA, 259 bp, Homo sapiens
cccagattaacgagatgtacaagagaagcgacgagatggatggatcacctgaggttagaagtttgagatcagcctgaccaacatggtgtaaccccatctctactaaatacaaaaaaaaattagccgggtgtggttgcacatgcctgtagtcccggctacttgggaggctgaggcaggagaatcgcttggaggttgcagtgagctgagattgtgccattgcactccagcctgggcaacgagagcgaaactccatctcacg

SEQ ID NO: 584412 - DNA, 391 bp, Homo sapiens
accagtgcatccattaagtactgggtgtgtatcaagtcccccctcaagagtcataagtagctgtatccttttaccagtgtcctgttttcgccctacccagatgtacgagaagctatactatagataaatctgactatgtcatccaataccattgcagtcctctgcggcatacatcctcaatgggggctgtatcacccctagattggttctgagatactgcaatgtcttgtgtccttccaaagaaccataatacttgagcaaatatgaacattacttggggtgagggcagaaagagagaaacacaagtctaagaagggccagtaatgaaaaaacagttgagaccttaagtatgatgggaacaggatgaggaaggaggagaaactgaaatgag

SEQ ID NO: 584413 - DNA, 414 bp, Homo sapiens
agcaccggtgcatatatcggaatgaatgatgtcggatactcttgtagccgtccaagacagaggccttggtctcagttcgcaatttggctatgaagtatatgtcctagcagcacggttctatagttctgtgggatcactgccatgaagaaccctgagcgcagtgcagtctgctatggattgataacagggttggtataccagactctgtacacttgcccattttctcgcatattcagattcgtgaggtcagcctggtgctcttctttgcgctatcctacagacacataccctggctttgtggcatactcctaccgttcatttctgttactgctctaaagtggcttcttctggggacggagagacatacaaaatcaatccctttgttgggaccatcctcttctttcgaggggatcc

SEQ ID NO: 584414 - DNA, 741 bp, Homo sapiens
  misc_feature (412)..(412): n is a, c, g, or t
taacggtttgagggggaatgctggagattgtaatggggtatggagactatttcatataagtaatggttagggttggaggggtaggaagtttttccataaggaggggtatgagtgggtcgtagcggaatcgggggtatggctggtgccagaattcataaagaacccggggaggttaaaatgtaggggtctgggtggaccaacatattgttggtgtgtaagactgtccacgggagaagaaggtcgcggtcacttattgtgtgtgccctatgagaaaagaatgtgtagtggtgtagacggtgttgtctctatcttatacataactgtgttggtggtatccgggcatattagaaagacatatgggcgcagaagtgggtgcgcccagtagcggggcgaggattatatctccagaatngttggttttagaacggccgtgaggacctaagtctctgagaccctcccctttctgtgcaaggtgtcgaacggcggcgtgtctcggttgtggctcctctggcatagtggtgggagagaataaatcatatttatggccaaggggtcctgatggcaggagtaaccagaggtgtcctggtgtggtgacgaagggtggccgcggttacgtggagccacttattagtactggttgactagtcagacatgactggctagggtgacttcatatgacgatgtgttgtgggctactgctcgcagtgccgccgatcagggcgtagttggatcttggaggcc

SEQ ID NO: 584415 - DNA, 399 bp, Homo sapiens
cgagtatctagaggatcccatggagaccaggttgagatggagaccagctgaggatgaggctcaggctcctcgggctggtctgccctgacaggatactgagccaagccctgccttgtggccaagccctgagtgccactgccaagctgcggggaagggtcctgagcaggggcatcggggaggctctggctgccttctgcatttatttgctttttttctttttctctggcttcgtagggggtggtggcagcactgtttagaatgagccttgggaacagtgaacgtagagaatggttttaagcagagttggtgaccaaagtcagagtggatcatgggggttgggcagcagggaattggtctggtgggagcctgctctgtgctccccattccatttctctgtcc

SEQ ID NO: 584416 - DNA, 140 bp, Homo sapiens
  misc_feature (56)..(56): n is a, c, g, or t
  misc_feature (79)..(79): n is a, c, g, or t
gatatcagtgatgtgtttagaaacacagagaatggatttcttcaagatgcacttangtaagccccatggaactgtgaanagccatatgtatccctgtaaggagcaaaatacttaaaaaggaaagacattgaatccattag

SEQ ID NO: 584417 - DNA, 1818 bp, Homo sapiens
  misc_feature (568)..(568): n is a, c, g, or t
  misc_feature (1032)..(1032): n is a, c, g, or t
  misc_feature (1329)..(1329): n is a, c, g, or t
  misc_feature (1574)..(1574): n is a, c, g, or t
  misc_feature (1665)..(1665): n is a, c, g, or t
ggcggcggcagggctgagtccatgcgacgctctccattcactctccgcgcccgtgctccgcgctgtcctccctgttccgctgcccggccgctgccgcgcatgagctggatacaggccgagtctcctttctgctcgtacagatctttctttgtgccgcgatggctgtcgtccgggactgtcatcgtcgctgtgagctggtcctgttgtgcctccgaactcgcatgctggtgatcaaatgacgttgtcgtcgcattgctagagatcacaagacggacggaccctatgacaagtgcaaggcagttcagacgcgacacggtaccgagaggacaacggtcagcgaaacgggaggccacttcggtagcgccacgtagcggattcgtacccgggcaatccgccgcaaaagtggggaatgccagtgggggctcgttagccattggttccccagattcccatctgtgacgcgcgaggcgacaccccctttggccccaaaaccgttgatcgaagtgtccatgcgataacgttatacaccccccgagtcttctagattagcgccccgtctagagcgttntacaagccccttttccaaacggcgatttagaccgcttaaccaagaggtggccagcagcaacgttccttttttctccatttgcgtggcgggctcgtcgcctggcgtcgtggaacgccaaacagtagaccaaccaatcatggccgagacgagtacatccttcggagcaacggtggactaagccacttatattaagcgcaggacgatagtccaagaccaccccggttggaggtcagcccagttcccccatggtggcaccacgcgggtttggcacactggctggcctcacgggggcccggacctagtaacccatcagttacagcccaccatatcctgattggacaggtttattcgcggagatggcgttaaccccccccgatggctctattctgggccaactttttcttccagcgtcgcacacaggataataagccaccctcctagtgtcactcgtgtggtctggctcntacgtggcccagggtgtgaaccatcgagattatgaggcgggaacaacacaagggattcctacggggagacccagaccagatgggaaatgagccgaaggcatgagacgaggattattccccctgagaagtgggtgagcccgtttggcggcctgcaacaagcacaccactttgttcccctcgttggtgcattggacaccacgggaaatcttcaaacatcgcaaaaggggaatttcgcccggagacacacgagaggctccgaagcatttcccccaggaggtagcggagccccctattgtnataatccgcccaagcggcgggcgccccgtcttccaaggggatggactatacagttccccccgggctggcccccacatggaggtggtacacagtttccgaagcttccaaagtgtcgcttttaacgccccgggtaggagacactggggtagccctattaaaccaattatgcacggaggcgccgagattgtgctacaccgggcaacgttaccgcggtgctcccagcacgctggcatgtcgcaaccganctttccgagattggtttaacccacacgggggtggccacaaccccgcgattcgggcaaccactatgagtgttcggcgcaaggcgcaaacagngaaattctatttccaaggcagtgcaactttgaacgcgggcggctggacgcaaaaggtgcaccatttcactatctcacaaagcgggagtagtaggcgcatgcggatccccaaagagcggttcaccatatgtgcgaggagggccaatttggatga

SEQ ID NO: 584418 - DNA, 269 bp, Homo sapiens
attctccccctttagagctatgtattcatctgtcaaaactgcctgctattgccacaagtagctatgaattaacctaataacacctcactggacacaacatcccacactttaaggcttaacaatgggtagccaatcactaatcaatgttatttctgtaaatcaatgagaatccgcggcagaactttgtatcagtccaatccttgtccccctccttttttgcctttaaaaatctgcctgtaataaaggccaagtggagctcataaaaaaaa

SEQ ID NO: 584419 - DNA, 173 bp, Homo sapiens
aatcagtgctttcatgccaactctttatacataatagaaaatcttttatttccacctttagtgttccctgctagaatagatgaccacaaaacccaggccagaaacgtactaggtctagccgtagaacagtccagtgaggcactatgttctagctagctagtaggaagtacgcc

SEQ ID NO: 584420 - DNA, 146 bp, Homo sapiens
acttaccagccggctgcctcggagacgtgttgccgagagggcggctgctggctgggcgtgcggacagtgctgagtgggacgagctgcgggtcccatctggaccttacttgcccacctgccagtgtcttgggcatttccttggcgga

SEQ ID NO: 584421 - DNA, 851 bp, Homo sapiens
gaaggagttccataccagcggactggcctggagcaaaagcggggcctgtggttaaaagaactgagcggactgccatctggaccctctgccggatcaggtcctcctccaccctgccaacagggcccccatccatccgcacaggctcataccagtgtcaggtgcatcaagaatgacgatcatgactacccggcatcagtcacttggtgcgcagcagagtataatcacggggagagaagcattaacacgatgcaccatgcagaagatgtaatctgaagtgaacgcatgaaagaaacgtgcagcagaaggagaatccacatggacgagcttgagaggggctcacgcgaggtagtgtaccacaagacaacggccaaggtggggctccacgcaaaagaacccagtacatactaggagagcgcgtgaagaaggcgcgaccaagagcaaggcgaggacacacccgattcgcgcaccacaaagaagcagaaggatccacgacgagcagatcactgaacacaggagggccaggacaccgacgaggacgtggatgtaacaccagttagtgggaaccacgcactctgggccgacagggacggagacccaacacgcacaaacagacgtggcgagaaaaagtaacagcactggggcggaacaaacacaacgcatccgacatagagcagcgaccaacaacatgagacttgacagacccccaagcactaccccagcactagggaccacagccaaacatgactaggaacagggaggcaagacgtaaacacaagggaagggaccaatgtggagaacacgaagactgaaagaggacattgcagtcagataagtccccaccagcatacagt

SEQ ID NO: 584422 - DNA, 93 bp, Homo sapiens
tgagaactgcagatagtacagcttccacaggagcaagggatgtctgagcacaagtggctgagttccaagagacaatatgggtcaatagctgtg

SEQ ID NO: 584423 - DNA, 108 bp, Homo sapiens
  misc_feature (90)..(90): n is a, c, g, or t
cggtcccttctgacgcgctttcagttcctagtgcaggaccacagagcatctgcagaaactttaattcctcctccgttgacacacgcatgngtcagagaatgaaatcct

SEQ ID NO: 584424 - DNA, 633 bp, Homo sapiens
  misc_feature (29)..(29): n is a, c, g, or t
  misc_feature (176)..(176): n is a, c, g, or t
  misc_feature (349)..(349): n is a, c, g, or t
  misc_feature (358)..(358): n is a, c, g, or t
  misc_feature (456)..(456): n is a, c, g, or t
  misc_feature (524)..(524): n is a, c, g, or t
  misc_feature (570)..(570): n is a, c, g, or t
gctgcaggaattcggcacgagcatagttngcaaatatattctcccattctgtaggttgtcgtgtactcagttgatagtttcacttgctgtggagaggttcttgtgtttaattaggtctcataggtcaatttttgtttttgtttcaatttcttttggcttatttgttatgaagtctntgccaggtcctatgaccagaatgatattttctaggttatcttccaaggtttttatagtttttggtttagattgaagtttttaatcaatattgagttaatttttgtgtctggtgtaaggaaacggtccagtttttatcttccacatatgactagtcagttatgccaacattatntattgaatngggattcctttcctcattgcttgctttagttaatcttcttgaagatcagatggctgtaggagtatggcattacttcttggctctctattcctgtcatngatctatgtgtctgtttcatatcagtaccatgatgttttggttactgttgccatgtagtatactttgnggcttggtagtgtgatgacttcagcacttgtctttttgttagaatngctttggtattcagattgcttctgacttcatatgacctcttaaatagatcttctaaatctatg

SEQ ID NO: 584425 - DNA, 215 bp, Homo sapiens
cgcatctttcgtcccatcagcggatttctatacattgacctcttgtttgttatcacaaacagcagtccaacgacgtgtcacacaatgacgctggtccatcttctcccatcagtttcccatcaaaccagcgtcattgtgtgacacgtcgttgtactgctattgttataaccaacaagaggtcaatgtatagaaatccgctgatgggagaagatgcg

SEQ ID NO: 584426 - DNA, 885 bp, Homo sapiens
tgtaatctcagctacttgagtggctgaagcaggagaatggcttgaactcaggaggcagaggtcacagtgagccaatatcgtgccaccatactccaaccgtggggtgacagagactctgtctcaaaaaaaaaaaaaaaaaaaggaaaaaaacacactgtgtgttgggccggccttgggcccctggagaaaaaaggtgtttaatagacccattccggttggggcgcgcgggggccccaaggttgggtaaagggtggaccgtgtgggccaaaaaggtggttcccaaagggaagacccgggcccatggcactaaggggtgtggggttttcctcaccacaaaataaaaaaacgcggcccggggggacaccaccggaggcgtgttcgtgacaccacattccaaggagtggagaggtacggcgaggggccaatacccggtgctctaactcaaacgagagagtctcaacgaggagagactgagatattcaaacattaatcgcccgcgctgggggtagccgacagactgccagcaacacaacaagagcaaactaagaagcgtaagcacatacaaacagcagaacagacgaacaggaggacgcgaagaacagcgcgcgaaaggagagcggacagaggaaggccgaaagacggggggcggacgagagcacgaggaccgagaagagacagcaggacgggagagcgtagaggcagggagaagggaggagggacgaacggaagagagagcagcgcaaagcgagaggaaaaacggagcagacagacaacagagaaagagaagcaagaagagagagagagacaacctgagacggaggaggagaggaagaagaacgaggggaagaacgcggccgaggaacgacaggaagcaggggagaggag

SEQ ID NO: 584427 - DNA, 819 bp, Homo sapiens
  misc_feature (819)..(819): n is a, c, g, or t
agccaccaaaatggtggtgttcgggtatgaggctgggactaagccaagggattcaggctgtggtgccggtgggaactgaggaagcgcccaaggttttcaagatggcagcactctatgcattggtcagcccagtccttctctagacagatgcaaaactcagaagaccaagtgggtcatagcaacatcatagaaaacacaattcttgactatcttagaacaagaacatgacacacaaatatattatcacacatgtggcgacattgggggaacaaacagctgggtttctcgtggaactatcctcaagacttcctggttcagacgcctgcttcaaaggttaaaccattgatgcttggaagacatatgcgatcatgggctacacttccatttagggtctactgtcgttacctgacaagcttattggtaattgatgcttaggtatccagattcatataagccaaggaacacactgtagtaactcacgaggctccactgacttgggcaatacgtcacgtgcgtgctatcgctaatcccaggtttcctttgggctatttacctaacaacatggaacgtcctgggcaacccaacgttatcattaccggttcccactggcccaacccaaacccgcgcaagggctctcaaatcccacttggcgattgacccgctcttggccaatcaccacccgaagccttgaccactttacattggcggaaatatccctaccataaggtcctttcaccgacttcacatagtatccgggacactagttacacgattggagcctaataccgcaacttcattggcgcacggataatctgggan

SEQ ID NO: 584428 - DNA, 659 bp, Homo sapiens
  misc_feature (479)..(479): n is a, c, g, or t
atgaaatattagttctggttgctagtgcagatctggactcggatcaagggtgtcgagagggtcctgggtcctgttccttgcctttcaaaaagactttttacggattgagaatttttaaataccactaggggaaaggtgaaggttctttgcagccttcagtgttgaaatggacgaaggtaaggaagacaaatcattttaagacgaaatctccgattttttaaaaaaggaggaaaaaagcagggtggctaaggataaagaaagaggacttgagaaaatgtggagaatgaaaaacaggagagcagcgagcaaaagcaaagatccagagttcaaagagactggcagaaggaaatagctgcgggctgagtgctgaagaggggagggactgacggctgccggccggtaggagcgcggagctgcgctgcggcggccaggagctgctgcggttcccgctgctcggggagcaggcggtgtgtgcgcgngtgcgaagtccgagggtttgaaactgcaccgggcaagggcgcggctccttgctgtgttctggagcctccgggcgtctcctctgcctcccaagctcaggggctttccaccctcttttccctccttcttctttccaaggttccccggcctcttggttggtcgcaggcttcggcaagtgagac

SEQ ID NO: 584429 - DNA, 178 bp, Homo sapiens
  misc_feature (68)..(68): n is a, c, g, or t
gctggagacgacgtgcagaaatggcacctcgaaaggggaaggaaagaggaagacaggtcatcagcccngggcctcaggtggcttaaggagaaattgtatttggtgtctgccatatctttgaatcctcaaatgacacttttgtccatgtcacttgatctttcttggcaagggaagccat

SEQ ID NO: 584430 - DNA, 262 bp, Homo sapiens
  misc_feature (53)..(53): n is a, c, g, or t
aaaaaaaggggggcccaatttttccccgggggcgcccccaaaaaagggggggntcttcaggtttttaggttaaaagggggcgcctttttttttttccccccctttttttttcgggggggcccggggtaacccccggcccccggggaccccctttttcccccctttggggttggcccggacccccgggggttttgggtttttttcccggggcccccccccttgggtttttttcccagcccctttttttttttaaacctcccca

SEQ ID NO: 584431 - DNA, 498 bp, Homo sapiens
gagcgggtgatctctcgtatagctaccaattgagagcagtttaactgtgcttgagtcccctggcgtgatgtgttcatgagactgaagtttgccgatggatgttgtcagtgtgttgcagctggagggcccagatggatcaatgaggcatttacagtgtagaatctcaccctgaacccagactattcagatacagaactggtgacacgatggctgtacattcagcacagctgtggatgtccacccaagtgccatgacccaggagccaattcagagaggagctggcctatgaccggatgcccacgcatggaggacggggacggcaaggaccactgccagactatgccccagacgcgaagaccgagctgaaacatgccagctgtcgaagagacttggcccacctgcttacaagcaacaaagactgtgggtctatcatcttgttgcttgatggtggagctggcctccttggtgaaactcagtgggttaaacgactagtacctg

SEQ ID NO: 584432 - DNA, 1144 bp, Homo sapiens
  misc_feature (924)..(924): n is a, c, g, or t
tggcccgtggatttacaaagttttatgtgaccggagccccttgggaggcaccaaagtccacattcggtactcagaagggtgagggatgggcctcaggggggcaacatgggcccgaaagggggggaagactcgtccatcccctggggggaaaggaggcatcccataaggcatggcacagggcttgaaggggggcacacccccacagtgggggaggaggaagcaatgatagtctaaagaagggagagagggggcaccccaaaagaattacctacccaggtattaggggttaagaactcttgaaaattggcccctaattagtctaagaccctgggggaccctttagaattcttaagaaactcttaagaaccattggaggtcttagaaactaccggtgcctagaacactatagagaaattttagaaaatgtggggaatctcgtgggcacctctttaaccgagggtctcctagaaggaggcagaaagtgcgagcaagagaaaccttaagagggtgctcccacacttttgagaaatttttttgagaacacgttggggtgctctagtttgagctcaccacactgtgagggtgtgacgaagtctatataacttttaagagtgcttaggactccgggaatcttgggcaccagggggaactctagagtggcctgtgaacacagaacaagaccggttagaaactcttattttaactcttcttagaaactctggggagcatttggagtcgtaagaacttctttagaccccgagaggaaattcttaaagactcttttaagaagtaagggttctttaagaaatattcacacatcttggcgcactctaatgtacagcgggtgcgggcacaacacagagcgtattgggaacagttgggcccgtgggtccatacgcgggtttcccggagacccaagttttntctgtggtaccccaggcgggtaagaacctgggcggggtcccccccatatgagggaagtacgcaataaaattcgaaaaaggccagtgttaaacctggtaaaaaacacgtgacacagaaagcaggtgacgagcgaccaaacagacacagcgcagcagaagagagagaagacacgcaggaaggagacacaacatgtgcaaaaaccaaataggcgtcacgaaaa

SEQ ID NO: 584433 - DNA, 503 bp, Homo sapiens
tcagtcggtcctggttgcgtggggcactggaatggcagcgtgcggcaaggtgggcgttgcaggaggaagacgggccccatgccaggagattgagactagagttagcagcaggctcacagcgcactttcctccttctttcaaaatctttcatcatattgacaaaacagtgaaaaacaagtccaagagaacttttaagatttaacctgcgaaaaagtgactcacactcctggctatgtgttttcatttttctgttctaaaatgttgggttacagaaagtgagttctacttgggaaacttgggaacaggaggactgaatccagtgtctgagtttacagggtggtggtttcgtcaggacccaagcttactatttgctgtcctttggacaaagctgggaaccaatacttttttaaagttaaagcaatagctgagttgtcaaaattgtaatagaaacaaactcttacaaacaaagttggagttcaataaagtagagatagttaaattta

SEQ ID NO: 584434 - DNA, 702 bp, Homo sapiens
  misc_feature (73)..(73): n is a, c, g, or t
  misc_feature (86)..(86): n is a, c, g, or t
ttttttgccagctcgggcatcctcctttttatttcaagaggggccagctccaaacaaagttacaaggttaagngcaactccaagtncctgacacagtctaatcccggctcggtcttcaaaaatatagaggtcggtaatcccttttggaacagtgccttcgaagtggaggtcttgggccagtgagctcttcttcgacatcatctagtgcccacggggtgatccgctcagctccaaagcttcccactcgtgtctggaaagcttggttgggtgtcgtgcgggcagtggtccatgtggctgtgcctcccggtcaatcgtgcttccgtgcattcattcggtgaatgggcccaggcggcatatatcttgggccccagaaatcagagagttaaagtgctccgaagcccaaaatacattgaggaagttaccaggagtgcagaactcacccaggaggcatctaaggtgagtagctcgatccctggcggtaacataggcttaaaagggagggtcaggggaaaggggacctgggttggtgacaaagccgtgagaatgtcatgtggatccatccaccattaagaatcataggggggacattgtgttacattccctttcatcatgtctgtcaacatagtaggatcagcataggagaggggggcctaacttcggattaagttttctggcaaaccatctcggggggtggaaaaaatc

SEQ ID NO: 584435 - DNA, 378 bp, Homo sapiens
ccgagagcatgctaatcagcggggattacatggcatgggccatgtgcctgggcctgggtttaatagttttaaaattttatttaggggggaatgatggtggtttttgggttatacaatgggcaatggctactgaggagtatcctagagacctggagggtcacgtgttgttatttggggatgcctcactattatgggtggcggttacgacgtgggtgactaattactggtacgtttacggctggacatagtacgcaccagacgatacgtgctacgactggtaccacactctggacacctactttggacaacgtacgagccagccagagactttcctgggtcgaactacggactgtacgacgtactgacgaccgacacaca

SEQ ID NO: 584436 - DNA, 646 bp, Homo sapiens
gtagaagagaagcggacggcgatggcgacggtcgcagcaaaatccatactgcatgctgcagtgcgtgcttgtggctgtgctggcaagcggcgtgtgactgaggatagagagccacagcactgaggagctgccagtgcctggacatgccagtggctgccagatatgaaaactggcgagagtgggcgatgaacgtccactgctgtggcctggcgaaagctggttccttgtggagaagcactggtataagcatgtgggatgtgcatactgtgcagggaggggaccatggactccagcaccttccctggctgcatcaacaatgccacactctttcaagatgagataaactggagcctcaaggagggactggtggaacggcgaggattatgtgctgctcccaagcagctgcttggcaattacctggtcagctggtattggtctagaagcatggccagacacccattgaacgcaaggtcactagagctgcccaacatcgcagaaggtcgaagtgtacccagtagaacctgctgctttgtccggcacaatgatttgggcaatctcaccactgtacagttcagccaataccgattctattggctagtattggcaacagctcggggaccgggttacatggtggagcccaggaaga

SEQ ID NO: 584437 - DNA, 135 bp, Homo sapiens
aagtccccatttcttccctggtgatctctcctgcagttggattactctggtggtgaaggcaggacccccatctcccctctgagttatttgagtttaggtgctgctgcatttccccattctaacaattacatagag

SEQ ID NO: 584438 - DNA, 123 bp, Homo sapiens
aatggtgttactaaatggctgttacataaatggctgtacctaaatggctgttcctaatggctgctggattggcgatcacgagtgccatttaggtaacagccattaggaacagccatttaggta

SEQ ID NO: 584439 - DNA, 289 bp, Homo sapiens
gctggatttttgggagctccttgatgggtcccagaccttggcttttgggaattgcacttttgggcctttgggctttggaacctgctttgggtcattggttaaacttggaaggggcagccccccctggctttttggttttgtggttgccagcctcaggtcatccttttaatttttgctgatgggtcagtcctgcctttactgtctttccatagccctggtggggtcccccttctttttcccctggacaaaaaaaccccccctgggatggggaataaagtttagaacatta

SEQ ID NO: 584440 - DNA, 711 bp, Homo sapiens
gcgagatctgcgcgactcggtctcaagcaactcgtggtagacccacggaatggtgacgggtccgttcatgtaacgcgaggtgcgtgcgacggactacgcaccgtctcatcagagcgtgtcaggtcgggcgcttccgtgtaacgagagacgggtcgttccgcaaaggtccacagagacaagcggactgccgagcgaagaaggactgttcgtcctgtgttacagcagctactcgggcaccaagggccggctacagcccccaagcgatacccgccaagtgcccctgatggacaccgaaccgtcttggagcaaatatccaagaagctattctctgaacagtattagatgtgattcagccactagtggagttcgaacaaggtagtcggtgctgaccaggcatcatcaagatcagcctgaagacgctgctggagtcgtgtgcggcatgcgcacctttgggcgcttcgggctgcagcaggtgcaagtggactgcaactttctgcagctctacctgtggcgttttgtggccgacgaagaactcgggcacttgctgctggacgaagtggtggcctctgcgagccctgcgcatgcccagagcctgtgcccatggagccaagtgtggatgaggtaatctgcgagcgcggctaggcgcagccgctgcaaggcaccggtctgtcctgcaccccatgcaccataacccgtggggggtccttcccc

SEQ ID NO: 584441 - DNA, 975 bp, Homo sapiens
ttcgactgaaagtaaaggtcggtagtccccggatctgatcgcatcgggccccagtgtcagcgcatggggtgatcaaacactctgtttaagtgaatatagtcgcctttaatagacccctgtccattgcaagcgacaaactatcattctctatacagtgtaacccaagtatagacttgcctcccaacaggcccaattccaatggtgaccgtgcaaggttgaggactgaagcaaggcatgtcgcatagcgaatgtgaaatcgcaattcaagcgattgtttgcaggaaggcgagagtcactgcacaaccactacaatatagtctgggattagcctggacggcatcgagatacgccttgcttggcacctttccgaacatgagccgtgtatcaactcaaccacaggtaggatagggcgaggaggacgacaaattggctagggccggggagtctcgcccaaggagttcattcgactacctccttgagccaccgtcagtgctgtaacggccccccccgaatgctacgatccattggagataatgaacacgcatagaaaaaagttggtgccacagaaatggcgcgtcaagaatcaattcacacagatgtccttccctttcaagcaggcatatctgccattaaagcaaccctctgtgacccaaccgtcttcacttcatttgaattgaccatgatggcgtagtccgctggaaaacgagcttccattgacccaacttagtccaaatggcccatctaggtggctgaccgcaaggacacacatgttggcacaggacccctaccgaggttacccactgaaggtcccttgatggacacgccggagactcatcccaaaaacgatcccatcctcctggcctccttactggccgcttgccacagtggctagtagcggcaaagggtcaatccccttgaggcttgaatcggggaaaggcctccacatgtacatgggccgttcccgatgtttcccca

SEQ ID NO: 584442 - DNA, 1190 bp, Homo sapiens
gcctgaatctcaggattccaccacaaagacctcagtcgggatcaaagagtgcgagaacaacgaagtaaatattcctccgcgcaaaggggtacccagcatccaatccgtggaggctggtgagcaaggtgacattgcaaccccgcataggaatggtgatgacaccctgcacgagtcaccaactcttcattggcaatcctggcctcatgaagtggacaaatcagagcttaaagatttcatttcaaagttatggaaacgtggtggagttgcggcattaacagtggtgggaaattacccaattttggttgagtagtgttctgatgatgctgagcctgttcagaaagtccttagcaacaggcccaatcatgttcagaggtgacggtccgtctgatatgtcgaacgatgaatgcaagcactcgagctgccagggataggcgatgcgacgagataatcgaccttcggggacctggtaggccctcgtaggtgggctgcgttggtggaactgagaggcccttccccgtggaggcttgtgttgcagaaagcacgatttgccgtgggacggggggctcgcgccaccggccgtgaatctccctggatctccgtgcatccatacgaaacctgggttccagacagaatggtgaattgtccgacagtccttaggcatctcgagagcatgagcccaggtccggttgtaacagtggatagagttcggattaacctgactcgcaacgtgggcaatggcgttggtgcatcccatctcgccctcttgccctttccggaactttaccctttcaccttgccaattcgccggatgatcatttggcaataaacgacttccagatagcccaccacacaagagattccggaaatggcgatttcaccaggcggcattttaattggtacaaggaaccttcccacaaaagaggggttttgctatcactcgacaaagggcggctcactcaccatgcagaacagttacctatacccagagggtaaacgcgcgaacaaaacaagcttgtggacttactaccggccgacccaagtgcttcttgcagtaaacaacccctggaggaagcgcagacaaagacagtacacctagtattactagctgtgcaacaccagtcgtggttgtgcaacctaccgcctgcatctcacagactatctgactgcaacagtaagtagtaagactatat

SEQ ID NO: 584443 - DNA, 1052 bp, Homo sapiens
cgtacgccgttgggctcgtgattgggatctaagaaaaccatttgacttattcatcttgtattcatcttatgttcttgatgtaatgggcgatgagagctgatggactttcacgactgttaggatactgaaatctggataatcatcccccgatgacctcaattacgcatgttagcccaatgactggttcccgtaaccacgtatgaatcacataccaggtctagggtattcaagctcaacatacgtgtggtgctgtgggagaagactcatttagataccaatgtggtcttgggactagacactacgaaggacatagtagagaagtatcattgtattcgtgatgatcaaacaatagttccaactaaatgagccgactagtactagtagaggccgggggcctgcgtgggacgatatcgtgatagtgaagtaggtcaagtactgagaaagtccattcctaaaagtattgtcataggaattcatgatacactaactggaacaacgcttgacctacctaccctctaatgtgtactgggtctaagtgaagacggtagataaggctgctctgaattatcatcgaggaatgagtcatccacctgtggggtaatatcagggtagaccgctactttgacacgactgactgttgccaattctggtattaatagcgctatatcatattggtttctatgcaaaaaaagtagtaagcttattaaagagccatatgtaccactcacctttggggaggccactgccttgcgaggctcccttgtgaccatgtgtgttgtaccagggctggagctaatagtgggcacgaccacgttctggctcctaaattccatgaacgggagtgtcgccttagattttccctgcggtggccgccaggctttgcctttaacccggctttcttgtccaggggggcctataggggaatccgtatgtagccagctggccgccgttgtacaacggtccgactgggggacattggctcgggatcttgggggggccctctttctgggggggccgtttgggccctccctcggagtttagtccgggataat

SEQ ID NO: 584444 - DNA, 315 bp, Homo sapiens
tccactagtgtaggccaatcatggcggagggaaagcaaacatatccttctgcaccaggtggcaggaaggagaagtgccaagcaaaagggggaaaagctccttacagaacaatcagatctcatgagaactcactcactatcatgagaaaagcagcataggagtaatcaccccaatgagacaattaccttacacctggtccttctcacgacatgtggggattatgggacgaacaatcgaagacgagatttgggtggggacatagccaaaccatatcaacatcctctatttcccaatgttgtttagttgtctctccat

SEQ ID NO: 584445 - DNA, 149 bp, Homo sapiens
cgagcccgaccctgatgtttgctggcagtagggcaaataccacatttgtgcatcactgagtaataacaccattagaaaaggcacttcacagaagttattggctaagcgaattcatttgaatgctctgttttagagccaggcaaccgtca

SEQ ID NO: 584446 - DNA, 1579 bp, Homo sapiens
  misc_feature (1481)..(1481): n is a, c, g, or t
atcaccacttattaacaacacacatagaatgatgaattaaacaagagttttctaggacttgctcatctttacttcgtgccacatttatctgataaagcagctgcaaggaattctgtctaaaacagactttttaagcaattgtcttgctcacgctcatgttcttagcaacactgttctaccctgctactactggctacactgtccagcttttaacaaactagttggacattatctcaatccttacaacacttctctactctcacccttgcacttgcgtctcatcaccagtataccttcataacacagcacaacctttctactgcttactacagcagcttacccttcctctctggcactcaagcacctctctacttcacacttctctccaagcctccaccgccctaccctcacctctcctcgacccaactctcactaacgagcacacgcgcacgcgctacacctccgctcgcctctctacacctcgcacctgggtatctaaacaccctcgtgctcgccctcggcctgcgtgctctctggggcacttcctctcactcgcacttgcccgtgccacgcccactcgtctctcccctgcccactctgcgcatagcccgtcactacttgcgctcctctcaacacctcactcaacactctctctcactcagctccgcttatccacccgacccagtcacggctggccattaccccaccaaagcaaagccacctcctcaaacctctcatcacgcattccccaacgtcacttgcataagcccataacttttggagcgctccccaactagtgcgctctccgaactctcaggcaaggacacctagcgctccacacccacattacccggcccacctcttccccgtacatcacatcccaagcgctcgattggctcatctcaagcaacccttatcttctcccacacagcgcttacattctgtctaacacccgtactatttcttatccccacaacaaaacccaattatggcttcaacccctaacttggggttagcacctatcaacattcacaacaacaccgcctctcccttcaccgcacaactctctcccccacagacctaatacccctcatttcaccctttactttcacggaacatacaaatagactcccttgggtgcttacatcctctctacagctatagcacacaaccaaaacctgatctccctcccagcgctctggtttcgacattcccccaactctcggccctgggctcccacttgcaaaggcgagcagaaccaacatccagcttatcgccccaagagataatccccacgggacctaaattgggtgcagcggcaaacgaggcccatcatcgcaacagcacactacacgccccccccgacaccccgattacacacggaccagcatcacggcgacaggccaccttcaaccacctcggcgacccaatctcaccgacacgcgcgacgcacatataaaccaccacacacgcagcactgnaccacataaacgcacacccctctccagccgcgctccaacaccaagcccctatcacaccctgtctcacacacccctaacgagcgatgcgactacgtgag

SEQ ID NO: 584447 - DNA, 148 bp, Homo sapiens
attctctattgttattatagaatgtgcaacttacgcaaccacattaaaactcattaagcctcaattcctcatggctttcattgttatccccactcccacactggctttggcagacaggcatctggggctcgtaggaggggtaccgagc

SEQ ID NO: 584448 - DNA, 555 bp, Homo sapiens
ctatagagcagacaaacatgtgtgtgtgcatgtgtgtgtgtgtctgtgtgtttgcatctctgtattctgcaaattgaatattcagcacaatacccaaaatcaactgcaaccaacatcatccatttatcatcaacacattttatatttcatattcatcacacatcaccaaatgcaacatcacgtgataacccaatgcccaagattaatcattacacatttgcacacacattcatcattttatgcagccttccaggcaagcaacacatccaggtcgtttcatcatcatcttttatgtccagtggtcccagatgcgctcatcgcatcacaaacgctcagagcacacacatcatcacaaacatggcacacacacacaaatggattttacttcggcccagattccaaagccacatcttcacagttggcacattcagctctttccgggaacaccttttatgggccatcggtcatctcttcaggcactccacagatctccaagctcaatcccaaggttctcgctaacacacaatcaaacacacctatcgtacccaactataa

SEQ ID NO: 584449 - DNA, 377 bp, Homo sapiens
cgtttacatctattggcgccatggatgttaatgtatcaaaaaatgttgcatcgaaaataatcctgtggatctgcctctggagtccaatatggttattattcttcctacttcccccttactatggctcttcctattgtagccccatggctcagtaatgccattgaataccctatttgtagactaagtggggtcgcatcatctttggtctatcttatcttgatgtcttctcattaaagtctccatgtgaaccagtataattgacctgcctgtgaagaggcgggcatgacacagcatgtctagaagagtgtatggagttttatatttattaatgcacacagtacctaaccaccgctgttcctgggtgtgtgtgcgctcgt

SEQ ID NO: 584450 - DNA, 406 bp, Homo sapiens
gtgactagaggatcctcttctgcccacgactcgagaagatgcattacgtcaggctggtctttcccttctccccattagaccttggtgtcttgaaggggccggaagaggtatctcctactctgggcatgtgtagaatagctatataagatcctcacaataattgaaacggaaagactcccttcggctctttctgccattccagtaaattcctgctaagtatgctctaggaaaactatgaggtgctgtatgatttctgtgacaggaactgtggctttcctgaggaacagtcttcctttcaatgctgttaacttcccccaagtttgtggtctgttggtggttccggtgtgggcaaagaggaatgaatgatggatggactgcgagcctcccaagtagaagtgggctaagc

SEQ ID NO: 584451 - DNA, 727 bp, Homo sapiens
gaccaaatggcggatgacgccggtggagcgggggggcccgggggccctggtggccctgggatggggaaccgtcggtggcttccgcggaggtttcgacagtggcatccggggccggggtcgcgagccgtggtagcggggtccgcgtgagtccgcactgccggccggatgactcgcagtgagggcaaaggccagaggtataaggatgtggatgcccggtcatcaagattgggccgcgtatgcgtcaaggacatgaagatcaagtccctggaggagatctatcttcttcttcccgtgacacctagttaacgtgaagtcacgagattcacttgatctatcgttcctggcggcgtcatctcgtcaagggatgaggttttgaagattatgccagtgcatgaagcacgacccgtgccggtcagcagcagccaggttcaagggcatttgttgctatcggtggactacaatggccacgtcggtctggtggctgttaagtgctccaatgatggtggccagcggcatcctgtggggccatcatcctggacaatgctctccatcgtcgcccgtgctgcagatggctactgggcggaacaatgatcggaaagccgccgacattgttccttgcaatggtgacaggtcgatgcggctctgtgctgggtacgtcgtcatacctgcaccacagagggctagttggcatcagtctccggcacctgtgcctaagaagctgtcatga

SEQ ID NO: 584452 - DNA, 749 bp, Homo sapiens
  misc_feature (15)..(17): n is a, c, g, or t
  misc_feature (52)..(52): n is a, c, g, or t
tcttgaggattaccnnncccctggggtaattgatatcgtcgagccagcgctncgaacctttccaagggcagctggttgtgtgatcgccatcttagggaaacagatgttctcgctcctgtggcgcacctggcgcgggcgaaccccgttcaacacgccacatctgacagctggtgcacgatggtctcgggggacctccgacaagcagcatccccaggggacccaccggaaccaaccaccgaccgccactcgacaaaacgtggcagaccgccgtccgatggaagagtacagttgtcgaataaggctccgcagaagtataaatgcactgatgatggataaaagagaggggctacaaaaggcaagcagagactgaccacacaccagactgtcggtaccgcctggatacgcaggcgcacaatgccgacaagacacgctgagacaccacaaacacatacaagggcaatacaacaacggacacctcagacacagcacacacggaggctggagaacgcaagccactggcaccaaaccacggggaacgagaggaccacccagaaagataaaccccgtacgacgcaaaacgtaccacatgccacagagacccatcacctaccgcagccataatgcagccatccatacacagcaaaccacccaataacaaagcgccgtacgccagtcggccacacatcctgactacggcagaaaagaagaaactcacccaatacaaccgacgcagcaacccaacaccaaca

SEQ ID NO: 584453 - DNA, 104 bp, Homo sapiens
tagctgggcagacttctcatttcacaggtgaggagactggtgccccacaggatttaagtgccttcccaaggtcaggcttatctccagagggaggtgccctggac

SEQ ID NO: 584454 - DNA, 103 bp, Homo sapiens
tatcagctcgtaccgctgtgatacagtcggctgatggtttcgataataactagttggggataggggtgtaggtgtgccttgtggtatgaagtgcgcctgggtg

SEQ ID NO: 584455 - DNA, 701 bp, Homo sapiens
gcccctcccccagcctcgctgccgccttgcagtttgatctcagactgctgtgctagcaatcagcgagactccgtgggcgtaggaccctccgagccaggtgcgggatatattctcgtggtgcgccgttttttaagcccgtcggaaaagcgcagtatttgggtaggagtgacccgattttccaggtgccgtccgtcacccctttctttgactcagaaagggaactccctgaccccttgcgcttcccaagtgaggcaatgcctcgccctgcttcggctcgcgcacggtgctcgcacccactgacctgcgcccactgtctggcactccctagtgagatgaacccggtacctcagctggaaatgcagaaatcacccgtcttctgcgtcgctcaggctgggagctgtaaaccggagctgtagacaggagctgttcctattcgggcatcttggctcctccttgagtctgaactgcacagatccacttacatgtggattttcttccactgcggcctctcctgagacagcaagaccaacccctccttttcatcctcctcctcctcctcagcctactcaacatgaaaatgacaaggatgaaacctttatgatgatccactcatccattttcttttctctagcttattgtgaacatcttaggctagtgtgtcgacttctgacttggctcatctgaacccaagtccttggaca

SEQ ID NO: 584456 - DNA, 486 bp, Homo sapiens
  misc_feature (21)..(21): n is a, c, g, or t
aagtttatagttctaaatgcntgcttcaaaaagtcagagagatctcaaattaatgattcagcatcacatctggaagaaccagaaaaacaagacaaaaccaactccaaactagaagaatgaaagaaataactaaaattgagctaaactgaataaaattgagaccaaaaatccataaaaagaatcaatgaaaccaaaaattggttctttaaaaggataaacaggatcaataggctactaactagattaacaatgacaaaaagagaagatctaaataagcacaatcagaaacaacaacagtgacattacaactgatcccacagaaatagacaatatcctcagaaactattatgaacaactctatggacatgaagtagaaaatagggaggaaatttataaattcctggaaacacacaatctcccaagattgaattaggaagaatttgaaacactgaacagaccaatatcaagttccaaaattgaatcagc

SEQ ID NO: 584457 - DNA, 133 bp, Homo sapiens
acgaggagagagatggaagtggataatcagtgaggcgatggatcagttggaacgaatgggaatggcggaacaattacagtgtgaggatatggtagtccatgcatggttatgggtgtggtatggccggtggtgt

SEQ ID NO: 584458 - DNA, 241 bp, Homo sapiens
  misc_feature (3)..(3): n is a, c, g, or t
gcngaatcacaagccaattcaacctcttttctttaaaaactatctagtcttaggtatttttttttcttttctttggggttttttcctttggagaaaggatttacctaagaggccaggccggaaaggaagggggccagtttaaggaggttgaaaacttgttgacggcttgcggagaatcaaataaaccttcagccgttgatattgcctaagcttccaccttatacggatgttcgacttgcca

SEQ ID NO: 584459 - DNA, 1818 bp, Homo sapiens
taaaaccctcatcaatagatggagacttacagaaatagtcaaaccacttctacaaaaggccagtatcaggggggggcttcgaaagcccaagaggtgatgtttgggagtttaaaggtgaacatattagtgtgggggtatgaagcagaataggtgcgaggcacaagtgtgacgcccaataagtgcacggtgaagctccggtggaagccgtggtggcttaccacaaaacagtgttgtgacccggtagaagtgccggtcggacaaagtgggtgcacagggaagaactctcgaaagttcacctctgtgagaggccttgtgttagggaggggtctacaacatcaaaaagcacccgagttaacaagtgtggtcaatcaagcaagtgtggcctgtgaatatcttatgtggggggtatctcggggtgtggtattctcttaatctaagaccattttagtggtgtgagagccctcacagaggtgaacatgtgaaataactctcctgtgagagtgccgagagttcacatacacgggagagtgtgtgttctcagagagaaagtgtgggcggaaacatcatctcagaagaggggggacactataaaacgcgagaggggggagtagctagtcgctcctgtagtagtgtagagggaggcgccccccagttgtggcgcccctctctctataaaagttgagggggggggagagaaacaagagaggcgccccataagagcgagtgaggcgacgtggtggggctccacacaggaggggcgcctcaggagaaacacacaaagtccgccgtgggggcgaaaacggaacaaaaaaacaaaaaccatcttttcccgtcgagacggggcgtccacccactaaaacacaattgaaggagggaataatatatatacccccggcggggtaaatttgccggaaagaaggagggcgcccttatttgattgcgtggaaaccccaggcggcgtgggttgttggctcgtctggtgtgttgggggaccccttgtgggggactaatgttgggtagcgccttataacccttcgcggagtgtgtttgtcaaccccaagttccgagcggcgccccccaaaatcaccacacttggggggcggcacacatcaactagggggggggacaagccaggacgcggagcgtgggtaacaagggcagcaacaacaagggtaaacaaggcggccccataaaggaatatatcagagcaaaggggaacgagcgagggtcataatcatgtgagagcaaggtctgggcgagacacaatccgttgtgcgcacaacatcccaccacattttgtgaggacatataagacggccgccggaggaagaaagggggacacaataataaacggacaacggggcggggcttcaagcacgcaagaggggtgccccccccctgggtgaaaacaggggagcgcacacacaaggggggaccggggagggggtatacaacagcagcacaacatcctagggagaacacacgcgggcccactggtagtagaaacaaggtggggggggggcaccacacacataaggggctgtatgatcgacgccggcgacgacaagagatgacacacaggaggcctaaacccacacaaaacacacgggcgtgttacacacaccagcgccgacagcccgcaagaggaacagaaacgacgcagccacaaacaacgagaataactcactagcacacgaagtcagcccacgcgacgaacatcgaccaacatcgcgctgaccgacaaacagctcagaccgagctagcacaaaccgacaagtcgccacctgcgtaggaatacatacgccaagcacagagagc

SEQ ID NO: 584460 - DNA, 723 bp, Homo sapiens
tggctccggtagtgtcgggccctatgttgcagtgtggtgctgcatgccctgtgctctttctggttgtccctactatggtggtctgttgcactgtggccagggcctgtcatgggaacgctggctggcccccattcgctgtctgctggctgtttgctgtatggctctgtggctgtttcgaagactgggcgaaaggtctgtcccggagggtcagacctaggtgccttgccgctagtaggtttctacctgaagttctcctgttcggtcataatagaagtttttggcgatgggagagtaatccagaccatctctggggcagccaggcccttgccttcattttgtacagaggtagcacaattgattcctaacacgtaaactccttcccctttttgaaatgatcttctgttctaatgccatagatcaaaggcctgcagaaaccattgcgtgtttcctctttgaagcaatgacaagcacgtttactttcacggtggtttttgttttcttcttattggctgtggaacctatttttggaaggacgttaaaggggtgttttacatgtgtttgtaagagtgtgtgagtagtgtgttttgtagatttcttgacagtgctgtaatacaggcggcaatgcaatagcctatttgaagtcactacgtgatctgagtgagatgtaaatagtttttattttttagccataagtgaattattttatctcttatgtgaactacc

SEQ ID NO: 584461 - DNA, 116 bp, Homo sapiens
gcgcaagcatccattcacacagtcaagtttttctcaagggggcacatccagcagcccatcggggcatcccactcttccacaaatctcccaaggcgggggtcacggcagctcgcaat

SEQ ID NO: 584462 - DNA, 208 bp, Homo sapiens
tatgggtgcatgaagacccaagcggcaagaaactgctctgctaccaggacgctggatgctccaggacgcgtgcgctgactcgaccttcactggctcccaggcaggtccggtagctaccctgcagtaactccactctcaacagaactgctatttaacaagtgagtctatgcagaaagaacggaggggtgcggggggtgtggtttttctt

SEQ ID NO: 584463 - DNA, 274 bp, Homo sapiens
ctctagaggatcttataaacgagggcgcagcagtggcctgtagccagccagtgcccaggtcattctgtcaggtcagatcagaagcacggagcttggtactccatcaagatgaggctcactccctgagtgtacagttccagggagcccatcccagtaagccagcacgctgtagggcaagcccgtctctacaggttgcgcaggacccttttttggcaaaacggttgaagttatcaagccagaggtccctgtgggccaggcatgagcagcagagtgt

SEQ ID NO: 584464 - DNA, 540 bp, Homo sapiens
  misc_feature (438)..(439): n is a, c, g, or t
ggaaggttttgcctgttctagaagcaacggttgtacttgcacaagcgtgatttgcgataaagactgcagtccagataggagaggggggatacattactgtgccggggaaatcttccactttttgcaaacatacattgactgccaatgtcattctggagtaatgactggaactgcaagttattcgaaaaacttatacctcatccgagtttgtaaccgactggaagctcaggcacttgtgatggtgtcaaagagacgccggagttactgggtcacatttgtggctttctaggaataccattagcaccttctgatgcagacacgagttaatgatgctgagctcatggccgccagtgatgctgaaggataacttagtagactattctgctctaacttgtatagtacatgaacccaaatcgttcactaagttgaccaaggtgnnccttacgcttaactttcattgagatcaagtgttcactttccagcagacttaatttataggcgaccacaggctattctccaccccgggttcggggttgggcc

SEQ ID NO: 584465 - DNA, 189 bp, Homo sapiens
aggatccgtaaaggagctatctagtgagaagggaggacgtgagtctatataaggctaaggagaaaggttttgagtttcctccaaaggtataatacttgggaactccagagaattgggggaaaaagtttaaaagcctgtttgaagttaagcttgcgggctgcatatgcttctcaggataacctggctacg

SEQ ID NO: 584466 - DNA, 211 bp, Homo sapiens
attccgaggatccccgtagtcgcgtaaaacgcccagattagcacagtaaacttaattcttcctgttccaatggaacaagtgatgctgacctgtttgatgcacatgatgacagagataatgatgcggaggctgggtctggtggaggagcacaaggatgcgttatcatgcagtctctctgtcgcaggattagagcttggcaatgtgatcttta

SEQ ID NO: 584467 - DNA, 1035 bp, Homo sapiens
tcccttctgagacagaaggtggtgttggggaactgaagcagttgctgtgggcggacagggaacccttgcgtttctactgtgtgattctgcagcttcctgggcaacgatcgccatgggagtgacttgtgtgtaccattatgtctgtgggcgtgggcgagagtgttgaggaaaccgtagagatccttacccggaagtggagatgcttggggcagagaggcacggcacattgtgtgtggactgtgagagttaccatacggtcgactctacccttggcagccaaggtggagtcctggccctgatggtggtagctagagactgctggagtctgctgctcgagattgcctagcagagatcctcgtaggcagccacacaaccaggggctcccgcagggtgtgggaaccgaccatgatgcggtctacgggccaagcagcatacctatgggtccatctacgagtggccaactcttcaagaagatccgctaagacacgcagtaggtgccggttggcatggggattcgtctcagtgatgagcacgctgccagctgagcctcgttgacaccaggggtactgccaaggaggcagcaagtgctgacctttcagggtccctggacccaagaaactcaggtagacatggacatctactcatctttacaggtacatcagatgtggcaattggtactgaggggatgagtttcgaatccagaagaagcagaggagtagtaacaaagtaggcacccaataccgacgggcattacacccgggaccattgtggactttgtggcggtccacaatagggacatatgcagagggcgacaaatggcacggacccttgttgcgacagccttgcaagactgtccgcgctgacagggggccacacccgacccaacatcagagggcacagccggcgagacaacaaacaacgggctcgaaaacacgtccatccacaacgtaggaacaccaaacgcatacaaggagataacaactgacgacaacaaagaaaaggaagtcacatatgaatacgacgaatgtctcagca

SEQ ID NO: 584468 - DNA, 309 bp, Homo sapiens
tatcagcgggctatcagatgatcagattccgactcccttcacagcaaggtagggactcgaagattgcaatcataatcaagttttctttatgtatttatttatttacttacttacttacagagtctcacttttttttttttttggaaagggagtctctctctgtcgcaaaggcgtggagtgcacgggcattatctgggttcattgcaagctccgcctccggggttcatcccaagttctcgttgcctcagcctcccaagtattctggaatatataggcttgtgccatcacacctagctaattatggatagt

SEQ ID NO: 584469 - DNA, 176 bp, Homo sapiens
ccccttccccctttcccccccaaggggttttaccccttttaagaaatggctttttttaattggttttttttgggggcccgtttttttagccgggaatttttatttcccccctaaatttttttttctcccgtttcccctgattttttttccccttaagggtgttttttggggtccca

SEQ ID NO: 584470 - DNA, 929 bp, Homo sapiens
ccaggaggttccccttggcgcgtgtacctcgggcctccctttgtttctgcgcccctcccctctattgcctcccggtcttcgccacggtgttcccctcggcaaactagttgcgcggctttttttcgaaagtcgccccccccctgtctgggtctcttgtgggcaacctctctgctggactctctatcggtggatccgcctccgctgtttcttggcagtctctctccggacaggggacggtgaaacagcggtctcgcacgctcgctcttcgttccgccgagcagtcacgcagctgcgttcctccacctacgcgtgtcttgctccgctcgccacacctgcggtgttcagtcacatggcctcacctgcgcctcccgggggcctcggctccccccctgttgccacagagctcccaatgtgctcaccagggctggccctctccctctctatctatccggcctatcttacggcgaagcgacgggtgcccacacatgggcacgcctgggtgctccccgagaaagctccttgtctatagggcactcgcaaaaccacctgtgttcctgcctgcgtgtttgtggaccttctcccctcctctctgtagcccctctctgaggcacggctctcacacaagagcgttgttcccaccaagtggccatcctcctcctggggcacacaaataatgctgcgggtatacctcctctgcgcaatcatcctttctccaagcgctactccccggccgcgctaaacctcgcggagaccttgctcctccatgagggacacccccttcctgcaaacatcgactctcacgcctttccctcttggacggattaccagatgttagaccccgcggacgggcccgtgggtcgggtttctatgactgagagcataagttttttctccccaaacaaaaaccaaaatccctgagccacaaaaca

SEQ ID NO: 584471 - DNA, 146 bp, Homo sapiens
tccgctagggtaaggatgaggggcagaagaaagagaggaagtccagtatatttatgccttttaggagttgcaggtgcatataggaggttgagatttggtgctgtgcacttgttttaggtcatagcttctctagtcaggttaggtct

SEQ ID NO: 584472 - DNA, 486 bp, Homo sapiens
gagacagaatgtagcaagcagaaggcaaacacagatcagggcacagtttctcgactaggacagagaattttaagcatagaaatatcaaaagaaaagtactaccttatttcccttacgtggtaataatctgaaaaacacttattagatatactggacaacaagagaactaagtactccaactctactgcagcattacaaaaaaaaacatcccttcaccacagtgtaagatttaagggcaacctgcccaaggatgcatgttatatcaaacacagcaagattgctgctgccctgccaagtacttccaatccctacccaggtcctactgaaatacgggtggtcccaattagttttatcgaaataaatctttaaagaaacagataaagcatttaaaaagacaagtcaaaatgcatcaggaaccacatatccaacacaaactttatcctcaaatgagtcatgtttgcctcgcactaatatcgcacttagaca

SEQ ID NO: 584473 - DNA, 196 bp, Homo sapiens
ggcagggcgtgcaccatggttgaatttgggaagtagaaaagaaaactggttggcatgaaaaagaggagacacttcggcttcagagtgcacaggcacatgccttttcaccaagaaggagaaagagtcttggtctctgacagcttcaaaataaagaatcaccaagtcccagcagctggaaagcacaggttttcatcct

SEQ ID NO: 584474 - DNA, 623 bp, Homo sapiens
accctgttctgcaggtctgctggagtttgcaggaggtccactccagaccctgtttgcctggatatcaccagtggaggtagcataacagcaaagattgctgcctgcctcttcctctggaagcttcttcccagaaggacacctgccagatgtcagctggagctctcctgtatgagttttacttgagtccaacattccaacacaaggaaggcaagtttttcctgcttccatgatgatggaaggaatcaaacttgacttatgaagccaataaagcccttggaaaagctggccttatgttttgtgtacacaatccctgtacggggttcctgacctgtgatgcacattctgattgcctcctttggaaagcttattagaaactcagaagaatgcaaccatttgtctctcacctacctgtgatctggaagcccctctccttgcttgaagttgtcccccactttctggacagacccaacgtacttcttacacatattgattaatgtctcatgactccctaaaatgtataaaacaaagcctggccctaattacctttggcatatgtcattcaggactttctgagtttgtgggccacatcccccacccttggcaaagtaaacccccgatgcggt

SEQ ID NO: 584475 - DNA, 370 bp, Homo sapiens
  misc_feature (2)..(2): n is a, c, g, or t
  misc_feature (60)..(60): n is a, c, g, or t
  misc_feature (279)..(279): n is a, c, g, or t
  misc_feature (312)..(312): n is a, c, g, or t
tnatgctgcccacccgtaatcccagctactctggaggctcaggtgagagaattgcttgancccaggaggtggaggttgcagtgagccaagatcatgccactgcacctcagcctgggtgacagagagagactccattaaaaaaaaatgctcctgaggcctccccagaagccgagcagatgtcggcatcatgcttcctatacagcctgtggaactgtgaacccattaaacctctttcctttataagttactgagcctcaggtatttatagtaatgtaagantggcctaatacagagctcctcagcctgacacgncagcccttttaggacataagcatagttttggggggccttgtagccccccaacacaagg

SEQ ID NO: 584476 - DNA, 1076 bp, Homo sapiens
  misc_feature (213)..(213): n is a, c, g, or t
agcggattcggaagctcgtctgtgtctagaggacagagctaccccgtgaccggcgttatgagaactgcgaaggaggccgcaagctttctccatgcttgaaagcttgtgcacggtataggatagtgaagtcttggatgccctggtagcgtgcgtgactacgagtgttgctgctggttggtccgtgggggaagtgccgacgatagtctacgaaangcgatgaggcgcccggtgcgagctgaggagttgactacctgttggagattggtgagtagtaaagcagtagagggcacagaggttactagataagatgcatggtgatggttatggcatgcgcattgtaggcgcaagcagtgggtctcggccatgtgttgctggaatttgggttctgccttttgctaagttgcttcgcgagggtagaagttcagcgaaagaaatggacagtttcagggaccaacgtatgctgggtaaagactagaattgtcgaaatgggggagcgtaatcgtcaaattccatgggtaaagtctccaattaatttgttcgctttaggaacacattggtccttgttgaggaagagcaaagtcttcctagggagtccttatttgtaggctcgaatagtgactccctttgaaatagggctatttagcctccaaatagggtagactacccacttgtggagttatagaaaaggctaagagcaatttcaagggtcgaaatgcaaggtaacttacggagggtgttaaaataaaagacgctccaaggtagacagtggcttgagaggtaactagaaaatttaaaaaagacggttggtcaagtaaggaggtatacacaaatttttcaatagcaacgaaaaattaagtaagcaaattgattgttcggtggcttgagcgttgaccatttgtataatttgagagaaaaggatggccttaattaaagttgtgtacccaaggaacccccttattggctggagaaaaataagaggaaaccgtggttgtgacattaagagagagacttgagtttgaatcagacagatatacatcgagtaattaaaacatagaggtagaggatttgattttaac

SEQ ID NO: 584477 - DNA, 255 bp, Homo sapiens
ccaggtagactaacactttggaaggctgaggcaggtggatcacctgagtccaggagctcgagaccagcccgggcaacgtggtcaaatcccgcctctacaaaaaatacaaaaattagccagaaatggtggcacacgcctgcagtcccagctacttggggggctgaggtgggaggatcactggagcccaggaggtcaaggctgcagtcagccactgcactccagtctaggtgacagggcaaggttaggtctacctgg

SEQ ID NO: 584478 - DNA, 112 bp, Homo sapiens
gcgagatctcgagtctgacttcggcgaagacgcgatcgatggcgtgaggggcgcaatcatctagcataagatcgagaacgtagcggaagtaacaccgcctctagatatagta

SEQ ID NO: 584479 - DNA, 666 bp, Homo sapiens
  misc_feature (16)..(16): n is a, c, g, or t
  misc_feature (80)..(80): n is a, c, g, or t
  misc_feature (87)..(87): n is a, c, g, or t
  misc_feature (89)..(89): n is a, c, g, or t
  misc_feature (102)..(102): n is a, c, g, or t
  misc_feature (107)..(107): n is a, c, g, or t
  misc_feature (124)..(124): n is a, c, g, or t
  misc_feature (127)..(127): n is a, c, g, or t
  misc_feature (133)..(133): n is a, c, g, or t
  misc_feature (137)..(137): n is a, c, g, or t
  misc_feature (139)..(139): n is a, c, g, or t
  misc_feature (144)..(147): n is a, c, g, or t
  misc_feature (149)..(149): n is a, c, g, or t
  misc_feature (151)..(152): n is a, c, g, or t
  misc_feature (154)..(155): n is a, c, g, or t
  misc_feature (160)..(160): n is a, c, g, or t
  misc_feature (162)..(162): n is a, c, g, or t
  misc_feature (164)..(164): n is a, c, g, or t
  misc_feature (166)..(170): n is a, c, g, or t
  misc_feature (172)..(173): n is a, c, g, or t
  misc_feature (175)..(177): n is a, c, g, or t
  misc_feature (179)..(180): n is a, c, g, or t
  misc_feature (217)..(217): n is a, c, g, or t
  misc_feature (249)..(250): n is a, c, g, or t
  misc_feature (252)..(253): n is a, c, g, or t
  misc_feature (257)..(257): n is a, c, g, or t
  misc_feature (292)..(292): n is a, c, g, or t
  misc_feature (295)..(297): n is a, c, g, or t
  misc_feature (301)..(301): n is a, c, g, or t
  misc_feature (306)..(306): n is a, c, g, or t
  misc_feature (354)..(354): n is a, c, g, or t
  misc_feature (425)..(425): n is a, c, g, or t
  misc_feature (428)..(428): n is a, c, g, or t
  misc_feature (432)..(432): n is a, c, g, or t
  misc_feature (435)..(436): n is a, c, g, or t
  misc_feature (439)..(441): n is a, c, g, or t
  misc_feature (448)..(448): n is a, c, g, or t
  misc_feature (450)..(452): n is a, c, g, or t
  misc_feature (458)..(458): n is a, c, g, or t
  misc_feature (466)..(466): n is a, c, g, or t
  misc_feature (469)..(469): n is a, c, g, or t
  misc_feature (475)..(475): n is a, c, g, or t
  misc_feature (485)..(485): n is a, c, g, or t
  misc_feature (487)..(488): n is a, c, g, or t
  misc_feature (525)..(527): n is a, c, g, or t
  misc_feature (529)..(529): n is a, c, g, or t
  misc_feature (533)..(533): n is a, c, g, or t
  misc_feature (538)..(538): n is a, c, g, or t
  misc_feature (542)..(542): n is a, c, g, or t
  misc_feature (546)..(546): n is a, c, g, or t
  misc_feature (552)..(552): n is a, c, g, or t
  misc_feature (554)..(557): n is a, c, g, or t
  misc_feature (587)..(587): n is a, c, g, or t
  misc_feature (591)..(591): n is a, c, g, or t
  misc_feature (594)..(594): n is a, c, g, or t
  misc_feature (598)..(599): n is a, c, g, or t
  misc_feature (605)..(605): n is a, c, g, or t
  misc_feature (608)..(608): n is a, c, g, or t
  misc_feature (611)..(611): n is a, c, g, or t
  misc_feature (613)..(613): n is a, c, g, or t
  misc_feature (620)..(620): n is a, c, g, or t
  misc_feature (622)..(622): n is a, c, g, or t
  misc_feature (636)..(636): n is a, c, g, or t
  misc_feature (638)..(638): n is a, c, g, or t
  misc_feature (641)..(641): n is a, c, g, or t
acttcacttgtaaaantttatcaacaaagatgtagtccccaaaatcatcaaatccattggttgttgcactatctattaangcttgancngaccctgaaggcntttcngtgttcagaccattctnatnatttcnttantntatgnnnncncnnanntacangnantnnnnncnncnnnannaaggccttcccacatacagtacatcgatcaggtttcnctccagtatgaattatctgatgtacaacaagnncnnactnctgagaaaaggcctttccacattcagcacatatgnaannnttcnctccngtatgaattcaccaatgccctgggaggtgagacttctgagagaaggcnttcccacattcagaacatacataaggttgttctcccgtgtgaattctctgatgtccaatgagatgtgactncgnacanaannagnnnccacatntnnnacattnatagggtngcnctccantgtgggttcncnnatgtatgatgagttgtgacttgcgagagaatgttttnnnanattntgtanattnatanggtttntnnnnagtatgaattatctgatgtataatgagttntganttnatgnngaaggnttnatnanattgagnanatttgtagggtttntnacnagtgtgaattctttaatgtataaaa

SEQ ID NO: 584480 - DNA, 109 bp, Homo sapiens
agtacttgacaccacacactgcacacacaccacacattgacagcacacacactatgtgcacacaccccagacacactgcatacacaccttgtggcacaccacaacacca

SEQ ID NO: 584481 - DNA, 235 bp, Homo sapiens
ttgtcaggggtactggcgccatgtgcccccccagccccagagagggtccaggggcacaccggtgtcttgagccccaggagcagagaaagcgccggaaccgctggcaccaccctccggagacatgagaccagatgcctgtgcgtgccatgggccagcgtagcccctgtcccctttaatataaaagagatatatatatatatatatatatatataaaatatctatattctatacaca

SEQ ID NO: 584482 - DNA, 794 bp, Homo sapiens
  misc_feature (293)..(293): n is a, c, g, or t
gcaggacaccgggggacatgtcgtctagcttcaacagttgctgggacggaacagatccggggactctattacagcctgcgaccgacctcagatttcctatctgttcgcagccttcggtaccatgttctaggtcatatcctgcttctgagacctgccagcaccggatttgtggttagcgacttcttgccaaccaaccatgagctaccagattagacagagttattcaaccgccgtggagggagacgacaacacactgggcaatttgctcgctgcaggtgttatacaactacttntctctgagctggtattaagaccgtgatgttgagactctggactgcgtgagatactacttacgctaactgctgcatgataagcacgagggctacaagtcgacttctgaagatgctaaaccagcgaggcgacctgactctctctcaggacattgatacgtctgatgactatgagtgcagtccccagacgcctggatagctgacatggtcatggaaataaagctgagacagtccctctaggatctatacgcgctgggttctgaccacacggacattcatctctgagactaactggagacttgctatctagatgaagacgtgaagcttatcaaagaccatgggtgtccatctgtcaacactgcacaggcatgagcgagccatgagctacactgagccagtatctctataatagggtcatatgactgacgactaagagactactgagacctacgactaatgggtcccttgcggataggagttatggctaggctctacttcattcat

SEQ ID NO: 584483 - DNA, 739 bp, Homo sapiens
gctcagtcatagtcactgatgccgatgaagagatctccgcaagccacacgctaaccgaggaagagctggtagaagctgaagaagctgagtcatgaggatcagaaacccagggatcaaactgatctgccggctggaacattgacatccgtggagcgaggggaggtgcggcttaggcttggaagtacgaaaagttagtctcctaggccggctgacgctacgtcgtaattcttcaagctaagcaaggagatcttcagcgtcgccgaaccggagaaatcaatggttgactcgatgagaagggcctggtggaagtgatcatccagaacttgtcgtgaggaggacaatagggtcgtacaccgatcaactccagagatggaaaagccataatagaccagattaccgttgacactggtggatgacgattttgacaagcgttctgaggaaggcagatgctcagagaagggactggaagagaacaacaggatccctgatgagagcggccgtagcgcacgcggaaggtcacggaggagtggcaagagcagctgacgtgcaaggtgaccgagagcaagcaaggcgacgtcgcgttacagagggtctgccacgagggcagagtatgccagagggtcagcgatgagccagagacgggaacggggacttctcggcattgaagagtgtccaaccaggacacgggaatcacagagcgaaggagtctgacgagcgaggggacgacgagaacaaatag

SEQ ID NO: 584484 - DNA, 918 bp, Homo sapiens
tctggaggcactgacacccacttagtctcttcgtcctctcatggagataaggtggaggtaaagaatcacgatgccgttcgccgaaaaatcacctttccccaccgatgtctcgatcgtcctgtctaaaaagaggcagttctcctctgccagtttgctcatcagttagaagttgggcgactgggatccacagattgcaacagcgcgagaagtggggatactcttccaatctctaaacaatgccgatcatttacggcacctaaacgacaaagggtcctgagaacattatctgtagctgatatctccccatgtggaagttgccataggccctatgtctacggtgactcggttttctctctatcggctgaatcatgaacttgacaagataagccatcacaagggtattccagaatggcaagcataaccttcgcctctggcccttcagatggggtatcgtgaagatcaacacaaagctcttgtagcatcaaatcaaggagctctggatatagttcacggtgtcaggagggaaagcttcatgcgacctgacatgctataccagcctcaggacacggagccagcggcaggcatgtgctctgtgggcagacagtccagatggacaccgctaaggtgcatccggcaccagtgctggagtccaggacgtagacggtaaaacagccaaaggttccactggacgggccgcgtgaaataacccaggaccgtatggcagaggccatgccaaaacatggaggcatcaggacagcagaatggacagaaccaaaagagtacgagggacgggtgcaacaggttcacactgctcgaggagcgacccgagtaaacagacagacaccgcggcatgatgaaagcaggaagatacacaagaagtgggcgcaaaaacgcggagcgcgacaacgcccgcccacg

SEQ ID NO: 584485 - DNA, 299 bp, Homo sapiens
  misc_feature (35)..(35): n is a, c, g, or t
gtggctgacctgaggacccggatcaggcactgaangcctggtcgctcactgcagcctcaacctcctgggttcaagcaatccttccgccttagcctcggaagtagactggactacaggtatgcgccaccatacccagctaattttttttattttttatagagatggggttttgccatgttgcccaggctggtcttgaactcctaggttgaagccatcccccaaccttggcctcccaaagtgctaggattacaggcatgagccactgcgcctggcaactttgccttcttagtttgtcttgc

SEQ ID NO: 584486 - DNA, 133 bp, Homo sapiens
tgatctagaggatcgcctagtgcagacacactccatgtccggtcaaacaggtacgggttgtggacagtcatctggaactgctccgaggtgcccggtcaagagttacttcgcggtttccccccgcttaaactcg

SEQ ID NO: 584487 - DNA, 235 bp, Homo sapiens
acattggcgatggcaagaaagaacgatggtaactattgcggagcacgcacacttcacgacagactcagagtatatgggtagtagtaggtagagatatgaagttaggaaaaaaaaatagttttgactggcatcgtgcaagagcctaggtgtattagtagtcacagagtttcggatttatttcctagattaaggcatcattaggggtgtatttgtaactggatatatttattggggc

SEQ ID NO: 584488 - DNA, 132 bp, Homo sapiens
ccctgcggccacagagatgacgatgactcacatgaaccgtattgccatatctgaactacattttctggagcgagctaagacggcgcatacggctgtccacatccctaatcacccggagctggctaacacaac

SEQ ID NO: 584489 - DNA, 845 bp, Homo sapiens
ttcgttgtttttccgttctcatacctgtgacaagggcggggggggcttttgttggctcgaagattactacttccgtccttggacagagaaaagaaaaaacataaaaagaaacgcctagtacaaagtccaaattcttactttatggatgtaaaatgtccaggttgctacaagatcaccacggttttcagccatgctcagacagtggttctttgtggaggttgttcaacaccgctgcgccatcctacccgacgaatgggcggactcaccgatgggtgttgatttctaagaggccagcgctaagggtggcaacgggttccttgacttttaaccttagtggtgatggccagataggcgtcatcatacccgcccataatggcaagaacgggtaccagacatgctgtcctcccctccgattgttccaacgccccacccgacccccgtcctgtagccgccccttccccggctcccacccgccgcccacccattacagattcgcatataaggccgctgataagtttgtcttatgtcgggggcgctgtgtgcctacctctagccgcgccgcccgcctccacccgctggttatagcgttcgcctactggcgccagtatcctaatcagctcaccaccgccttgtacgttccggtgtcacgtgccacggcagtggatcggccgatgtcatttgccgcctccccgctcccaccatccgtgctctaatccattcgccccacagccacattccccccctgcccttccgcgcccgttccgtgcggatcgcaaactcagtgtcgttctctcctctcacgacaggtcgcagcattggatcagccatattctcgctcattcagc

SEQ ID NO: 584490 - DNA, 460 bp, Homo sapiens
aaaaaaaaaaaaacaagtttatttgttcacctaaagtagttttaacagcataattttttaaaaatgaacactaatggaagatttatttaagccatacaaaagtagtttaatggaaaagacccagtattttaaacgttttcatttaaggaacatgatgcccactttgggatctatgcatcaccttcaaaatgtgggaaggggtattaatttcacatatttaatgtattatataaaggtatttaacaacctatcaacttttgacattttgaagaattaaaatttaagtctaaggatgataaaaggcttcatttatgtcttttcaagggcaggacaactgccttggccagggagactgagctcccctgacttatgggcaggccttgaccccgttacactggccttatgcattactttaaataaaagcctttgatttacatgactttgggtcaggaataccaga

SEQ ID NO: 584491 - DNA, 541 bp, Homo sapiens
  misc_feature (254)..(254): n is a, c, g, or t
  misc_feature (276)..(276): n is a, c, g, or t
  misc_feature (279)..(279): n is a, c, g, or t
  misc_feature (418)..(418): n is a, c, g, or t
gagaaacggagggtgcaggttgtgtagtagggtcacacatgcgtgcaaaatgcacactctgctcttctgcagacgggcagctccccaagacaggaggcagatcagagaagctaggagagctccagcagaggcacagaggattgggggcaggaggagtctggaacacagacttcatgccccgtgaacccaggacggaccctacccacgacctaaggtaacccagtcgtatactctgtacgcatgtgttgccaggnctgacaaacacctgcagatagntgntagcccacactgggacctagccaggaggttggagcagaaagggctctccctggggtggtgtactcctccacggcattgggatgctgttctgcctagcagcagaaaggtaggatggagagcacactatgggaccggggtnaaggagctgtacatttgcatatcttatagccctgattccaacagtcacgtgacagtgtgtaaggcgtaagtagaatagttacctttctcaaaaacaccacacgaccggttcctttttttccct

SEQ ID NO: 584492 - DNA, 709 bp, Homo sapiens
  misc_feature (41)..(41): n is a, c, g, or t
  misc_feature (50)..(50): n is a, c, g, or t
  misc_feature (57)..(57): n is a, c, g, or t
  misc_feature (63)..(63): n is a, c, g, or t
  misc_feature (83)..(84): n is a, c, g, or t
  misc_feature (86)..(86): n is a, c, g, or t
  misc_feature (100)..(100): n is a, c, g, or t
  misc_feature (116)..(116): n is a, c, g, or t
  misc_feature (124)..(124): n is a, c, g, or t
  misc_feature (169)..(169): n is a, c, g, or t
  misc_feature (174)..(174): n is a, c, g, or t
  misc_feature (223)..(223): n is a, c, g, or t
gagaccagcaatgactgtcatcttggagacaatctatgatnccacattgnagcaggnagatantgatctgcttcgccgtgganntngtactcgacgtcancctactaggacttggngaagaggngccagaatggcttctttgtcttggtgatattattgccttcacttngggtngtggagatgatgacctagatgggctctgtctgggaggtgtgctagattncactctaggaggagaggaccctgagcagctatgtctagaaggggtcctagatttcaagtcagggtcaggtgatgattcagaacagctccgtctctgtggcgttacagattgctcattggcctggggacttgtgatggaccctgtgcctcggtggtgtgccagacttgcacgtttgaggatgaccggagatgaactggaatgactttgtcgttgagggtgtcttagatttctgtaaggtggcggagatgagagctggagcgcactgcgtctgggtggcgtgcgtacgttagcttgagtatgggaggatccagagcgactgcgcctggggtggtgtctgtgactgttgcttagggcatggggaagaccctggaaggctgtgcctcagagacaggccgagatttggcttggaccgtggtgaacgaggagacctgttccgcttgagaattgcgagattctcattctgggcttgatggactgggctcgtgg

SEQ ID NO: 584493 - DNA, 384 bp, Homo sapiens
atagagatctgttctgattaccatgatgaggaaccggggaaccgactcgctttccctggtttagaggggaaggtttagaaaagtctagaataaaagcactgtgctggtctgacatgcaaaatgtcattccacaggtccccagagaggcatatcacatattcaggaatccacttttatccatcagaaatagatgtggccaggccgggcatggtggctcacacctgtaatcctagcattttgggaggccgaggtgggcggatcatgtgaggtcaggagtttgagaccagcctggccaacatggtgaaaccaatctctactaaaaatacaaaaattagccgagcgtggtggcgcgcatctgtagtcccagctacttgggaggctgag

SEQ ID NO: 584494 - DNA, 221 bp, Homo sapiens
ggacagttttcaagaccagcctaaacaacgtagtgagaccccatctactacaaaaaatttaaaaattagccagatagtgtagtaatctacagctactcaggaggctgagcagagaggatcactatgagcccagatcgttcaatggttgtagtagagccatagactgcaccacatgcactaccacgcctagggcaacagaagcacagaccctagtctcaaac

SEQ ID NO: 584495 - DNA, 137 bp, Homo sapiens
cctagcccctagacgcccggcaagggcggtgaggccgcatctggttgccggcgccgtgcgtgtccgttcacggatcacgctgcgctcttactggtccaagccggccttggtggtcggcagctggtaatcgccgcatc

SEQ ID NO: 584496 - DNA, 113 bp, Homo sapiens
cagagtttctgtgagcagcttaaagagggtagcccgaaaagacacaacaaccaaaaggttgtaatgcccgtactaatactttctaaagtggctttgaaatagtcaccacttca

SEQ ID NO: 584497 - DNA, 430 bp, Homo sapiens
ccactttctctactcattgatattacctgcctagcggctataggcattttagtatgtacccacacatgtaacactgcctgatttcttggggtggtagtaggttgtgtcatggatggtaatgactttttcatatgctggaactcttgagccctctggatttgatacccatatcaggtgatgagcttcacttggctccttggccacaggctgagtatctagccttattcccaaataattcagtcatctgagacataattaagaaaatgtggatgtaaacactgttcaaaacttgctggataggagatatacatattaaaattatctttcagatgcaacatattagaaattgtactctggattctgcctgtcagttggcacagtcttgcaaaaagtattgtataagctgcttgaaaaaaaaaaaagtcgacgc

SEQ ID NO: 584498 - DNA, 568 bp, Homo sapiens
  misc_feature (45)..(45): n is a, c, g, or t
  misc_feature (50)..(52): n is a, c, g, or t
  misc_feature (75)..(75): n is a, c, g, or t
attctatagtagtattggcaacaattctcttgatatgtaataggnaaaannncttttcatgatatagaattaatngcctattgtgaaatcaacaattttattgagctgccaaattgctacctgcttttcttaaagtagcattaacttctttttgttagtgtagtgtctccatgcttctaaagttgatgtagtaacaggatgttggcttcagcttataggctccctttatgagtgctgttttggtgaggagtgcatcggaataacttactgaacccttttttttttctcagaattctgccaaccttctgagtcaacatttaagacccttgtctttgacagatatcatttataggtttgaagatacacatactaattttggtaaaatttaattttcaattatagcaaataatgttcattggttttgtttttagtacattttgtatttctttctattataaaagagattttttcctaggtgcttttcttaagtctgtgttcagctttcttccactcttacttgatttaatatgtgactacatggttcaaaacggagaaaagaaaaaaaaaa

SEQ ID NO: 584499 - DNA, 129 bp, Homo sapiens
taagaagagaagcatagaagagactttatttatctagaatgcagaaatgactacctgtgctataccagagaatccagagaattattttgtatctctgtagcctcttacatcacctttattatacagcca

SEQ ID NO: 584500 - DNA, 120 bp, Homo sapiens
taggtcagtgtgtgagccagattcaaaggcaggtccaggtcgggcacagtgactcatgcctgtattccagcactttggaaggaccaggacaaaggattgcttgccgtctacgagcgtaat

SEQ ID NO: 584501 - DNA, 1020 bp, Homo sapiens
  misc_feature (338)..(338): n is a, c, g, or t
gatttcctatcttcacacctgccagctcactgtcacacctatcttcctcacctttttggtggagatggagtctcgtgtctcttgcccaggctggattgcaatggcatttaaccgccatgcatgtgcgaggggccactgagattgtctctgagctattacttgagaatcaaccagaaaagagccatggtagtggtatgcccttgggctctctgggaaatgggaaatcagacaaaggactgagaatgagttacccttaaggtcagtagaaaaccaagcagagtgtgcgtgtgtctgtgaagctgagcttacctctctattcaacctcattcccttctccnatataagccacttgttgccagttcgtggcccctccaggttggagaggccagcaggagaaaggcacagcgtttggaaaacaagacttttcctgcaataccctgggacggaataagacaggatatgagtgttccgaagcgaaacaatcgaggccctggtcaagggcttctgagtacgctgccaggtgtgtgcttcactccccggtgctttcgtgtgctgctagtatcgcgggtccctgatttaccaggacccaggaggcaagatctgcggtgcttcccatatcggagatctatagagcatcgcgacacgtcgcgtctgaccctgcactccagatccttagataaccccacctgatccccctagaaaacggacatcacacaccgcagcctgcggtgtacctgacgcagagatcaacaataacaaagagggtgactaagagccagccgggacaccggcaagtgacctcccaccagcacccgagaaatgacgaccggacacagagcaacatgcacgggacgcaaaccacggagagcacgagcccagcgagaagagaacacggcgcgaagacaacaagacagcaaggcagacaccaaacagacatatacaaccaagaccacaggggacagcaacaacaggcacgcagcacaacgtgagacaaccagacaacagccacagaacaagtca

SEQ ID NO: 584502 - DNA, 760 bp, Homo sapiens
agcggagtgcgtggccgcccggggccatggcgacactcatgcttcgtcttcctgctgctgggaggcagtgtcctgtgcctccggcttctgcctccggccaggagttctggcccggacaatcggtggctcgagtattctgtcggggcgcggcttcccgcacgacggtatcttctgtattacgtcaaccccgccgtgaaggcttcaatgctgctgcagggatgtctatatccgaatcgtcctctctccgtgaagactctgctgaagacgtgaggagtgggtgcttgtccatgcctccagtggggtccgcctcgtaccactggcagtagtcctgactagtccatccaggtccggattccctggtctgagttttaatgatcttccaagttctcatagtaaaaacatccccgtcatcgagttatgagcagttcatcgcagaatctggtgggccctttattgaccaggatttacgtcctgcaaagttacgcatgaggggtggaaacgaagggacctgggaagagaaggtggacgagcggccgtgtattgatcagctcctgtactcccaggacaagcacgagtactacagaggatggttaggcggtatgaggagaccaggggtctaaacgttctcctgtcttgtccgtccagggctcagacctccatcgtggcgccccttggtgctgagaaacacatcagccgggtccgtgattgttcgacagagccgaagaacctacgttcacgaccactatggagggaaacgaat

SEQ ID NO: 584503 - DNA, 120 bp, Homo sapiens
ttagaggatcccccgtccacacttgctgtcaggttgcgatagtattaaaacatggttagacctgggaaaaggccattcaaggaagcagatagtgaagtgatggacggtttgacacccact

SEQ ID NO: 584504 - DNA, 207 bp, Homo sapiens
aactattacacatcaaatctgaggaaggtgcttgcctgggaccagtggcagggaccccggaacctgaaggtgctgacaaagatgacctgctgctgttgagtgagatcttcaatgcttcctccttggaagagggcgagttctacaaattatgggcctatttgttatggtgactgccaatataaggatccattactcactttggtcctg

SEQ ID NO: 584505 - DNA, 401 bp, Homo sapiens
  misc_feature (41)..(41): n is a, c, g, or t
gctcactgcaacttcggcttttggggttcaaatgattctcnggcctcagcttccttagtagtggggatacagggtgcccgccaccatgccgggcttatttttgtattttcagtaaagagggggtttcccattgtggccaggcgggtcttgaactcccgcccttggtgaccggctgggggtctttgattctattattacatcagggtttttgggtggcctgaaattaattcatttttggggaagtcctggttcccccagataggtttcctgttaagcccatggaagcctcccattttcaaggggggggttgagggatttaatgcagctccgacattgcgggcaggggggggttgggaaaacccctacccctttttcccccattattttcctctcccccctta

SEQ ID NO: 584506 - DNA, 799 bp, Homo sapiens
gaattagtgttgggatgggctaaaacagacccttccaaaacttcggctagcagtggagccaccggatcttagattatagctagtctagcctcagtttgtggaaagtgatagatgctggtctataatagtgagcagtcacccatgataggacctccaggttctgtctcatatttgcttcttacttacctcaggaatgctcttgtacatagaacttatttcaccaaaaagctcaggccgatgtcgacaggtgaataactgtaaccgattgtatgacgtgcctgcacttacatgtgaactctctcagaaacagagtcttatactggtgtgttctcttgcatgcttctggttcaggacgtcttgatctgagatatggatttcgatttgagtatccgaacttgtcctgagtgctccaactgtttcactcgttttaaataaatagcctattatttgtagcactagcctagagcagcttccacatagcaatgagcatagttactgtcaggaggtcgaggaaaggaacttgtgctgaacttgtgacatgtatcctgataatcaaggcttagaggaggaagtgtgtagaagataagagaaagttgttctaaattgtgctgaaactattagatgatttagagtatacagatatgtaggtattaatttctctattcactattatgtgatctggtggcccttctcctaggagtaagtatactggtaaggatgaaattagtgaggtaaatgtttatgagcagtcagtacaattggaattcgagaggttacaagatatgtaagggggagggga

SEQ ID NO: 584507 - DNA, 85 bp, Homo sapiens
tttttttagataagccatttattgtaccattcacttttctaaaaaaacacaaatgtgaatggtcaataaatggcttatctttcat

SEQ ID NO: 584508 - DNA, 263 bp, Homo sapiens
tagtaatgtactgaatcctgcctgctcatgctgctttctataatacatgtctccatgtcatcaagaggttggataacttattactaagctcaaggttaaaaatcatgtcaccttttttttttttccccctacacagtcctcaaaaaattggcgattgaggaagtagcatgaccctaaattgtgttgctaaaactcaggcagcccgagcctctggtctctccagaaagcccgtcttcacttttctctatccctcagtctaaaca

SEQ ID NO: 584509 - DNA, 185 bp, Homo sapiens
ttggactcatggttcctcatttccgcagtctgcaatgttccacatcgcactatttaacttcccacaaaacattgcgatttgaggctcagcaacagcaaatcctgttccggcattggctgcaatagcctcgatgtagccggccgagccaagcaggcgccgtgagccccaccagcagcagacgcagg

SEQ ID NO: 584510 - DNA, 1725 bp, Homo sapiens
ttagaggggggtgtggttaaagaggtgtggtgttatgtgtgggtaggtgggagtgagtactggtgtgggtgtagtgatggggagtagtatggtgttgagtatgtgtttgttagagagttgtgtgaaaggtgagagcggttgttgttggaattggggcgtgttgttagatgatagccgtagtgtggttgaagtgtttagtggaagtgagttgttgtgggttgtgagagtgggtggggaagagttggggttgggtattagatgaggcaaagttgcgcgtgtgatgggtagcagagagtgttgtggataaggagttggagtggtggtatgttctgagtcgtatagatgtgtggatgatgaagtggttggggttgcgaggcaagggggaggtgaatttggagatgtggtattagagtggaagtgttaaggctgcgttgtatggctcgttagatgatgggtgtttggggagtatggttgtagagtgtgttagagcgcgtgtcgtgctgatgatggaaagttggcggtcttagtgtgtgtggggtggtacagggagtgtatgaaatgtttgcgtttgtgtgaggtgtaaatggtagaaatttgtggggtgggggggtgaatgatgcagtagagtttaagtttgggattgggaggtttgttgtataagtaagaaggggggttgttagaggtgggtggtggtaaggagggaggaatgtgtgtggccgcacaggggtctgttagataagtgttggtgtgttggcgtcgtgtggcggtgtggtgcagagagtaatggggtgtaaggactagatgtttaatgggaagtgggggtgaagtgcgttgtgtaggggggggttgtgagatagtggtggtgttgaacgtaggtgggcgtgtggtttttagatagagtgtgtgtaataaagataggcgttagtgtgggttgttgattagttaatcagtaagccagggtgtgtggaagtagtttgtgtgagaaggcaaggcggtaggatagttttaggggttgtgtgttggagggggtaagacaagtttgcctgggtcgtggcaggcctgttgtggtgtgtagggtgttgtggcgtggcagaggtagtaaaggacataggagggagatgatgttgagaggtggttgcgtaaagaaggtgagggggcgtgcgtgtgagggcaaggtttagagagagagcgtggagccagggcattgtttgtggtgaaagctagcatgcaggttgtatctaggagagttgtgtgtgtgtgttgagagtgtggagatgtgcagagtcgagcgtagagaggaagagtgtaggaaggagcaggggtgcgtagtgttaggcagcaatgtagagggctgaaggagaaggcagcgtaatgttgtgtgtgtagggttgtaagaagtagtatagtagtattgtgttagttcaggagtgttaataatgtgttaaggcgtgttagtatgagttgtagaagtagtagtgtttgcgtaggttagcgtgtagtgtgtagtgtgagctgcgtgcaaggcagcttgtgtaagagaaagttagggatagttgttaggaagtggtagcactagtgcagttcaaagtgaaagtgtgcctttcacgtatgtcagttctaagaaaacaaccgctcttgtttgcagtcataaattagtcacaaatgcacaaattaaagtctatatagagttgaaatttgtaattaacggctcttggagtagttctt

SEQ ID NO: 584511 - DNA, 996 bp, Homo sapiens
ggagagaactagtctggtttttcttgtttgtatgccctatttatccaaaattaattataatattttattcaggatgatcaagccttcaggaggtcaacgaacacaagcccagcacagagggaaaaaggccaacctgctgaatgtgcagcggcctgtcggggaggggctgaggcttcggccctcggaaggctgaacgcagggaggctaggagaatagaggatcgggctatacaggtcctcccaattccgggagaggtaaacctccccctccgtgcaggaagaacaaagttgaggaaagtggaaaggggcctggtggcaccctcgggggggacaaaccctcggggagggggcgccacgaatgtggccccatcattccatccgaggggggccgaggggcccgacaacacccaccccaatgaaggtgtgtacacccaagcaaagagactggggcggggcaccattaaataaaccgccagaggaacagggtccgacagcagccatctgaccccttcccaatagatgtgagggcaggtagcccctgggaggtggatgagcccctggtttcggacgtcctgggcggagccccaattcgtaaccaacggggggtacaagtctagcaagagcacggacaaagtgcaccgggagccctggacggtataaaagctgacatgtgaacgaataaaggggtctctcacggcccatccccaagaaagtgtgggtttagcaccgcccaatgaatcttcgggcacggggtgtaggtaccaccccggggagcaaaaaccgcggggaacccaggcgacatgaatggcggaacccaagatagagtaattcagcaccagtgaaggaacacatagctagggacactcagctgcaaagagcagagaccgataagacacgaggcacgccacagcaaaaacaagacaccaacagagtcgtagtagggagacacccccaaacaaccagcacaggaccgatgtacatccaaacgcacaacacg

SEQ ID NO: 584512 - DNA, 321 bp, Homo sapiens
acgcgtattaacagcgtaattatacaagcatatttaatgctgagttactttaataattatacatatggtaattgtagggtaatacccacaacaactgcgtttcttacttgggcattagaatgcttatttaagtgttagacttccattctggcaaaatcttgtcccaatctgtgtttgctttctgcttgctacatttgtctccctcacttttcttgagctaaagacaggctttttccaccggcatcatcactgctatcatcattaacagcgtaattatacaagcatatataaagatgaaaaagagagaagggtcatgcagca

SEQ ID NO: 584513 - DNA, 332 bp, Homo sapiens
  misc_feature (32)..(32): n is a, c, g, or t
  misc_feature (38)..(38): n is a, c, g, or t
aagccatgcccctggggaaagggaaggcatcncccacnaagctctaatctttgccttagctttaaagtgagtgctgctaatgtccacccctccacccgaaaatgggggtcgctgcccttcactcctacccccagaggccttggcaaagctgctgctttgaaagggggatcttggaaacaggccatccaccctggagcctcatggaacgggatgatggcactgagaaagccaatgaccgaaacacttttctctgtaaaaatgtagactgaaaagccatgtgtattttcctatgtgctgtagctctcctttggaaataaattacaggcatctgg

SEQ ID NO: 584514 - DNA, 137 bp, Homo sapiens
tgagccggccccactgttaaggtctatgcatctgcgttagatctgaatggcttggagcacctcttcaattttaagagaatcaggccgggcacggtggctcacgcctgtagtcccagctactcgggaggctgaggtgg

SEQ ID NO: 584515 - DNA, 243 bp, Homo sapiens
  misc_feature (141)..(141): n is a, c, g, or t
  misc_feature (225)..(225): n is a, c, g, or t
cctagttttagaagtttcaatagcaacagagacttctcagcagaaaccttacaagccaaaagagattagggtcctgtcttcaacctctttaaacagaacaacggtcagccaagaattttttatcccacaaaactaagtttngtaaatgaaggagaaataaagtcattttaaacaaatgccaggggaatttgtccctaccaaaccagcactacaagaaatgctatngaaacttctaaaactagg

SEQ ID NO: 584516 - DNA, 708 bp, Homo sapiens
agcggatctctttcaaggttactgtgggctgtctgaactgctgggtttctgcttgtgtcctctggactatgcagcgtctggtcgactccagtgaagcgcattctgtcaactagacgagagcggtgcaggaaacctccctcacacctgtctcgcctgctcccagtagcccaacaaaggttttctacagcctctgctgtgccccctggactcactaatcatgatatcttggtcaataggacgtgggcatcctgggccctgttaggtctactttctcagcccaatatgtggatccaatagcagatctgggatgaagtataacgatgtgggaagtcaggaatagttatacagatgtgcttgggccagacccgtatgggctactgctcagatccgatgaaggagatcaacatgcctgtgcctgacggtggtgcatgcgagttagataggagactgcatgacagtctcccatgggtactctgtgggcttggcctggcaacgtaggctactgcagtaccgatctattgaccaatgtccctatagctgtctaaaacgagatggctcgattggaagctcttcgccggattcagagcgataacttggatctgtgagggacctagataatggacacaatgcctgtctacgaggttggtgactgcctccctcttcaaatgtttgccgaactggtatggcagttccagattcctgagggag

SEQ ID NO: 584517 - DNA, 137 bp, Homo sapiens
cgagtggctttctaaacccccaaacacatttccttgcagtattcacatctcagatgagtggtgactacgtacttccggaaacgtccgaacttgacagcatgtattttaaatttatgaaataagtttctctatttgta

SEQ ID NO: 584518 - DNA, 684 bp, Homo sapiens
taacgtcgcgcatctcgccttgttcacccattttgcgctccggaggtccgtgtgttgccctgcacgtccccccgccagggcgccaggcacttctgggcccttgttttcgttgggaccccagtcaccgctttctttgcaatgaccccactctgcctcttttccaacgggatgcgccttaaacgtttcaggctcgcccactcgcctcccggggatgtctcgtgcgcgtcaacacccaaggttccctaagccgtatgacaatgggagaccccgtcgggggagaaccccttgttggatgtgaccttagggtgcagggacgcaattcaggaggctaccaggggagcatgcgctgactgcacccttggcaacactgacatgtgagatacgacatggtgctatgccttcctgcgcctccactagcatcgacggtggaccaagggctttcagtgtcacatgagcaagtgacattggcaccgcccttactctttcagtgagtcttgcccacattcttcatgagatcagtggtccgatgacagggacccgcacacaggcagacagtccgtcgtaccccttcatcgtggctccccatcaacggtgacactgactggtgaacggtcatcttggttggtctggacagtagcatagctgtcatcatgaggaacaatagatataaaacgggaaccagca

SEQ ID NO: 584519 - DNA, 356 bp, Homo sapiens
  misc_feature (352)..(352): n is a, c, g, or t
gcacgagagaatcaatgggtggtacaacacttgctcctgaaagagtggcgcaaaccgtgaaattcatttatgatatgcctcaaacggtcaacatcagagaaattgatattgctgcaaccaatcaaaatgcttaatatttaatatcttagctaaaaaagatactagttaatcgctagtatcttttttagctatttatttcatattttatctaggagataagctctgcctccaaaaacttttatttagaaaatattttcttaaaaaaattaggtcctttagattctttggttgcttcaataatatcagttgccataagttctggtcttatgtgataacgattgtaaagttcttntttg

SEQ ID NO: 584520 - DNA, 313 bp, Homo sapiens
cctccgctggccatgcaaaaatagactaactgacttgtgcctggtaatgataccattaggtgagactttggttcatgcagtcggctgcgcaaaggttgcaccgaaaagccgcatgcctggaacccaaagtcagtcagcggtggtggctcatggtgtcagccgtgctccttccacaaacaccaggtgacatactgtggtcaggcatgcttggtggcaaagaccaagcccgtgtcattgtgcccatccagtccattcagccaggatgcttccgctggccaggaagcttgagcctctactttgatttcctgtactc

SEQ ID NO: 584521 - DNA, 547 bp, Homo sapiens
ttgttgccacagatgctgtaattcataatcacgcccttggccagcaggataccccttatccaacacccataatcttatcttgaagggtgtccttcaacccatgcaatactcgtatgagggtgatgtgaaattctacagggtgagcaggcccctgttgttgacgtgtaaggtttttgcagacattcaatactacacagttgactacacctacttgaaagaaacgccttctctagtgaacgatgaacgggccgcctgaataacctatgcgagaatcgcgggcagcataaggactctctcttccataacacatgaaccgaggagggaccacctctgatagagagttgactgtgacatagacgtgtgacatattgagcatctctctcacagctcacattggtatgcgcattcttgatgatcacacacttccgagtgagctctatatgcttctgagacacggacagagctttagtacttatgtgcagggaggagcactatgctttgttgctggtaaagcgtacttcgaagaagcctggccacttcagttgct

SEQ ID NO: 584522 - DNA, 211 bp, Homo sapiens
gactctcgaggattcctcttctccgaaaggaccatgtgcagcaacactctgatgggcagtccaaactcttgggaggaagtaaattcatggtaaatgtcatgatggctggtcgaggagaaggtccccgggatggggaagagagggagacagagaaatgctacagcttaatacaataacagtaattgagaactagtgtggtttcacacgccat

SEQ ID NO: 584523 - DNA, 491 bp, Homo sapiens
  misc_feature (1)..(1): n is a, c, g, or t
  misc_feature (316)..(316): n is a, c, g, or t
  misc_feature (365)..(365): n is a, c, g, or t
nttcagccctctttttagatagcatatatagtgtaactttatgccaagcacttttctaagcacttgatgtattagctcatttaattctcacaataagctcataaattaggtaatgatctttccttttttacagttaagaacacacttaaggcacagagagattatagtgtcacccaaataggtggtggaaataagctccaatccagcatcttgtctctgctcttaaccattgtgttaaactacagttaaactgtagagtggagtcccctcctacctttgaggcaactatggccataacaatagatgtttctgcatnttagaacatattgttttgtgtggcattttaaaagtttttagaaatggtnaaatatagctgggcgtggtggctcttgcttataatcccagcactttgggaggccaaggcgggaggatagcttgagcccaggagtgcaagaccatcctaggcaatatagtgagacctcatctctatt

SEQ ID NO: 584524 - DNA, 141 bp, Homo sapiens
ccttggggcccccccttcccccttttttgtcccccaatttgaaatgtaaaaaggcttttgttttccctgggggggggggggggcagccggggtttccttgtaccttgtttttagcccagttgaataaaagggcccccctta

SEQ ID NO: 584525 - DNA, 1065 bp, Homo sapiens
atgtcccgcctgctgcatgcagaagagtgggctgaagtgaaggagttgggagaccaccatcgccagccccagccgcatcatctcccgcaaccgccgccgccgccgcagccacctgcaactttgcaggcgagagagcatcccgtctacccgcctgagctgtccctcctggacagcaccgacccacgcgcctggctggctcccactttgcagggcatctgcacggcacgcgccgcccagtatttgctacattccccggagctgggtgcctcagaggccgctgcgccccgggacgaggtggacggccggggggagctggtaaggaggagcagcggcggtgccagcagcagcaagagccccgggccggtgaaagtgcgggaacagctgtgcaagctgaaaggcggggtggtggtagacgagctgggctgcagccgccaacgggccccttccagcaaacaggtgaatggggtgcagaagcagagacggctagcagccaacgccagggagcggcgcaggatgcatgggctgaaccacgccttcgaccagctgcgcaatgttatcccgtcgttcaacaacgacaagaagctgtccaaatatgagaccctgcagatggcccaaatctacatcaacgccttgtccgagctgctacaaacgcccagcggaggggaacagccaccgccgcctccagcctcctgcaaaagcgaccaccaccaccttcgcaccgcggcctcctatgaagggggcgcgggcaacgcgaccgcagctggggctcagcaggcttccggagggagccagcggccgaccccgcccgggagttgccggactcgcttctcagccccagcttctgcgggagggtactcggtgcagctggacgctctgcacttctcgactttcgaggacagcgccctgacagcgatgatggcgcaaaagaatttgtctccttctctccccgggagcatcttgcagccagtgcaggaggaaaacagcaaaacttcgcctcggtcccacagaagcgacggggaattttccccccattcccattacagtgactcggatgaggcaagttag

SEQ ID NO: 584526 - DNA, 410 bp, Homo sapiens
aactggaccgtcgctttaaccagttcgggacgggagtcaaatggtggttaccagaggctgggaagggtaataaagagtagggaggaagagggtttggttaacaggtacaaaaatatagctagataaaaagaataagatctagtgtaaggtagcactaagaggagcactcatagctaacaataattcattgtatatttaaaaaaactggaagatctagaatggtcacaacataaagaaatgataaatctttgagatgatgagcatcacaattacctagatttgatcatctcatattgtaagcttgtatccaaaatgtcacatgtgacccataaattattaaccactaatggtgttattcctattattggttttaaaaaatacaaccattattttggcttacacgttcgggc

SEQ ID NO: 584527 - DNA, 282 bp, Homo sapiens
cgaggcctggtgatcctcgcggtgtatacctacatctatggggaggccgcggtgggtgggtcagctggagtgtcaggagttcgagatcagcctggccaagatagtgaaactccgtccctacttaaaatacaaaaactagccgggtgtggtggcacatgcctgtaatcccagctactcaggaggctgaggcaggagaatcgcttgagcctgggaggcggaggttgcagtgaggtgagatcgtgccactgaactcctacttgggtgatagagtaagactgtctc

SEQ ID NO: 584528 - DNA, 361 bp, Homo sapiens
  misc_feature (186)..(186): n is a, c, g, or t
  misc_feature (196)..(196): n is a, c, g, or t
  misc_feature (245)..(245): n is a, c, g, or t
  misc_feature (255)..(255): n is a, c, g, or t
  misc_feature (287)..(287): n is a, c, g, or t
  misc_feature (329)..(329): n is a, c, g, or t
actgatgtgtggaagactttttattttctcttcatagaaggatacaatagatttgttttgctcaaagagttcattttctgttgctgggcacatatattatactgtaaacacatttctggatatgacgacataatgatgaagagagacctttgaatattttcttaaatgaagattgaaggagtatangctgtgagangagatttttctactatttcagtcctaagattgatcttttttgtcatggntttatccctntgtctctatgcatttctatgtgtctgctcagnatcttatcttctacatttgccctagttccatccttccttttntccatgcttgtttttccatacacctgcccatc

SEQ ID NO: 584529 - DNA, 360 bp, Homo sapiens
agaggggaccccgtgcttccggcgcgcctggagaccaaggtgaccgaggaacacagggccagtcgtagtgaaatcccaagacctccggagcgcaattacccccttggagttcccctcaacttctgcatccagggacacaactctgagggaaacgtttttctaaatagcgtgataagcctggcatggtgatgcgtgcctgtggtcccagctacttgggaggatcacttgagaccaggaagtagaggccacagtgagccgtgactgcaccactgcactccagcctgggatatttgtttatttctatgttactttgtattttttatatttttcaggctacataacattttgacagtttacata

SEQ ID NO: 584530 - DNA, 1806 bp, Homo sapiens
ggcttgaaccccaggtcgggaccgatgtctggcttggtgctgctgccagcctaagcagaggcctgctgcccgatgcttgctggcacgaggccccgtgggtcagtggctggctcctcctgctgctgaccccacgtgaccctcccgacccctgagccccgtgggcttgctggtgcctgcctcctggtgcagagacgcatgcactttacctgtgtgctgtccccgcctgggcacaacaacgtggtccaaatgtcagtgcacatcaacgggtcctgacagtgacgtcgcacagcgagtcagcatcttctccaaactctgtttccgaacaatccgccctggtcacgtgacacgcccaggaggccccaaccctgcacccacaaccctgccccctggccacacatcttagaggctgtgtcgcacccacacatactgcgcaagtcacacgattgacgacagcactgaaccactggacgaacactcccaaaggcacacctcactctgcctgccctgcagcgctccgacggcacctgcctggctccttctcctggcacatcgcaggccataactctacacagtagcgcaacaaggtgccaagcacacctccacacactatcctgacgtaccactgcaacgaagatgatgcatggagcaaccccgcccaccccacagaccacaaaggcgcacgcacggcagctgccaggcgaccgcaccgagcaacccacagccgcgccccccccgcgccgccagccaccaccaagcaagaacacagacccagcacgccaaccaaacgcaccccactagcgagcaacccaaggaaccagcgtcagctcgcccacatcggacacccgtccacccacccacccccgcgccccggacgacccacacccacgccaccgcgctgcaagacgcacacccaaccaccacgacgcgcgcggcgccacccgccgaacccagcgcaacgcaacccgcacgccgcccacgaacacccacacacccgcaccccgcagacgcccgccccacaacacacaccaaagagcaccacacgcccccaccaccacccccgccccaccaacaccgaacccacacccgcacaccccccagcgccgccacccaaggggaccgacacgcccgaacggcgagcccccgccggacctcgcagcgcgcggcgcgccacaccaggcccggcacgcgccagacgggagaacagaagatcaacagtatgagaggagagacgaaggggcgggcgggggcgacgggggggaggctgagggagggcgacgcgcgggacgggacgccgcggaactgcgaaggctgcacgagcgcgagacagaagaggcgacactacacaagtccatcaccactcaccactcctccaaccgacccaccgaaagccactaatcctcccagctcactcagcacatatctaacaccagcgccactcgcataacatacatcacgtaagagcacacagccactacgccgcatcacaccgaactcccacacacgacacttaacaccacactcatctgccacaacacataaccaccacctcaccgccatgcacccaggcgaagcacgcacacgcgacgaccggcgagacccctgccgcgcgccccggcaacaccgccggagagcgacggcgacgagccgcgacagaagcgccgccacgcggccgccgaacggcccagagggcgccgcacggcgctgccgagacggctgcacggaggcgtgatgagaggcgccgcagcgccgaccgccgcagcggacccggacgacggccggcgaccgacgaggcggcgagaaggagag

SEQ ID NO: 584531 - DNA, 308 bp, Homo sapiens
ctccacacatctgtaccattcttgagtgatcgcttaggaatgaatgtgatttgaactcattcatgttgagaggtaagtaaaatatttcacttataataatcaagggctcaaaagatgaaaaatagaaattacaccatcccagtatttcaggtatacacagaatttgtagattacttgcaaaaatttttacaatgtatatattgtatagagagggaaaattaagagacttcatgtctatacctccaaacgaaacttcctgtgttctttgcatcattatttaactggcagttccacatatttcatcctaa

SEQ ID NO: 584532 - DNA, 511 bp, Homo sapiens
agtcctcttactcctcctatctgcatgttcggggcagacaccgtaccctctccgcactcccttgagcaggtctgtacttacagtctccaggtacttaagcatctccagattgcatgtgaaccatttgtcatgttgctatttctagcgtatgtctttcatctgcgaatactcagagctggggagcttcattgctgggctctgggctgggcctggtggtatatccacaggcgtctttgggtgccagttatatggtcttcagctgttttggtattgaaatgatcagctgaggaggaatcgatggagtccttggactaatgtgtgcatagaagtgtgactgttatgagggaaggggagaggggaagacattttctgggtgttgctacccgccgactgtacttatcgaggaggaccccagataaagttgtctgagggcgtgtagatgtagcggggcgaaccgaaggagcttactccgatgctcatctgtctctaatggtctaagcaaaatactcta

SEQ ID NO: 584533 - DNA, 436 bp, Homo sapiens
  misc_feature (4)..(4): n is a, c, g, or t
  misc_feature (28)..(28): n is a, c, g, or t
  misc_feature (380)..(380): n is a, c, g, or t
  misc_feature (423)..(424): n is a, c, g, or t
ttgnatctccccactctggaacccttcncccatatttggaagacctaacagatatcccatcctaccctcactgttatgggctgaatttttctccctcaaaatttatatgttgaagcccctaatcccccagtaccctcagaatgtgactgcatttagagatggggccattaaagaagtaactaagttaaaatgaggcctttagagtaagcccttatctgatctgactcatgtccttataagaagaggagattaggacacacagagagacaccagcgatgcacatgcacatagaaaagtcgtataaggacacagagagaaggcagccatccgcaaaccatggaggaaggcctcaaaagaaatcaactctgccaacaccttgntcttagacttccagcctccagaactgtgagaaaatgaattcanncttgtttaagcc

SEQ ID NO: 584534 - DNA, 1763 bp, Homo sapiens
  misc_feature (1763)..(1763): n is a, c, g, or t
ggtgatcccgcactccagtccggggccttggcctgcggatgccgccgctattcggatatgtcgtgcgaatcccatctctgtagaccccgcggcctgtaggcgtgtcggaggcgttcctcgtgctacccggagattgccgtggcgtctcccggtcgtagctctgggctccccggcgactcatcccggtactgagaagtccgtgtttctcgcgctgatatggtagtgcgcgcgacaggggccggtgctcggcatagttgggtggagcgtcgtttgacttgtttactcaagactgatttccgtttctcgaatcggagacttcaagcgtgtatggattggtcggagatagccaacgacacaggaggtagcgtgatttacagggtgacgatgtacagcggagcccctcggatctcgcaggagacctgagaggggcttcactgggaatcttcttatagtaggacttacctaaaggatatcccctcgctatatccaagcatgcgagcaatgcgctctatacgttcgcacatacgaactatccgtagctgattgctgggtcgcctcccttcaccccggctgcacgatttctgctaggtggggcctcgacgaaaccacgccaggttcgtatccgacgacgatacacttggcttgcgttttcagtgtaggcccttgtctcgcgtgtataccctctagccatagtgcgacaggttccgaacctcttttttccttcctgacgccacctccttccacgcaatttttgcaaggttcccgacatgctctgcccggaacacccgcgcgtgaagccggcagccggattgggctccgttaggccgcacgccgacccgtttgcccctctgacaacaacgcaggggggtcccctcttggcctagaggaacaggcctggtgtgggcggtctccttgcgcccttggattccaaacgacagccaatggccccaaggagctttgaggtccatccccgtttctctctccccccttgggctgccaccagggtccccagctgcggtccttcctggggtggggcccactttggacgcgacattcacgacaaacggcccctctggttctgctgccccatcgtcgggccccccgaagcagtcttacacccccctcgcgaactctcggctctgtctcctacggacttatgcccccattctccttatcggcactctctcgcctcaatctggttcccacaccttgcgtggcgctgctcggcgcccccccaggcggcacacgacgccgcggccgcccacgcctactttctctcaccctcgggtgcttacaacagcggcgacaccccgccgcttaaccgacgtcttgctagcctttcctcttcccgcacgacatccggggttggggcacggaagtgtccttcccctcacaacgggctcccccccgcgcgaggctacactggcccctctctaacacctgtgtgtgggcccccaccctgcgtggaccccgctgggtcccataccctgcggtgcagagagatccccgctcccaacgcacactctgtcaccgtactagtcgtggctctctgtgggcccccacccggcgagcctcccccccctcactctgttagagccggcgctggcggcagccccacgcctactcccccaccctctaacactcacgagcgacgcgtgctcttgtgcagtacacacgacgaccccactgcgcccggcgactgtgcgcgagctcagaactagtatcctggagccgttcaagctcgtcggctggccgttcttctn

SEQ ID NO: 584535 - DNA, 149 bp, Homo sapiens
gtgcctagaggatcccgacaacaactattatatttcaaaaatatttgaactcaacataaattaatttcttaaaaagtacacttctcatactatgtgttgtggcgattagactctggttaactcttgtgcagcagacacctacgagatgc

SEQ ID NO: 584536 - DNA, 442 bp, Homo sapiens
  misc_feature (91)..(91): n is a, c, g, or t
  misc_feature (209)..(209): n is a, c, g, or t
gacttcagcatctgtttgctaacgtggtctcccacaaccagctaaaggctgtttgattgattgccggtcctgtgtgctcggtttgcatctntccaccagccttatcatcctgcatgagttacctctatacatgtgctcatgtctaagggccaggtctccccaagagcaggatcaggtcatgcctttgttactccagcactaacagtgcntacgtgcataggtgtccaatgagtggggagtacttaaatggttgaattctactcaaagactcacgtgaagtccttatgactgcattttctctaagtctgttttttaaaaaatccaataattagcttcttatggttcatatattttctctcaagtgtaagacaatatatattttaggattttgttttattatgttttgctgggaaaaaggaaaactctttctgggacatagggt

SEQ ID NO: 584537 - DNA, 201 bp, Homo sapiens
gaagcctcttactcacgtggcttaaaatggagttcaaaagattgccattgagttctgattgcagggactaacactgttaatctgataaggacagcaaactcatcagactcagtgctctgtgattgtgcttcgagctatgtggtaacatatgaaggatatgcacatgaggctctgtatctcctgtggccttgagcaagacct

SEQ ID NO: 584538 - DNA, 110 bp, Homo sapiens
tcagctcggtacctgactctgtggtcatggcagaagctcctcctggggtagagacagatcttattgatgtcggattcacagatgatgtgaacaaaggaggtcccgggctt

SEQ ID NO: 584539 - DNA, 454 bp, Homo sapiens
ctaaaccctttgcactgacttgggaggtaatggtaagttttattataggggatatggtgcttggtatacacagcgatggattgaggagactgagctggggcagggtaggcttgtgagtgttagtggggtacgatgaggagattgtgctgtggtgaagagtatatgggtgtgttgtggtaacttatagtgtaggaggctgaataattatgaaggagaggggtcagggttgattcgggagatcctattggtgcggggggcttgtatgataatgggcgttgattagtagtagttactggttgaacattgttctgttggtgtatatattgtaattgagattgctcggtggaataggttatgtgattaggagtagggttaggatgagtgggaagaagaaagagaggaagtaaagtttaattatgcctttttgggttgaggtgatgatggaggtggagat

SEQ ID NO: 584540 - DNA, 320 bp, Homo sapiens
gaaaagggtcgctggttgcagctgaaatgacctgaaatgtagcctcagtcttaagtaaagtcagtatgagttgccgcacatctctattgtgtactatagtacggtactaggcagaaaagtcataaatcaacaagccagtaggattttgccttagcccttaagctatacataatagcatctaaattattgatattcctaccaggagactagtgtatatactagtaccatacacctagatgtaattaggaccctagtagtattaaacaactataggacacccaatacactacacacccactatagacgggggatacctacta

SEQ ID NO: 584541 - DNA, 983 bp, Homo sapiens
gacgcaagcagcgtcattgaagcgcttgttatcaaccgcttatgagtgaacctcaagtgcctggagaatatactcgcagctttccgacggtagctgaaccggaatagatagttcctttgcctctcaccagctaggcacgatagtcacacgggtcgtatggactctatcgatgacaggcatggtcctgtaggatagagcatgtcccgtgacctggactgtcttaaggtgtagccgattattcgtcaaccatcgaatattctccattatcttccccatgcttggtaaaatcgaaagagggatttaggaacctgggcttcggtcagagccttgcagccttccatcacacctcaagtcccgttggggccagttgggagctcatatctagacacagagacacatagcatcaacttcaagaaaggtgacaatttgttgcagctccagggatggcgaagcgtgggagatgggtagacgacaatcttgatagcaggaggacaataggtgaagtgcccatgaatgccccacgactaggctatggatgctacttgtgcctcgatctaacatgtgtttgccctcactatcacacacctcccggtcgttccatgtcgacctgtacctttttgcgctcagacctcgattgggacaattattctgagtttcccttaaatgggaccgctagccaacaaggattatccaacggaactatcacgcttcatttactcgggctcaactattacctacaacataattcctggctttcatccgcacaaactaatagttccagttttacaatcccaaacatcactaaggcttcgaagacgcaggctgaataacggcactcggtcacaacgaggggatcgaacaattctggaagtgcatccactatggatgcagggactaccaaaacaagacaagacgaaacgtcaacagaaccgaaaacagaaggggggcacacaaaaaacaaaaaagggcacaaaccaaggacc

SEQ ID NO: 584542 - DNA, 790 bp, Homo sapiens
ctaggaggaagcccggtgttaatcggacgaggcacacagctggtgtggaccatcggcgggagagagtgccacgcctccacagcttgccccaagcgctctgcctgcccgtccactcatctgcccatggggaagtctggctcactgggacaatgggccactgggctggtctgtgtcttgggcctgtcccatggctggtggcatgtgatgtgggtgcccatgtcatgcctcttttggtggcaccctactctcatgccatggtcttgtgccctactgccagtcacccatgcaccccatgatcacctgccatgtgccatgccccacaatgtgtccccattactggacatgtgtcccatgatgattggacaagatgtgcaccacatgtgtgcccccagcctgtcacttctgagcacatgccctgtgtgtgctcccttgacctgatgtgtccccctgccatgtgctactctctaactaactgctgttgcctttcactgtgacccctgcttggaagcttgtagcttgtgcaatggctgatgcttctgccctggcctgctctgtggtggtggtggatagtgtggactgacggccagccagccatgctgtggccgggggccctggtccatgtgtcccgtgtctgtgttgctgtgctgccgtgccgtgtctgatgtgtcagtgctccgggctgcgctgtccctttcatcaaagccttacctttgctttatgctcttgtgggaggcgatggggggccgcgggagccggcccggggttatgctgccacaggggctggtaccca

SEQ ID NO: 584543 - DNA, 114 bp, Homo sapiens
ctcagtttcgtgtgacggggtgcgcgtcaaggacaccgtctacacggacttcgatgtggagccgagtgtatatgccctccagagtgtgatcctgctaccatcgtctaccatgtg

SEQ ID NO: 584544 - DNA, 161 bp, Homo sapiens
gcgattttatcaaaacatttattggtggtaaaatataacaccaaatgtgtcatttgaactggtctatatagtgcagtggtattaagtgccttcataatcttgtgctaccaacaccatcatccagctccagaactttttcatcttctcaaactaaaaatctg

SEQ ID NO: 584545 - DNA, 200 bp, Homo sapiens
gcaacgtgtacatctcggacggccccacgtggaccagcggggattttctcggtaaccacggcagagagcagcgcccatgttaagagtgaattaatgtaactcctggtgttaagagtaatgtaaaccctgcggacaatttagacctctttctcttagactcttctaaaacaatgctctgccttgggcgttacctaacaggg

SEQ ID NO: 584546 - DNA, 126 bp, Homo sapiens
ctgctggtggtcgccgtagccgagaagcgagagaagctggctgaacggcggggagggacatggcaggaggcgacctgttgttatctgagcattgcactatgctgacgccgtctattggcgcaacgc

SEQ ID NO: 584547 - DNA, 149 bp, Homo sapiens
actcttgaggatcccggttgacgtgttgtgtgggtcgagagcgcctcatgtgctggtgctgttgtgtgtaggtcccgtgggacacaagcaggcgccaatggtatctgggcggagtcacagagttcttggaataaaagcaacctcagaac

SEQ ID NO: 584548 - DNA, 988 bp, Homo sapiens
actcgtaatcaagggtttcgccgcgggggttacgcgggtggtcgtgtcctgatccaggagttggttctgccgcccgactgagatttccggccattgcgttttctacacaagtcttcagaggtggtcttgcacaccgtgggggcacgcgatatttcccccgtggtaccccgggctccccgcacgtgggttttctgcccccccggcgtatttgccgccgttccccctttttgtgggtccccaccgggcccacgcagcatgaagttctgcttccaatagaaagacattgtccccgttcggtgtgcaaacatgcggcggacgcccctcattttcagacaccttgtggggggaccaccccactgtaataaatttggtccccccggaagagccccccaccttcgttggggaggcactgtcgcagttccgaacaccattgtgtggcgccccttttgtccgctgtttggaatttgaaggacaaccggacggccaacgcgatgggcgggtctattcaaaaacaacgcgggttcacacacaaaatccggtccgagccagggagccacggagcgcaactcacacattcgtctctccccggtaagaccattccaataggcgcccacagggtaagttttgtgccctcgttgcagctgggcaccccccccgttggtacgcaatgcgggtggcaggagcccggcttgccaagagttggttgtatcatagacaggcgccatcaattactgtggtgacgttaacatcccgtttgaagcaagaacatggcctaagcaggtttaggctcccgcatgtaaagtcaagacaatttctatccgggcacacccgtgcacattatttttatttgtgtcggggctccgtattcaatttttgttgaatgtaaaaaccgacattctcttttcaaggccccataggcccccaaatgtagccaggatctggggcccccatttaaaagcccacatgacaaaaaaaacagacataaata

SEQ ID NO: 584549 - DNA, 670 bp, Homo sapiens
agcggggcctgtcctttcgtggctcactccctttcctctgctgccgctcggtcacgcttgtgcccgaaggcaggaacacagtgacagacctgcggcacactgcagattctctatccttcacacagctctttcaccatgacctggatcacttcctttgaatgcagaagcttgctggccatatagatgtgggaattgttgcccttgagatctatttctccttctcaatatgttcgatcaagcagagttggaagaatatgatggtgtagatgctggaaagtataccattggcttgcggccaggccactgatgggcttctgcacagatagagaaggatattacagctctctttgcatgactgtggttcagaatcttatggagacgcaaataatcctttcctatgattgcattgggcggctggaagttggaaccgagacaatcatcgaacaacatcacgagtctgtgaagactaatttgatgcaggctgtgtgaagagtctgggaatacagatatagaaggaatcgatacaactaatgcatgctatggaggcacagctgctgtcttcgaactgctgttaactggattgagtccagctcttgggatggacggtatgccctggtcagttgcaggagatattgctgtatactgccacaggaccatgctagacctacag

SEQ ID NO: 584550 - DNA, 114 bp, Homo sapiens
atcatagctgtgcagatgtcagtaccgggacagctttcgacgtggatgacgactggcccctattcaggaccattctgtggccgtgccagagctgcatacggatttcacgccaag

SEQ ID NO: 584551 - DNA, 329 bp, Homo sapiens
tgaatgggcaatatcttcacttggtttaaaacctagaaagtaggccaggtgtggtggctcacacctgtaatcccagcactttgggaggccaagtggggtggatcacctgaggtcaagagtttgagaccagcctggccaacacggtaaacccccatctcaactaaaaatgcaaaaaatagctgggtgtggtggctcatgcctataatcccagctactcaggaagctgaggcatgagaatggcttgaacccgggaggcagaggctgcagtgagtcgagattgtgccactgcactccagcctgggctgggcgatagagtgagactctgtctc

SEQ ID NO: 584552 - DNA, 165 bp, Homo sapiens
cgtcccatcttctcatctattcgtgtcttccgccgaaaatatattaacatccactgtccaaaatttcatgttctataacatttgctctgtgctatctccgctatgcaccagttttgaccttaccaccatagtttatatactaagcgtaagctgtgtgatgtcagt

SEQ ID NO: 584553 - DNA, 235 bp, Homo sapiens
tactatcaccccaaggaggtctagactgttattctcagcttgcagactaaggctaagggagggcaaacatcttggcaaggggtgcatgcctaccacaagtggcacggcctggattcaggtccaagccttctgacctataaagtgagggctccacgaaacacacacataaagaatgagcagatatcaaacacggtcttagatgatgagatgcgtatgcaaatgactattttaccaa

SEQ ID NO: 584554 - DNA, 487 bp, Homo sapiens
  misc_feature (13)..(13): n is a, c, g, or t
  misc_feature (99)..(99): n is a, c, g, or t
  misc_feature (236)..(236): n is a, c, g, or t
  misc_feature (301)..(301): n is a, c, g, or t
  misc_feature (424)..(424): n is a, c, g, or t
  misc_feature (446)..(446): n is a, c, g, or t
  misc_feature (451)..(451): n is a, c, g, or t
  misc_feature (476)..(476): n is a, c, g, or t
  misc_feature (483)..(483): n is a, c, g, or t
tcgagcggagtcncttttgggtgtccttggccgcagctggaaactgacggccaccttctccaactcgcagcatgctgttggggttgggcggccggtggncagcgggcctatgccgggccggacgaggacgacgtggtgtgtggccgccgcgctccgaggttccgggatcgctttctggcgtgcggcctcgctagccgagccagagcggctccggagcggcgggcatctagcgctancgagtcttgcgggccacccgggcgagcgcacaagaatacctgtttgttgggaacaaatgtgtccngctgcttccatacacaagttgataagccagaaaatggcaaggctgatttatactggaaacctggcccgaacgatatttggtgtgaaatgtttctcttattctacaagtgttgtcagcctttgnaatatttccccgtaacttcttntcacnaaaataacattaatgttttggaaantttgccntttt

SEQ ID NO: 584555 - DNA, 230 bp, Homo sapiens
cctctgattaggggctgtcagtgctagcatggtttatgtgtccacacaggaagacagaattgagggaacttggcaccccacgggcatgattcaacagggatcgagagacgcaggcgacggatgtagtgcaggtggtgcgtgctagttgtatctctataacatggagatggccaggacgttggaggagccccagtgacgccgagtgttccctacccgtagtggcatgggcg

SEQ ID NO: 584556 - DNA, 943 bp, Homo sapiens
ctgttcatatggctaccaatactcatcgagaatgttcagtgcagatatgtacagttagctgatagacacttacatcagagatcccaagaaaagggaattgatttcatgcaattgaaaccatgccctatgttaagacaaaagcagatagggccttgcgatggatagcagatagaaaatctactttggggaaagagtggtggcctttgctgctgtagaaggagttttcttactcaggatctttagctgctatattctggctaacagaagagaggtctaatgccaggacatcacttaaaaccaatgaactcatcagcagagatgaaggacttcactgtgactaagcttgcctgatgtaccactacttagtaaataagccttccagaagaaagggtcagggagatcatagtgatgctgtacaacattgagcaggagtttttaaacagacagccttggccaagttggctcatggaatgacattgcatatatgatggcaccccgtacatagagtttgtagctgacagctcactagtggaaacttggatttcctcaacagggtttttcagggcaaagaacactcctttttgaattttactgggcacacatttctatagaaggcaaaccaatttctctgagaaagagttcagagtatacgcgtatggagataatggaaaaaaccacgaataagtctcaccatggacggagaatctacaagaccgcgtgtaaaaaccccataaagggtcaaggacaaagagacaaaccctgtaaaaaatccgaattcttacgacggggcgaaaagaaccaacatcaaagggcgtaaaacagatacaaacaggaccagcgacagcaaaacgaagaagaggaggaagaaaagcaaccggacaacaacacaacagaccaaaaaagaaagaaaacaaagacacaaaagcaaagacgaacacacaaa

SEQ ID NO: 584557 - DNA, 477 bp, Homo sapiens
  misc_feature (4)..(4): n is a, c, g, or t
  misc_feature (85)..(85): n is a, c, g, or t
  misc_feature (97)..(97): n is a, c, g, or t
  misc_feature (104)..(104): n is a, c, g, or t
  misc_feature (108)..(108): n is a, c, g, or t
  misc_feature (126)..(126): n is a, c, g, or t
  misc_feature (141)..(141): n is a, c, g, or t
  misc_feature (185)..(186): n is a, c, g, or t
  misc_feature (233)..(233): n is a, c, g, or t
  misc_feature (236)..(236): n is a, c, g, or t
  misc_feature (248)..(248): n is a, c, g, or t
  misc_feature (282)..(282): n is a, c, g, or t
  misc_feature (300)..(300): n is a, c, g, or t
  misc_feature (312)..(312): n is a, c, g, or t
  misc_feature (315)..(315): n is a, c, g, or t
  misc_feature (320)..(321): n is a, c, g, or t
  misc_feature (325)..(325): n is a, c, g, or t
  misc_feature (332)..(332): n is a, c, g, or t
  misc_feature (334)..(335): n is a, c, g, or t
  misc_feature (458)..(458): n is a, c, g, or t
aganaaaaaaaagagacctaacaggggcctcttgcagcccacttgggggagaaaaatgagtaagtctggccttcataatgcttcnaaaaacaaaaanccagcanacgncattattacaaaggaaangaagaaaaggaatgnaagaatcacatccatcttgaggacaaaacaagcatcgacattannaggacgaaacaagaattgcagaaccaaacatggagaaaccgtcaaanccnttggtgtaagcnaagccaagcccaccatgcaggtggaagcagggangcctccccaacccaaccngaagctcagganccncaggnntggnagcagantnnagaccacggaagcacaacaaaaaaacacaatcacaggcccactgctcaccagcacttcgcgctcactccgaagccagtgaagcccccgcagagcagccggggagaccaactcaagggcaccanaggccacaaaaaaaaaata

SEQ ID NO: 584558 - DNA, 612 bp, Homo sapiens
  misc_feature (6)..(6): n is a, c, g, or t
  misc_feature (29)..(29): n is a, c, g, or t
  misc_feature (42)..(42): n is a, c, g, or t
  misc_feature (600)..(600): n is a, c, g, or t
  misc_feature (604)..(604): n is a, c, g, or t
tgaaanaagcagaattgccatttattttnacagatacggccnacggacttgaaatgccttccaccatgcccaaaacccaaattgctttcgccttcggggacttatcacatctgcacacagttgtgcttttaggagttgagaggagttctgccagggaaccacaaggacctcaaagtcaacaaggcaagcttcttccttctgcgcccctgctgccagggggcaaagtggtgaggtcgacgtggtctccagtgaccctggtcttgcggcagtctgtgctccccatctccatcgtcaggaagtacttgatgccggccaccagctgctctgcgccttgatgatgtgcgtgtctcggaagtagtagatgctgttgctgcccatgttgtagctggccgacggccgcctgcgccgccttctgcactgcgggtcgtcgggcgacaggtcccggagttctccgaccatgcgctcctgcggccgggcccgggcgtcgcgtggcagcgccaggaggcagaatgcgaccagggccaggcccagcgccagcgggaggttcgaacgcgccatggccgtcagtgccgtcggagccctcagagccgtgagtgcccngtantcggtcgc

SEQ ID NO: 584559 - DNA, 527 bp, Homo sapiens
tttatctggtatttcaaagttaatctggtttggatccattgctgaaagctagtgtgatttcttgtggatgctgtagaaccccattttgtcatattaccagaattacttttctggtttcttcttattttgggtggaccatttcttcaaattgttcttaaatttatttttaatttgactgtgtttttttctttaatttcttcttttccctcttaaggatctgactttaatgtttatcatttattatagcctaatttgattcttaatgcttttagtggggaagactctgtaggagttccttaaggagagtttttgtgcgctggctttcccagacgctggttgcagtaaccacgcatttggcctgtgggtaagttcactgtctcctgtagggttggaatggctaggatctcttgaagcttatctcattctcccatggtgtacacctttttatttatttaattttttcccagtattttatttactaagctgatgattcagccttcaggccaataggagaggtatccctgggg

SEQ ID NO: 584560 - DNA, 226 bp, Homo sapiens
gtcgacacagagcaagattcttgtctcaacaaaaaaaaatagtaacatgtctcccagcaaagaaaagtccagacccaatggcttcagtgctgaattttaccaaacatttaaagaactaatataaatcctacctgaactattccaaaaaaaaatagcagaggagggaatacttccaaactcactttgtgaggcaagtattatgctgatatcaaaaccagagtcgacg

SEQ ID NO: 584561 - DNA, 567 bp, Homo sapiens
  misc_feature (105)..(105): n is a, c, g, or t
  misc_feature (555)..(555): n is a, c, g, or t
  misc_feature (559)..(559): n is a, c, g, or t
gaattcggcacgaggccgatccaccccatcagggcagagactaggaccaggcaagccaggaaggcaggtagtgcaatacagggtttaattatgtctttccttganatttagatggttgtccatcgtggagttttagcattaattcgatttttaaaatattgcatgaaaatatcccgattgcgcttttaggcccccttcatgcacgctggggcagcgcctgtggcctcccccatctgggccgggtgtcccctcccagcaccccgcccgccgcacctggctctgcgccttgatgatgtgcgtgtctcggaagtagtagatgctgttgctgcccatgttgtagctggccgacggccgcctgcgccgccttctgcactgcgggtcgtcgggcgacaggtcccggagttctccgaccatgcgctcctgcggccgggcccgggcgtcgcgtggcagcgccaggaggcagaatgcgaccagggccaggcccagcgccagcgggaggttcgaacgcgccatggccgtcagtgccgtcggagccctcagagccgtgagtgcccngtantcggtcgc

SEQ ID NO: 584562 - DNA, 151 bp, Homo sapiens
cccggaaggagatctgaaggagaataacttgggctgagaagctgttatataatagtgaccatttctttcacagagacggggaactgtatgcagcctttatctgaaaacccactcatctatttaatcacaactgtacctctccttcagactt

SEQ ID NO: 584563 - DNA, 839 bp, Homo sapiens
tatgcgaagacatcggcaaaaatgttttttcccgcaggggttccaacccggaccccgggtttgagaccacacgttgtcgcacggccggaagacgacccttttattgaggcttcttggcccgcaccactcaagtgtagaatctctcgcggagcgcctttggagatgcgtgctcgaccgccaataactggggctttctagaaaagggaacagtaccacacaaacaatgtgtctatgtaaccaaccgagagagcggtgtgtctccacaaaacgccgtcacaatgcttgcacacacaaaccgttttgtgtgccaaatagggtccaatggagattgttctcccccaaaaatttgctggccgtgtgccccccgcccaagcattccccgcgcagtatagattttcgcgcagaggaaaagcccccacgtgtgtttgcaaacactacttgtttacaatagagtggcctgacccacgtggaagtgtggctcatctatcaaaggggagtcatttcagtgcctcgctcaagcgctgggttacttctgatacacgaatatatccgtgttgaccagacaccgtggcgggaaacaccaatatcttgtgcatgcatgtacatggccccccgtagtttttagtaagatcactagcctcaccccttgttgcaccagaaatcttgcggatggtttgtaaataaaaatcaacatagcgtgctagtttcacaaagggtgggggtacatcccctcttagttaaatttattggcgggcacatccgttcgttcttggagcttccgcagattttgttgtcaacatcgcaatcaaagtaattaaaaccaaaatgggccccccgaa

SEQ ID NO: 584564 - DNA, 198 bp, Homo sapiens
tctagaggatccctgcttgtctagctctgtggaatatttgaccacctaagagctggggcctgcttctggttctgggaactggctttagggggtttctagcttaccaggctgagctcttcaaaattcccccaacttccccattggtgaacaattggcatttcttgggctcttccctggcaagaatctttgaatattccc

SEQ ID NO: 584565 - DNA, 324 bp, Homo sapiens
tccaaagttggtttttttttaatttaaaatggggaggcattttttaattcaaaattatttcttccaatacccctttatctaaaattttactaaaaaatgttttccttttaatttttttttaacccattttctggaaaattgcaccttataaatttttattcgtggtgacaattcgggggttgcactgtcgaattggtgtaaagaaacactattggtctttctgggactaatggggatgtcaactccaactatgggcacgacaccctatttttggacgatggatggatcacaccgggggttgtgaaaacacgcttaaaaatcccc

SEQ ID NO: 584566 - DNA, 145 bp, Homo sapiens
  misc_feature (63)..(63): n is a, c, g, or t
gattgccaagggtaaggaggcctgccaggactttctctcccttgagtacagcttccttgactnagggacaaccctgaaggaaaaggtgtggtcccaccccaagtcaatcttttcccttccctgggggctccatcttgtaattccc

SEQ ID NO: 584567 - DNA, 630 bp, Homo sapiens
  misc_feature (276)..(276): n is a, c, g, or t
tttggatttttaaaaaatcaagacggggtttcactatcttgcccaggctggtcttgaattcacgggctcaagccatcctcctagctgagcctcctgagtagctgacatggtaggattgcttgagcctgggagtttgaggctataatgagccatgataggaccactgaactccatcctgagtgacagggcaaggtcctgtttctgaagaaaaaaaggacattggaatcagggccctctccatcctgaggtgcctacaaggcatctctctctgcaaangagtaaacatcaccctccaactccttacagagtggagcaacaggaaaactccttcacctcatttctgtgctgcttgggaggcctggacagcccaataaccagctcctcgctgatgaagcaatcaggaaatggctcgagttgagctaaggagaatttggatccttcctttggttctcagtaggcagggtaggggccaggcatggtggctcatacctgtaatccttgcactgtggggggccaaggtgagaggattgcttgaggccaggagctcaagaccagcctggacaacatagcaagacctgggtggcatacacctgtggtccctactacttggtaggatgaaaggggggatct

SEQ ID NO: 584568 - DNA, 401 bp, Homo sapiens
cacgaggcgtgcgtcaggccgccgccaccgcctgaccggcaccgctggacatcaccggacgccatcatgcaggacgccccgctcaaaccgttccgctttaccgacgccgccgcactggtgcgcgccggcgtgccggtgacgatggtcaccatcgtcgaggtcaagggctccgcgccgcgcgagcccggcatccgcatgctggtgaccggcgacgacctgatcggcaccatcggcggcggccacctggaatggcgcggcatggcgatcgcgcgcgagatgctcgatgccgccgcgcacggcgaggcatcgtcgctcgcgcccgacgccacgcgccgcatcgtacggattccgctcgggcccgcgctgggccagtgctgcggcggcgtggtgcagctggcctt

SEQ ID NO: 584569 - DNA, 1734 bp, Homo sapiens
  misc_feature (149)..(149): n is a, c, g, or t
  misc_feature (1380)..(1380): n is a, c, g, or t
agacggagtctcggtcgcccaggctgaagtgcaagggtgcgatcttgggtgacagagtgagaccctgtcttagaaagaaaaaagaaaagaaagtgttaatccccctatgggaatctcctcttctcctgccctctctggaacctcatgtnagttcttcctcccactttcctgtatctttaacctatcccccacttttagctccttcccatcatcatttaaattactcaaacttcttctgttttaaaaacctctccctaaactcagggagaggtcttctgcacacacattgagccatctgctcttcctggtgccttctctacagcagcctgagccatgtctctaatctatgaatctcatcatgttactcccccatttacatcacttctccttgcctcagggattaagtccaaactccttaacagcccctgctctgccctgccttgcaaggcagcctcactgcttgcccctctccattacatctgctatggagtccaactgagcctcatctgccccttgaacgcacactctttctcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagctgagtacctggcataaaatagttactgtggtggccaaagtaataacccccaccgccaccaattgctcatgtcctatgttacacagcacaattacataggaagggggaattaagagtgcagataaaattaatgttgctcatcagctgaccttaaaacaagattatcctggagtatctaggagagcccatgtaattacaagcattctttaaaactggaagagggaggcagaaggttaagaaccagagacggtgggcacaatggctcatgcctgtaataccaatactttgggaggccagggtaggaaaatcccttgagtgcaggagttcaaggtcagccatggcaacatactgaggtcccatctctacaacaaaataaaaacaaaattcactgagtgtcacgatgcttacctgtagtcccagctactgggaaggctgacatggtaggattgcttgagcctgggagtttgaggctataatgagccatgataggaccactgaactccatcctgagtgacagggcaaggtcctgtttctgaagaaaaaaaggacattggaatcagggccctctccatcctgaggtgcctacaaggcatctctctctgcaaangagtaaacatcaccctccaactccttacagagtggagcaacaggaaaactccttcacctcatttctgtgctgcttgggaggcctggacagcccaataaccagctcctcgctgatgaagcaatcaggaaatggctcgagttgagctaaggagaatttggatccttcctttggttctcagtaggcagggtaggggccaggcatggtggctcatacctgtaatccttgcactgtggggggccaaggtgagaggattgcttgaggccaggagctcaagaccagcctggacaacatagcaagacctgggtggcatacacctgtggtccctactacttggtaggatgaaaggggggatct

SEQ ID NO: 584570 - DNA, 1562 bp, Homo sapiens
  misc_feature (1208)..(1208): n is a, c, g, or t
tgagccggtccacatgatgctcaccgctccttcccatcatcatttaaattactcaaacttcttctgttttaaaaacctctccctaaactcagggagaggtcttctgcacacacattgagccatctgctcttcctggtgccttctctacagcagcctgagccatgtctctaatctatgaatctcatcatgttactcccccatttacatcacttctccttgcctcagggattaagtccaaactccttaacagcccctgctctgccctgccttgcaaggcagcctcactgcttgcccctctccattacatctgctatggagtccaactgagcctcatctgccccttgaacgcacactctttctcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagctgagtacctggcataaaatagttactgtggtggccaaagtaataacccccaccgccaccaattgctcatgtcctatgttacacagcacaattacataggaagggggaattaagagtgcagataaaattaatgttgctcatcagctgaccttaaaacaagattatcctggagtatctaggagagcccatgtaattacaagcattctttaaaactggaagagggaggcagaaggttaagaaccagagacggtgggcacaatggctcatgcctgtaataccaatactttgggaggccagggtaggaaaatcccttgagtgcaggagttcaaggtcagccatggcaacatactgaggtcccatctctacaacaaaataaaaacaaaattcactgagtgtcacgatgcttacctgtagtcccagctactgggaaggctgacatggtaggattgcttgagcctgggagtttgaggctataatgagccatgataggaccactgaactccatcctgagtgacagggcaaggtcctgtttctgaagaaaaaaaggacattggaatcagggccctctccatcctgaggtgcctacaaggcatctctctctgcaaangagtaaacatcaccctccaactccttacagagtggagcaacaggaaaactccttcacctcatttctgtgctgcttgggaggcctggacagcccaataaccagctcctcgctgatgaagcaatcaggaaatggctcgagttgagctaaggagaatttggatccttcctttggttctcagtaggcagggtaggggccaggcatggtggctcatacctgtaatccttgcactgtggggggccaaggtgagaggattgcttgaggccaggagctcaagaccagcctggacaacatagcaagacctgggtggcatacacctgtggtccctactacttggtaggatgaaaggggggatct

SEQ ID NO: 584571 - DNA, 1023 bp, Homo sapiens
  misc_feature (149)..(149): n is a, c, g, or t
agacggagtctcggtcgcccaggctgaagtgcaagggtgcgatcttgggtgacagagtgagaccctgtcttagaaagaaaaaagaaaagaaagtgttaatccccctatgggaatctcctcttctcctgccctctctggaacctcatgtnagttcttcctcccactttcctgtatctttaacctatcccccacttttagctccttcccatcatcatttaaattactcaaacttcttctgttttaaaaacctctccctaaactcagggagaggtcttctgcacacacattgagccatctgctcttcctggtgccttctctacagcagcctgagccatgtctctaatctatgaatctcatcatgttactcccccatttacatcacttctccttgcctcagggattaagtccaaactccttaacagcccctgctctgccctgccttgcaaggcagcctcactgcttgcccctctccattacatctgctatggagtccaactgagcctcatctgccccttgaacgcacactctttctcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagctgagtacctggcataaaatagttactgtggtggccaaagtaataacccccaccgccaccaattgctcatgtcctatgttacacagcacaattacataggaagggggaattaagagtgcagataaaattaatgttgctcatcagctgaccttaaaacaagattatcctggagtatctaggagagcccatgtaattacaagcattctttaaaactggaagagtcagcgttgtgggatcctctagaacacca

SEQ ID NO: 584572 - DNA, 1193 bp, Homo sapiens
  misc_feature (149)..(149): n is a, c, g, or t
agacggagtctcggtcgcccaggctgaagtgcaagggtgcgatcttgggtgacagagtgagaccctgtcttagaaagaaaaaagaaaagaaagtgttaatccccctatgggaatctcctcttctcctgccctctctggaacctcatgtnagttcttcctcccactttcctgtatctttaacctatcccccacttttagctccttcccatcatcatttaaattactcaaacttcttctgttttaaaaacctctccctaaactcagggagaggtcttctgcacacacattgagccatctgctcttcctggtgccttctctacagcagcctgagccatgtctctaatctatgaatctcatcatgttactcccccatttacatcacttctccttgcctcagggattaagtccaaactccttaacagcccctgctctgccctgccttgcaaggcagcctcactgcttgcccctctccattacatctgctatggagtccaactgagcctcatctgccccttgaacgcacactctttctcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagctgagtacctggcataaaatagttactgtggtggccaaagtaataacccccaccgccaccaattgctcatgtcctatgttacacagcacaattacataggaagggggaattaagagtgcagataaaattaatgttgctcatcagctgaccttaaaacaagattatcctggagtatctaggagagcccatgtaattacaagcattctttaaaactggaagagggaggcagaaggttaagaaccagagacggtgggcacaatggctcatgcctgtaataccaatactttgggaggccagggtaggaaaatcccttgagtgcaggagttcaaggtcagccatggcaacatactgaggtcccatctctaataacatgttgcccagtcagtttctcttcttggattcagaagtctttgctgtgga

SEQ ID NO: 584573 - DNA, 425 bp, Homo sapiens
aaccttctgaccatcccagattcaacgtgattcttctgccgtcagctcccaagatagcttggactacaggtgctagccaccctgcccattttggtatttgtagtagagacggggttcaccatgttggccaggatggtctggatctcctgaccttgtgatctgcccaccttggtctcccaaagtgctgggattacaggcgtgaccaccacgcccaggctgatttccttttcttaatggccaagtagtattccattgtgtatatataccacaattattaagtccagtcctctgtcggtggacacttagtttgattccctacctttgctactgtgagtagtcctgcagtgaacatacaagtgcaggtatgtaattgacataatgatttattttccttcaggtaagatacccagtagtagggttgctgc

SEQ ID NO: 584574 - DNA, 258 bp, Homo sapiens
gtcgaccgctcgagagaaccccaatggcaggtttcttttcccgggaagccggtgcattaactggcgcgacgttgtgcgtactccttggggctcacccccatgcggcgcacgaaggctttcctcgggccattgggcgttcgaactggctttcagcgtcggatatcccaaccctatcaccgactttcactcgagccaggtcctgccgcagcgacgttaccttttcaataccgttcaattgctcaaactctcgttgagcct

SEQ ID NO: 584575 - DNA, 1422 bp, Homo sapiens
  misc_feature (149)..(149): n is a, c, g, or t
agacggagtctcggtcgcccaggctgaagtgcaagggtgcgatcttgggtgacagagtgagaccctgtcttagaaagaaaaaagaaaagaaagtgttaatccccctatgggaatctcctcttctcctgccctctctggaacctcatgtnagttcttcctcccactttcctgtatctttaacctatcccccacttttagctccttcccatcatcatttaaattactcaaacttcttctgttttaaaaacctctccctaaactcagggagaggtcttctgcacacacattgagccatctgctcttcctggtgccttctctacagcagcctgagccatgtctctaatctatgaatctcatcatgttactcccccatttacatcacttctccttgcctcagggattaagtccaaactccttaacagcccctgctctgccctgccttgcaaggcagcctcactgcttgcccctctccattacatctgctatggagtccaactgagcctcatctgccccttgaacgcacactctttctcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagctgagtacctggcataaaatagttactgtggtggccaaagtaataacccccaccgccaccaattgctcatgtcctatgttacacagcacaattacataggaagggggaattaagagtgcagataaaattaatgttgctcatcagctgaccttaaaacaagattatcctggagtatctaggagagcccatgtaattacaagcattctttaaaactggaagagggaggcagaaggttaagaaccagagacggtgggcacaatggctcatgcctgtaataccaatactttgggaggccagggtaggaaaatcccttgagtgcaggagttcaaggtcagccatggcaacatactgaggtcccatctctacaacaaaataaaaacaaaattcactgagtgtcacgatgcttacctgtagtcccagctactgggaaggctgacatggtaggattgcttgagcctgggagtttgaggctataatgagccatgataggaccactgaactccatcctgagtgacagggcaaggtcctgtttctggacatggtggcacatgtctgtagtcccagctacttgggagactgaagtgagagaaccacttgagcccaggagtttgaggctacagtgaaccatgatcatgtcactgtactgtag

SEQ ID NO: 584576 - DNA, 95 bp, Homo sapiens
ctcgtggaagtcacatcgtctttaaaccctgcgtggcaatccctgacggaccgcgtgatgccagggagcaagggggacttgaaggtcaaataatt

SEQ ID NO: 584577 - DNA, 1364 bp, Homo sapiens
  misc_feature (149)..(149): n is a, c, g, or t
agacggagtctcggtcgcccaggctgaagtgcaagggtgcgatcttgggtgacagagtgagaccctgtcttagaaagaaaaaagaaaagaaagtgttaatccccctatgggaatctcctcttctcctgccctctctggaacctcatgtnagttcttcctcccactttcctgtatctttaacctatcccccacttttagctccttcccatcatcatttaaattactcaaacttcttctgttttaaaaacctctccctaaactcagggagaggtcttctgcacacacattgagccatctgctcttcctggtgccttctctacagcagcctgagccatgtctctaatctatgaatctcatcatgttactcccccatttacatcacttctccttgcctcagggattaagtccaaactccttaacagcccctgctctgccctgccttgcaaggcagcctcactgcttgcccctctccattacatctgctatggagtccaactgagcctcatctgccccttgaacgcacactctttctcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagctgagtacctggcataaaatagttactgtggtggccaaagtaataacccccaccgccaccaattgctcatgtcctatgttacacagcacaattacataggaagggggaattaagagtgcagataaaattaatgttgctcatcagctgaccttaaaacaagattatcctggagtatctaggagagcccatgtaattacaagcattctttaaaactggaagagggaggcagaaggttaagaaccagagacggtgggcacaatggctcatgcctgtaataccaatactttgggaggccagggtaggaaaatcccttgagtgcaggagttcaaggtcagccatggcaacatactgaggtcccatctctacaacaaaataaaaacaaaattcactgagtgtcacgatgcttacctgtagtcccagctactgggaaggctgacatggtaggattgcttgagcctgggagtttgaggctataatgagccatgataggaccactgaactccatcctgagtgacagggcaaggtcctgtttctgaataacatgttgcccagtcagtttctcttcttggattcagaagtctttgctgtgga

SEQ ID NO: 584578 - DNA, 205 bp, Homo sapiens
tgtgctgggtgtgatctgtgtgtgtgctgggtgtgagctgtgtgtgctgggtgtgatctgtgtgtgctgtgtgtgatctgtgcgtgtgctgtgtgtgatgtgtgtgtgctgagtgtgatctgtgtgtgctgagtgtgatctgtgcgtgctcgctgtgatatgtgtgtgctgagtgtgatctgtgtgtgtgctcgatgtgatctgt

SEQ ID NO: 584579 - DNA, 1065 bp, Homo sapiens
  misc_feature (149)..(149): n is a, c, g, or t
agacggagtctcggtcgcccaggctgaagtgcaagggtgcgatcttgggtgacagagtgagaccctgtcttagaaagaaaaaagaaaagaaagtgttaatccccctatgggaatctcctcttctcctgccctctctggaacctcatgtnagttcttcctcccactttcctgtatctttaacctatcccccacttttagctccttcccatcatcatttaaattactcaaacttcttctgttttaaaaacctctccctaaactcagggagaggtcttctgcacacacattgagccatctgctcttcctggtgccttctctacagcagcctgagccatgtctctaatctatgaatctcatcatgttactcccccatttacatcacttctccttgcctcagggattaagtccaaactccttaacagcccctgctctgccctgccttgcaaggcagcctcactgcttgcccctctccattacatctgctatggagtccaactgagcctcatctgccccttgaacgcacactctttctcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagctgagtacctggcataaaatagttactgtggtggccaaagtaataacccccaccgccaccaattgctcatgtcctatgttacacagcacaattacataggaagggggaattaagagtgcagataaaattaatgttgctcatcagctgaccttaaaacaagattatcctggagtatctaggagagcccatgtaattacaagcattctttaaaactggaagagggaggagaggaagaggtgggaggagaggaaaaggtgggaggagaggaagagtgggaggagatgtaaggtcc

SEQ ID NO: 584580 - DNA, 478 bp, Homo sapiens
  misc_feature (43)..(43): n is a, c, g, or t
  misc_feature (432)..(432): n is a, c, g, or t
ctggagcggtttcattgcctacattccgcattggaaaatagangcagggacaatgaagggaaaaggccgaggcatcagcgtgtgaagaccgcaaagacgatcccgagtacagttgtgaacagcattgctgctaggctcctcctgcagatcatctgaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaaggtaaggaaaatgactcggaaaatgtgcatgaaatgtactagggtttttncttggttaaggtgcctaaatgcttaggtcaaataccctgggcaatc

SEQ ID NO: 584581 - DNA, 1250 bp, Homo sapiens
  misc_feature (896)..(896): n is a, c, g, or t
gtcgacgaaactgaagcagtccctgccccctgaatgcacactctttctcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagctgagtacctggcataaaatagttactgtggtggccaaagtaataacccccaccgccaccaattgctcatgtcctatgttacacagcacaattacataggaagggggaattaagagtgcagataaaattaatgttgctcatcagctgaccttaaaacaagattatcctggagtatctaggagagcccatgtaattacaagcattctttaaaactggaagagggaggcagaaggttaagaaccagagacggtgggcacaatggctcatgcctgtaataccaatactttgggaggccagggtaggaaaatcccttgagtgcaggagttcaaggtcagccatggcaacatactgaggtcccatctctacaacaaaataaaaacaaaattcactgagtgtcacgatgcttacctgtagtcccagctactgggaaggctgacatggtaggattgcttgagcctgggagtttgaggctataatgagccatgataggaccactgaactccatcctgagtgacagggcaaggtcctgtttctgaagaaaaaaaggacattggaatcagggccctctccatcctgaggtgcctacaaggcatctctctctgcaaangagtaaacatcaccctccaactccttacagagtggagcaacaggaaaactccttcacctcatttctgtgctgcttgggaggcctggacagcccaataaccagctcctcgctgatgaagcaatcaggaaatggctcgagttgagctaaggagaatttggatccttcctttggttctcagtaggcagggtaggggccaggcatggtggctcatacctgtaatccttgcactgtggggggccaaggtgagaggattgcttgaggccaggagctcaagaccagcctggacaacatagcaagacctgggtggcatacacctgtggtccctactacttggtaggatgaaaggggggatct

SEQ ID NO: 584582 - DNA, 553 bp, Homo sapiens
  misc_feature (507)..(507): n is a, c, g, or t
atgtagggataatctttatagatgcaatttagccctgccaaaagtctgtttataatgatgaatagtaaatgaagaaacttacattttgcattaccgaatgagcttgactttctcttttcccctgaataggaagggaaaaggccgaggcatcagcgtgtgaagaccgcaaagacgatcccgagtacagttgtgaacagcattgctgctaggctcctcctgcagatcatctgaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaaggtaaggaaaatgactcggaaaatgtgcatgaaatgtactagggtttttncttggttaaggtgcctaaatgcttaggtcaaataccctgggcaatc

SEQ ID NO: 584583 - DNA, 985 bp, Homo sapiens
  misc_feature (149)..(149): n is a, c, g, or t
agacggagtctcggtcgcccaggctgaagtgcaagggtgcgatcttgggtgacagagtgagaccctgtcttagaaagaaaaaagaaaagaaagtgttaatccccctatgggaatctcctcttctcctgccctctctggaacctcatgtnagttcttcctcccactttcctgtatctttaacctatcccccacttttagctccttcccatcatcatttaaattactcaaacttcttctgttttaaaaacctctccctaaactcagggagaggtcttctgcacacacattgagccatctgctcttcctggtgccttctctacagcagcctgagccatgtctctaatctatgaatctcatcatgttactcccccatttacatcacttctccttgcctcagggattaagtccaaactccttaacagcccctgctctgccctgccttgcaaggcagcctcactgcttgcccctctccattacatctgctatggagtccaactgagcctcatctgccccttgaacgcacactctttctcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagctgagtacctggcataaaatagttactgtggtggccaaagtaataacccccaccgccgtcacccatctctaccaagaaagcgtggatacccatccacgaagttttgatattggaattcagattggctatcagcgacgccataaggatgtgttggcttgggtaaaaacgcagaagaactataacgatcgagacataggggatccctctagagt

SEQ ID NO: 584584 - DNA, 301 bp, Homo sapiens
ccaaaaagactacagcgggtgaaggctgaacctttgccagcgtctgcccagctctagggcagcggcgccggtacgtaggccccactcaagacaggctccaagacatgctctgccacgctgaccgaacttaatgaccttgctgagaacatgctgccaacgtacggccgcaagaggctgtgagcggggcccaggcacacacctgaggctgcccctccaagctccggaacggaacggctccagcaagatgctggggctgggaatgcagaggtgtgacagtgcgtccatcctcagcccttcactg

SEQ ID NO: 584585 - DNA, 342 bp, Homo sapiens
  misc_feature (342)..(342): n is a, c, g, or t
acacttcgtacagttacgctgtaccgcgtaacgtacgcgaggactcgaagtcctgagcgctcaagtatgtccgaatgtctagagaaggccatggaggtgccgacaacggcaccgaggagctgtctctgtagagcatagtgcctattttcccgtgacattgctgtcgacgctgagactgtcaacttgtaagtccttgaggagcataagaagcagcttacatacgtacctgagccctattacacagagtctagatgggaccggctactggagctgatgggatgctacagcaggcatcattggctgtgagcatggggtaccagctgtgattcatgcttaaccgtn

SEQ ID NO: 584586 - DNA, 321 bp, Homo sapiens
  misc_feature (180)..(180): n is a, c, g, or t
  misc_feature (202)..(202): n is a, c, g, or t
  misc_feature (209)..(209): n is a, c, g, or t
  misc_feature (243)..(243): n is a, c, g, or t
  misc_feature (299)..(299): n is a, c, g, or t
ccggctagggggagctcactgcagtgccacagagccgctgtagccagaccgtctctctagattcctcctctctgggcagggcacctctgaaagaaaggcagcagccccagtcaggggcttatagataaaacttccatctccctgggacagagcaccttggtgaaggggcagctgtgggtncagcttcagcagacttaaacgntcctgcntgctggctctgaagagagcagcagatctcccagnacagtattggagttcttaataagggacagacttgactccttaagtggggtccctgnaccccgcatggctccttggatg

SEQ ID NO: 584587 - DNA, 701 bp, Homo sapiens
gttgcagcttgctacttcaattgctgctggaggggaatgacttacggatgtctcaccagaaaaaacaccccggatccccgtcttccgctgcagtttccccggcaacagaggacgaggaggagccgagtctgtgtgcagcttcctacttcaaattgcttgctggaggggaaggacttacggatgtctccccagaaacaacacccggagcccccgtcttccgctgcacgtttccccgggaccagaggaacctgctggcgacaccaagaacaagaaattgacattttgctaaaggctggggagacactcctattatgaaaaaccaaaagaagtgggcagtagagcgaacgcgaaccatccaagggactcattgacttcagtcaaaaagttttcttcaacttgtggcctcagacacagattgtaactaatgttgaatcagtcctttgcttcccttcccccacgaccacgacaacgtatggacactctctaatgaagtgtatgggcagctgagtggtaaaacagggtttcaacaattcacctgccaaggatctcagcgcagtgggggatgaacccccacactgagcgactccacctctgcctacttacattgacaatggattttcacaccgggaatcacgacacagctctgcaacaggtctgatgctggtggaaggagacttcgcagctggtgccccatccgcata

SEQ ID NO: 584588 - DNA, 477 bp, Homo sapiens
  misc_feature (50)..(50): n is a, c, g, or t
cccggcgctcgtacgagataacggcagcgcagacgcctcgcgagcgagcnactagtgcgacagcgtctagacacagtgcacgacagagacagactgtgctctctcttgtgacacggggacacgtgtggcacgtgctctccgggaacacacagcgtgtgagaacacatatgaccactatgagacccgactatgaattccttcagcaagacctttctaacgcagaccagataccttagcagacgggctggaaccttagaccggtgccagagtctttgggggagtctgggtctccatttcttggcccttctttccaggtggctcttggcgggcattcccaggcagacaggacctttggccccagggcagcagacagatacgccacctggtcttcccgagaagaagcgcaagagcgcagacttccagacgggggacgggtctggctgcggtgtgctacgagcgcgatacctcgcagtatgc

SEQ ID NO: 584589 - DNA, 186 bp, Homo sapiens
cccccatgggggcttttgggtcggatccggcctccggtttttagcgtaggcggggggggggatttctttttccccctgggggcggttttggccgttgggcctttgggaaagggtttttaggccctcttatacaaggtgggcctccccgtttttgtccggatttcccgggtggaccccggggtccga

SEQ ID NO: 584590 - DNA, 648 bp, Homo sapiens
gcagccccgggcccgggagaccgtttgcttggggttgcacgtttgctttgcaaaagtcatacgttgcctctgatggagcgcaccagctgcttggggctgctcacagcaaacagcatgacgtcactcatgagaggagacccttgctcaacacaaggctcggtgagcactgcaaagtcacttcctgtagcagaagtaaaagaaaggacaataaaaggagagaacaaagaacgacatccatcccgctgacagcacactatagccaagtcaacttcgtcaaactgtccggtctatggtcgtaccttacccagatatttcctgtccagaccgtcttgatattttcacgattcgccatcgccgccggcaagtctgcattgggccaaaggtaaagtccaagtgccagttcgttgcaaatcggtcaaatgaacttgtgagaagcccatgagtctgttaggtttggctagtccctgctcagcccatctgtgtgagcgctgtaaaagtgtctaacagcgatgcgttaaaatgtgacgaaggctttgttaagaatcagatcttcagcgaatcctgagtgaatcttgacttggagggcagcaggaatttttaaatagagaagaacaacaaggatattcacccccaggtgactgttaatac

SEQ ID NO: 584591 - DNA, 101 bp, Homo sapiens
gcttgggcgaaacacttaacacgccacacaaactcttcagccagccgcataagccgcacaggccaaaatatcagccagcttagcacttgctacatagccac

SEQ ID NO: 584592 - DNA, 1201 bp, Homo sapiens
  misc_feature (5)..(5): n is a, c, g, or t
  misc_feature (14)..(14): n is a, c, g, or t
  misc_feature (18)..(18): n is a, c, g, or t
  misc_feature (937)..(937): n is a, c, g, or t
  misc_feature (942)..(942): n is a, c, g, or t
  misc_feature (953)..(953): n is a, c, g, or t
  misc_feature (964)..(964): n is a, c, g, or t
  misc_feature (1015)..(1015): n is a, c, g, or t
  misc_feature (1017)..(1017): n is a, c, g, or t
  misc_feature (1045)..(1045): n is a, c, g, or t
  misc_feature (1059)..(1059): n is a, c, g, or t
  misc_feature (1061)..(1061): n is a, c, g, or t
  misc_feature (1110)..(1110): n is a, c, g, or t
ggcgngcaggaacncaantacggctaggtacgaggctgggtggtggccagataggggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtgaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaacagcacaatttaaaatgcctgggagtggctataggggtagctctttccaacagcccaagtggggtcaactcctaagccccaccccctcacanacacngcttccctgtnttgcccttggnggagccacttctaaggctgcttacccttgggggtgtcctctatttgctgcnanctctcttgtctctccctctgaagatggntcggcccacatacncnttgtggtgtcaccgtcattgatggactctattttttattattacttggncctggtcgtttttatactagcagatgtcttgtttcattggggttgggggggggagggaggtgacttgtgttttgaccaacccggtgtgggg

SEQ ID NO: 584593 - DNA, 1603 bp, Homo sapiens
  misc_feature (5)..(5): n is a, c, g, or t
  misc_feature (14)..(14): n is a, c, g, or t
  misc_feature (18)..(18): n is a, c, g, or t
  misc_feature (1339)..(1339): n is a, c, g, or t
  misc_feature (1344)..(1344): n is a, c, g, or t
  misc_feature (1355)..(1355): n is a, c, g, or t
  misc_feature (1366)..(1366): n is a, c, g, or t
  misc_feature (1417)..(1417): n is a, c, g, or t
  misc_feature (1419)..(1419): n is a, c, g, or t
  misc_feature (1447)..(1447): n is a, c, g, or t
  misc_feature (1461)..(1461): n is a, c, g, or t
  misc_feature (1463)..(1463): n is a, c, g, or t
  misc_feature (1512)..(1512): n is a, c, g, or t
ggcgngcaggaacncaantacggctaggtacgaggctgggtggtggccagataggggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaacagcacaatttaaaatgcctgggagtggctataggggtagctctttccaacagcccaagtggggtcaactcctaagccccaccccctcacanacacngcttccctgtnttgcccttggnggagccacttctaaggctgcttacccttgggggtgtcctctatttgctgcnanctctcttgtctctccctctgaagatggntcggcccacatacncnttgtggtgtcaccgtcattgatggactctattttttattattacttggncctggtcgtttttatactagcagatgtcttgtttcattggggttgggggggggagggaggtgacttgtgttttgaccaacccggtgtgggg

SEQ ID NO: 584594 - DNA, 582 bp, Homo sapiens
cctgatgaatctgcttcacgtatgaaatagcctgagtataattaacctatgacccgttctttgcacactcgaagaggagttccccccaacactgtaaatgccaataaatggaaaaggtttaccttctttagcttccaaagttggaagggttaatttatcacggctaatttctacctgatgaactgcttcacggtgggggagggaaacttatttttatttgcctgatttaagtgttctgagaaacccaatctttgtttcttcttaggctgcacatggaacacaactttaccccgggttttggcactttcctttcctttcctttataaaaacacatgctcagccaactgcacccacgttaactaccacgtttggtaaattgttatgttaacacaattatgaacactctgcaatgctctttataaagcaaactaatttaataaaatcactgttgtgaggacttaaattttgtgttacctccccagagatactttttgagagtatagaacaccagcttcttgggagtacagttctttacgttctttactaaatcttaataaatgcctgacatagttacagctttta

SEQ ID NO: 584595 - DNA, 1071 bp, Homo sapiens
  misc_feature (5)..(5): n is a, c, g, or t
  misc_feature (14)..(14): n is a, c, g, or t
  misc_feature (18)..(18): n is a, c, g, or t
ggcgngcaggaacncaantacggctaggtacgaggctgggtggtggccagataggggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcgagggcggggcgccgggcgagacagacgcttcaggccgggcgggtcacagtacgggtagggcgggaggaggggaaagccaggaggggggggcgccagggggcgccagaagcggggcgaaaacgaaagcctggcaaagggggggggcacgggcaagcaaaggcgg

SEQ ID NO: 584596 - DNA, 463 bp, Homo sapiens
cccggtaatcgcataaaacttacaactttacagtcagaggttcaattcctcttcttaacaagcatcccaagtcattgcaggttactcctagctacctgcagagctgtctagaaagcctgacatagagtgacacacagtgagaggtacccatgaagacgatggacatcacgtctagcatccatgacatcacacatttagctcaagtgagaagtcctaacattttaatattcaagatgacttttttatttggaagataattccagagacgggctgactttgaaggctgtgatagagctctcttctctcaatgaccagacctgaattgcattatcatactgcttgagaatctgcccatcagttgatggctaaagacacacatgagatacaacagactctccaccagtctttatctagatcagaattcttggcacagcttggctggattctctacttcacgatctta

SEQ ID NO: 584597 - DNA, 114 bp, Homo sapiens
  misc_feature (86)..(86): n is a, c, g, or t
ggcgatgcgcgtgcatgtggttgggactcccagacactttaacaaagcagcagcagtctgagagggttgtcagtggaccacctggnacccagactcaactcttgactcttgtat

SEQ ID NO: 584598 - DNA, 1561 bp, Homo sapiens
  misc_feature (1297)..(1297): n is a, c, g, or t
  misc_feature (1302)..(1302): n is a, c, g, or t
  misc_feature (1313)..(1313): n is a, c, g, or t
  misc_feature (1324)..(1324): n is a, c, g, or t
  misc_feature (1375)..(1375): n is a, c, g, or t
  misc_feature (1377)..(1377): n is a, c, g, or t
  misc_feature (1405)..(1405): n is a, c, g, or t
  misc_feature (1419)..(1419): n is a, c, g, or t
  misc_feature (1421)..(1421): n is a, c, g, or t
  misc_feature (1470)..(1470): n is a, c, g, or t
cgctatgtactatgactgttaaaagcagtgtacggcgatctggatgtagggggctggtgttcagttctctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaacagcacaatttaaaatgcctgggagtggctataggggtagctctttccaacagcccaagtggggtcaactcctaagccccaccccctcacanacacngcttccctgtnttgcccttggnggagccacttctaaggctgcttacccttgggggtgtcctctatttgctgcnanctctcttgtctctccctctgaagatggntcggcccacatacncnttgtggtgtcaccgtcattgatggactctattttttattattacttggncctggtcgtttttatactagcagatgtcttgtttcattggggttgggggggggagggaggtgacttgtgttttgaccaacccggtgtgggg

SEQ ID NO: 584599 - DNA, 357 bp, Homo sapiens
agcgaacattaataaatgtagcctcctccaactatgtgtcacttccaccatggtatcacagctatttattattcatccccacatatattctccagatttctttctgtctacattgcgtgtgcgtgtgtgtgtcgtatcgtttcgaaggagcgcatcaactcgaaaccatcacaccaatgttcatcacatgtagacgggagcgctttatatcatataaaggtttgcagcctagaatggtggccattatgacaggctgcagaagtgtgccctattgccaaggcaagaggcaggcccttccagggagggaagacgaagacaggactgagaaactatctgagttgactacatatacatact

SEQ ID NO: 584600 - DNA, 1449 bp, Homo sapiens
  misc_feature (5)..(5): n is a, c, g, or t
  misc_feature (14)..(14): n is a, c, g, or t
  misc_feature (18)..(18): n is a, c, g, or t
  misc_feature (1185)..(1185): n is a, c, g, or t
  misc_feature (1190)..(1190): n is a, c, g, or t
  misc_feature (1201)..(1201): n is a, c, g, or t
  misc_feature (1212)..(1212): n is a, c, g, or t
  misc_feature (1263)..(1263): n is a, c, g, or t
  misc_feature (1265)..(1265): n is a, c, g, or t
  misc_feature (1293)..(1293): n is a, c, g, or t
  misc_feature (1307)..(1307): n is a, c, g, or t
  misc_feature (1309)..(1309): n is a, c, g, or t
  misc_feature (1358)..(1358): n is a, c, g, or t
ggcgngcaggaacncaantacggctaggtacgaggctgggtggtggcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaacagcacaatttaaaatgcctgggagtggctataggggtagctctttccaacagcccaagtggggtcaactcctaagccccaccccctcacanacacngcttccctgtnttgcccttggnggagccacttctaaggctgcttacccttgggggtgtcctctatttgctgcnanctctcttgtctctccctctgaagatggntcggcccacatacncnttgtggtgtcaccgtcattgatggactctattttttattattacttggncctggtcgtttttatactagcagatgtcttgtttcattggggttgggggggggagggaggtgacttgtgttttgaccaacccggtgtgggg

SEQ ID NO: 584601 - DNA, 806 bp, Homo sapiens
  misc_feature (5)..(5): n is a, c, g, or t
  misc_feature (14)..(14): n is a, c, g, or t
  misc_feature (18)..(18): n is a, c, g, or t
ggcgngcaggaacncaantacggctaggtacgaggctgggtggtggccagataggggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggcctggcgcgactgagagacagccacacgccgtgtatacgtcttgttcacctcggacgccgagcgcgtcaaactggtggcacgacccgacgctgacgttccggtgggccgtagccgccggggcccctctgattgacgcgccccttatgggagacccttcttgaactggaccctgtcgatgcgctggcatgggctgacactcctccagtgacccaacgcagcgtccgcggattagcgcaacatgcgcgtctcggcacgcaccgtaccgtcccgaacgtagctggcagggcaggggccgagaccgcacggccactgggcacggacacgccgcccatggccggcggggagccggcgagcaccgggtggcacgcctcgacacgccgagggcgaggctgacccccggggagggattacccgggcgcggcgccgcgctggacccacgcccaagggacgccgaacgacccgcccggccgcaaaggcccttacac

SEQ ID NO: 584602 - DNA, 313 bp, Homo sapiens
  misc_feature (108)..(108): n is a, c, g, or t
  misc_feature (114)..(114): n is a, c, g, or t
  misc_feature (234)..(234): n is a, c, g, or t
  misc_feature (253)..(253): n is a, c, g, or t
  misc_feature (270)..(270): n is a, c, g, or t
  misc_feature (280)..(280): n is a, c, g, or t
gagggaaattggctcaaaaatggacaacctggcaactgtgagtccctgcttcccgacaccagcctcatggaatatgcaacaactcctgtaccccagtccacggtgttntggcancagggacacctgggccaatgggccatttggaccaaaggtggggtgtggggccctggatggcagctttggcccaaacatgaaaacctcgtgttcctcccccctctattactgtttccccanagctgttttagctcaaatntgttgtgtttttgagtntagggtctgnacccttgtttataataaaagcaatcgtttggga

SEQ ID NO: 584603 - DNA, 349 bp, Homo sapiens
  misc_feature (7)..(7): n is a, c, g, or t
  misc_feature (144)..(144): n is a, c, g, or t
  misc_feature (150)..(150): n is a, c, g, or t
  misc_feature (270)..(270): n is a, c, g, or t
  misc_feature (289)..(289): n is a, c, g, or t
  misc_feature (306)..(306): n is a, c, g, or t
  misc_feature (316)..(316): n is a, c, g, or t
tgagaangcgcgattattaataatggatatatgactacacactgaaagattacacgcgtcggacacaggcactgtgagtccctgcttcccgacaccagcctcatggaatatgcaacaactcctgtaccccagtccacggtgttntggcancagggacacctgggccaatgggccatttggaccaaaggtggggtgtggggccctggatggcagctttggcccaaacatgaaaacctcgtgttcctcccccctctattactgtttccccanagctgttttagctcaaatntgttgtgtttttgagtntagggtctgnacccttgtttataataaaagcaatcgtttggga

SEQ ID NO: 584604 - DNA, 316 bp, Homo sapiens
tactggctgggagcagtacactgatgaagaattcaggccccactggttcagcagactttttgcagttattggagccctgttcagagcagtgacctgaaggactgcacttttatcaggacttttaatactcaaatgatgaaaagagctcttgagatgtggaagatataaatcatggggctattggtgaagactgaaaaaggatgtttcactcctgataagacttactaggcagctggtggcaccacagcttcctttgattttgtggctatctggataaaagttgatgcgaagacctgggaaacagtttggtgcaaaa

SEQ ID NO: 584605 - DNA, 323 bp, Homo sapiens
  misc_feature (21)..(21): n is a, c, g, or t
  misc_feature (172)..(172): n is a, c, g, or t
  misc_feature (236)..(236): n is a, c, g, or t
  misc_feature (249)..(249): n is a, c, g, or t
  misc_feature (304)..(304): n is a, c, g, or t
  misc_feature (310)..(310): n is a, c, g, or t
cccgatgtgtgccaagcaatntttaatgagaaaaatgtgtgtgtccttagtgagaaggaagacaggaagcaaataaggagtgttaagagccagaaagaaaatacagcagggtatacaaaaatggaacatcatggggaggtggtcaggccaggtaccgcctcctctgaggagntgctgattgatgagagttctgcagggagtgagcagggagctctccgagggcctgcaggagtgtntgagcagcagganggaccagtgcccctcctcagccaaaggaacaactcagagtgacaggagctgagtncgaganggggcctgcgatt

SEQ ID NO: 584606 - DNA, 807 bp, Homo sapiens
ccgcacccccaccgactaatatcacttcaccatcacgacacacccgcccttacttgggaactacagcacaagatagactccacctactatggcaggaaatactaaagaatgaaaaacacttagaagaaatcaaaataaacagccaagatttttatgaaaaagaaaaactccttagtaaagagaccagtgaggaactcctgcctctaccagttcaaactcaaattaaaggccatgcctctgctccatactttggaaaggaagaaccctcagtggcttccagccgccctggtaaaacctttcacgcaagatactggatgccaccagatggcacgagccacaatgaatgaatgcattacggccaaatccttcacatgcctacggatgagactatcctaacacctgacaaaagttacaaacgaacgacatcgtcccagacctccgccgccctctcccgccgtagaccatgatagccctccctcctcgcgacgtgcacgttctgaacctctctacctacatctgctaactccaatactggcaaatagacgcaaacgaacaacgccccttcatgttgacccgaggatactcccacacacattgaccccctccacccggactccactcacccgtgagtgaactggccggcccttacagtagtcacgccgtcttgcgcgcattttctgccaaaggtcacagccttattctctctttacagcttcccgaccggcacacctcggtcgcacgacactattatccacaaacaccaccttacacgttcctagtacaccaactcatatcatccctgacctc

SEQ ID NO: 584607 - DNA, 214 bp, Homo sapiens
  misc_feature (161)..(161): n is a, c, g, or t
aatctatctattaactaacttcgcattccgctaacggtcaggccaatccgctgtgacgccgggactcaagcacgagggtttcgtccttttctaaatgcccccaacgcggcctgttagacatagtccttgctacaccttttttaaatttttattccctaaanatgtgggagtcggacccaaacatgagggttctggggccttggcccttatcgaa

SEQ ID NO: 584608 - DNA, 836 bp, Homo sapiens
gcccggcgactccaccgacccgaatgtggggcggcgccggaccaaccgctagacttgaacgattcttctatttatagtcaagcttcattggacaacacagatgatgaacaaccaaaacaaccaattaaaactggcaatggtattgaaaattcagcaaaacataggtgtgattgcagcatttacagttgcagtccttgctgcgggtatctcctttcattacttcaatgattagggtgaggcacaaagaatttcttgatcatccggagaacattgacagacaattatgaatgggtggagatgttaacactccatctgtatttaaaacactagcaccgcagatctgctgacatcgatgcctaatataagaaaacaaccccaaccagcacacactgcgcggccaccggggggaggatgcggggcctcgttggcctcgaaaggggagatcgcacgcccctggccttcaataagtgttaagtcttgaccctcgccgactgactcattccgcgcgcccgcgggcccgatccgcctcatcatatattcactccaccgccccacacccgctttccccccaccatccggcaactactggaagcaactggtgctccaattcccagcaaccgccccccgtgcggtcacacccccacccccttgcggtgcaccctctcataatcccccttgtccccgttcagttcctcctaccgtgtatcctaagcgtgagaatcccaaccgcctatacaagaaccgtgaccctctgattcgcccaggttcgatcgccactgccacctcccattctgagcggacctaggaccgacaacccgctaaattaggcagcccag

SEQ ID NO: 584609 - DNA, 392 bp, Homo sapiens
taggtgactctagcaggatcttttcggtttgtgcatcctcaactcatcatctatgttaggtatttcccctaatgctatccttctctagccccccatctgctgacaggccctggtgtgtgattttcccctccctgtgtccatgtgttctcattgttcaaatcccatttatgagtgagaacatgcagtgtttggttttctgctcctgtgttagttcgctgagaatgatggtttccagcttcatccatgtccctgcaaaggacgtgagctcatccttttttatggctgcatagtattccattgtgtatatgtgtcacattaagtttatcccgttcatcccatcagtgggcacttggctagcttccaccattctcggctatagagaaactaataca

SEQ ID NO: 584610 - DNA, 309 bp, Homo sapiens
  misc_feature (46)..(46): n is a, c, g, or t
  misc_feature (247)..(247): n is a, c, g, or t
  misc_feature (261)..(261): n is a, c, g, or t
  misc_feature (277)..(277): n is a, c, g, or t
  misc_feature (300)..(300): n is a, c, g, or t
aatctgaagtggggctgagctcgtagactggccggcgcatccgggngccggacgtcgcctcggaaggccaacgccaggctgccgttgaccagcggcgggttgcggaacttgacgtggtagtcggtccaccaggcgatgcggaagcggtcgagcggcacctcgacgtagggcccgccgctcggcgcttggtgcaaagcgagaaggagtcgttgaagaggctgttggcgatggcgccgcagcgaatcgnggcaaggccggccnctctgcgctggtaagngggcgcactcgttgacaagggtngcgcacgcc

SEQ ID NO: 584611 - DNA, 201 bp, Homo sapiens
ctccacaaaaagagtaatgggatatccaataaactgagaaagattcttcacaatctccgtgattcttcgttcctcacaagtactcagtttggtcttctttcaggtgtaggataacttttgatccacgacccataggttcacctgtgcctgccctcactgtgaatgatccccctgctgaggactcccaaggtcgcctcacgg

SEQ ID NO: 584612 - DNA, 314 bp, Homo sapiens
aaactttgccctttattttataacaaaacagcccctgaaccaggtggaaactccggttatagcctgcaatgcgggcgggggagcttttggcccccccaaagtgtttattaacttgggcaaaaaaaccaaaaccggcccatgcggtttttgtggggtcccgttcaaacagccccccccctaaagggtttggccccccgggggtcccccaacctccttttagcatttccccggggaaactgagcccgtgaaactccctggttttgtgccaaggggattcctggtgcttaataaaaggggttgctgtccaggctgta

SEQ ID NO: 584613 - DNA, 509 bp, Homo sapiens
  misc_feature (13)..(13): n is a, c, g, or t
  misc_feature (15)..(16): n is a, c, g, or t
  misc_feature (22)..(23): n is a, c, g, or t
  misc_feature (37)..(37): n is a, c, g, or t
  misc_feature (45)..(45): n is a, c, g, or t
  misc_feature (49)..(49): n is a, c, g, or t
  misc_feature (78)..(78): n is a, c, g, or t
acctacaggatcntnncttacnncccaaactctaccntccactgntgtncccaaatgcagtcctcaggttgcccagcnacacacattcacattttagagccagacaagcacacttgattcaatttgttaactaatccttcaattagttaatcagtccagagctacaacaacgtgtgctgattgaaccaaactaaatacttggaggatgcaggcattgatcccgctacccctcgcatgctaagcaagcgctctttaccatttaagataatccctctgtgcctccaacaagaagtatgaaatctcaatgaccgcactgccaaatccctcgtccataagacaggatactttttaaaaagtatgcttgcttcaactgtctaaaagtatttttcatggtaagtacagtaagggtggaagtagtgactgcagtaagcccagtggtggaaatagttgtattgtggggtaagtatccagagctaacacaaatgtgtgctgattgaactaaactaaat

SEQ ID NO: 584614 - DNA, 399 bp, Homo sapiens
  misc_feature (361)..(361): n is a, c, g, or t
  misc_feature (390)..(390): n is a, c, g, or t
ataaatcattctatcctggcacatacctcctgccttcactgattggacaggctctttcttgcaagattcttattacaactttttccctgcggtccatggtttccgatgcatttgacatgttttctttaatgtgatcagaacttcttggaatctacactggcttattatgactgacactatttctttcacggactgcttttcttctgcacaattgcaacttgccatctattttagggcttttaaccaaaagccagggttactcacgtttagatcattcagattagtgtaaactatcacaatgaggaataacatgctcacatactctctccagcagacaaacactagctctatctaaattcancagtcctgatcacttatatgtttagctgnttcagaaaa

SEQ ID NO: 584615 - DNA, 978 bp, Homo sapiens
  misc_feature (475)..(475): n is a, c, g, or t
cttttttttattgttttaaaggtaaaagcttcttttaaagaaaagaaaaataggtctgggcgcaggggctcacgccggtaatcccagcactcggggaagctagaggcaggcgagaatcaccgtggaggctcagggtggttcgagaaccagccgtgaccaacagtggagtgaaaccccagtctctacaaaaaagtacaaaaaccagccgggcggtgggtggcagtgcgccgtggtaatcccagctattcgggagcgctgaggcaggaaaatctgcttgtaaccgtgggaaggcggaagcgtggcaggtgagccaaggatgtgcgccacgtggcattccagccgtggggcaaccaaggaggcgaaattcgcaatcttccacagaaacaacaacaaacaaaaacacatatgagacatggaggcgtgtgggagctaacaaggacatttaagaaaggggcccacacacaaatatcgcagngcacatataacctctataacaaatgtgttaacaaggtgggaggatcgagaacggtggcccagcgtgacctctctacataccgctcgagaaagacgggacgacaaccgagcaacaatatatcaacacgggaatcacccaagagatcaagagacgaaacaggaatatacgagcacaacacccaaagagaaacaaactcaacgtaaaccacacagagcaagacccagcggaagccacccagagggaagcaagagtcacacatacacaagtaagtcaccaatacgaaaaccgcggggacataacaagtcaacacaatagcggcacccgacataccgcacactgagcacacccacccagcataacacaaaagccagaaaggtaaaaaagggggggaagacaaacaaaggagaaaaagtaaacgcactacacacagcgcaaaaccacgattaacaccacgacaatcagcagggaaatcccggaaggaagagaggcgaacaagaaaaaac

SEQ ID NO: 584616 - DNA, 427 bp, Homo sapiens
actaagcaggcatatttcatatcaaaatagtaaagaacttcctttccaaaggcaggacttgcttctgtgaggtactgagccacccgtccctggaggaaagcaagaacagagcagatcagagcccaggcagacatcttggatgatgggtgagatcttcctggggttcttgctgaacctgctgacaaggggcagctctctctaaatgccacggagctggaaggctgcagcctggaacttgctgcagcccacccaggcaagcaagagatgacatagtttcagcacctggatctatggcacccagaagccagatccaaccccccagcccttatctttgaccttgagccagtttgaactggtaactggaagtcacttatctaccagattcaactatcaggatgttactaataaaaaatgactccaaaaaaaa

SEQ ID NO: 584617 - DNA, 338 bp, Homo sapiens
ggtcataaaatggaatattaaaaggggttttgctggagaaggaaaatgcggtaaatgtaatgcccaaaccaaagctgtggagctggaagtttgcccagcggcttccccgggagaaggaggccctgggggccagcggcttccccgggagaaggacgccctgagtgggcggggaatggggggccctctggggggcgggggaggccccgcccgggatttgagcggtagggacccggggggggcccggggaccggtcccccccgaacgggatgggggggggccccgttacccccgggggggaaaggttaaaggcccccccgggaagaaagacccagatttta

SEQ ID NO: 584618 - DNA, 384 bp, Homo sapiens
tgaggtggggtcgggatgagtctgtggtgtccttgtgaatgaagctacgagggtgggtgctccagctcggagtatgagagagagagagggtgtgacaggaggtgatgtgtgtcgtaggggatggcttcccatcctatggtgtggcagctggagcagtctgtgcagatcaggatctggtggtcgtgtgagagggtgggaccgtcttcagggaaggtggatctagcaagatgatgccaaagggtacttatgccatcaggagatactgacgagtccttccgccgctagacctacggagagataaccacaggctgtgtacctgaagagcacccgtgcgggcaggagggcggaggacatgtggccttcacgaccaggacatgttgagac

SEQ ID NO: 584619 - DNA, 1396 bp, Homo sapiens
taaatttataaaattttatattttttttatatattttaaaaaaatttatacccgcggtgcgcgtgggtgtgggtagccgggtgcctaaccttttgtgtggtgacccatttaaacccacacaaatcccccgtgcgcataagagactttcttttctgtgtgttaccaaatatactcaaatctccatatatcaccaacatttgtggaagtgtgtggtaaattttttatatgtgtgtggtgataaaaacaccacccaccccgagagagaagacgctgtgggctctctagaaaaacaaccatgttggaggtgtcagaactctcctataggagaggtgtcacaatgagtgtggacagagagagcgcacgtatatatatttataatttctagaggcgcatagagaaaaaattttagccataccatagtgtgtgtgttctctttgtggaagagtgtcctatatatatagcgcatagagagagggcgtataaaaaaagtgtcacaaagcgggcggagaaaaaacaaaaaaaagaaaacaaaaaacaaacaaacacaaagacaaaacaaacaacaacaacaagacaaacaaagaggagaggggaggcggagcgcgcatgcagaggaaaaacactcccgcacggggagggcaccaaaaaaataggaacgaaagcaccccgcgcttatgtagtagagaaacgaacagggggggcgcacccaataaaataggaccagcgcgataatataaaaaacaccaacagaggaagcgcgaggcggggcacgaaaaaaaaaaaaaaaccagcgagaggaagaggacaaaaaaaaacgaaaaaaagaagggacaacaacaatcaggagaagaaacgcaccacacaaaaacacgggggggaggcagacaacaaaaaggagggaggaaaaaaaaccaccaaagaaagaaagtaaaagcacaccaagagaagaaaaaaacaacacacaaccactcagacataaaaaagagtagaacaaaaacacacgcgacaacaaactaacacggcgcgccaaacaaaacactacacacaacgaagcggagacacatccacaaccaaaaccaatatcacccgacgaggcagcagagaagaatataaccacacgacaagcagcaacaaggccgacgcgacgaacacaagacacacgaacacaaaacagcacccagaacgaccccagataaggtaccaggacgtcaggacagagaaggtagacgagagaaggcaaaaagacaaaagcaaaagaggtagagggagcagggtgaaagagaggagctggcgaggaacagtcagcaagcggagagagagagtatgaaagctgcactaggggaggagacggtaggaaaggggaagaggagagagggacggtagaggaatggccagc

SEQ ID NO: 584620 - DNA, 866 bp, Homo sapiens
  misc_feature (5)..(5): n is a, c, g, or t
  misc_feature (113)..(114): n is a, c, g, or t
  misc_feature (123)..(123): n is a, c, g, or t
  misc_feature (126)..(126): n is a, c, g, or t
  misc_feature (132)..(132): n is a, c, g, or t
  misc_feature (135)..(135): n is a, c, g, or t
  misc_feature (149)..(149): n is a, c, g, or t
  misc_feature (151)..(151): n is a, c, g, or t
  misc_feature (154)..(154): n is a, c, g, or t
  misc_feature (156)..(156): n is a, c, g, or t
  misc_feature (159)..(159): n is a, c, g, or t
  misc_feature (205)..(205): n is a, c, g, or t
  misc_feature (294)..(294): n is a, c, g, or t
  misc_feature (330)..(330): n is a, c, g, or t
  misc_feature (336)..(336): n is a, c, g, or t
  misc_feature (340)..(340): n is a, c, g, or t
  misc_feature (462)..(463): n is a, c, g, or t
  misc_feature (465)..(465): n is a, c, g, or t
  misc_feature (517)..(517): n is a, c, g, or t
  misc_feature (587)..(587): n is a, c, g, or t
  misc_feature (794)..(794): n is a, c, g, or t
  misc_feature (845)..(845): n is a, c, g, or t
attanaaaacagccccctggaaccaggtagccaaggaagcggccgcgcctggggggcggttggggttgggggggaaactgcgccttcctgacaaaggtcgggggtcggggtgnngggagggcngcnggggtnggnggggcgaggcgggntnttntngcngctcggccataccagccactgaggtcctaactgcagccaaggggcngtactgcacacgtcgctcaccctctgtgctctgttccccacagagcaaacgcacatggcaacgttggtccgctcagccactggttctgnggtggaacggtggatgtctgcgctgtgacatcagcngggtgngtgncaacgactgggggtgccgctgacccggggctggggaaggggactcccagctcagacaggcttggctgtggtttgctttggggggggggtgaacatcacgggggacggctcatgtcagccccnngngggtgggctggcccctggtccccgggctccttctggccctgcgggcgttggngggcctcaacctgctgccgcttctccttggcccgggtgatggccgtctgggagagcctgcggtagaggtncacagccagcggagagtcgtcattgccgggtacagggtaggtgatgaggcaggggttgcagttggtgtccacgatgcccactgtggggatgttcatcttggctgcgtctctcacggccacgtgtggctcaaagatgttgttgagcgtgtgcaggaagatgatgaggtccggcaggcggaccgtggggccaaagaggaggcgcgcgtnggtcagcatgccgcccctgaagtagcgagtttgggcgtactcgccaaaatnacgggccatgttctcaatcag

SEQ ID NO: 584621 - DNA, 829 bp, Homo sapiens
ctggttttaataaacccgcgccctcttttgctgccgccctgccatggtcgccgctgcggggccccactccccccacgcgctggtgtggcgcccccccagaagggagacacccgcggggccgtgttaccccctcttcgcggattcttttcactgtatgcgccgccggggcgcggatgatacacaattttttcccacacgcgtgtacacgcctcttgtgccccctggggccctcattgttgggggcaccgccctatgtggtgacccaaccgttgtgtgctcactcagcagaacgcagagcgtggtgtttgcccgcgtctcgcggagtttttcccccgggatattttgttgctcgtgctccccacgcctctcctccgcagtgagtacactcagcgggcgtatatcaccctcacgagggttgtttggggtgcgcgcgctggtggtgtctctcccccccgcggggctcctcgtttataattttcaggtgtcgagcgtcttgtgttgcaccacaaagtttgtcacaaaaaacagaggtggtgcttgtttggcacccagagaggtatagtatctatgatgttcccgtgggggcacccacagatgttagaatggtcgccctttataaaccccttccctggcccaccatgaagccactttttgtgcaccccaaagagtgagagtctgctgcccccccccccctgttgctgaacaaaagagggggggacccaaccccccccctcccccccccctccccccccccacacgggtgtttcctttgccccttttttttgggttttgggtttttttttttaaaacccccttataaattttttca

SEQ ID NO: 584622 - DNA, 248 bp, Homo sapiens
tacctgtggggggagcgggggtaaaggaaggtcagtgaaaagctgggatgtaactacgctataagatgctcgtagacttaaatagcatcgtgccccgcctttcttctctctttattcacttttttttttttgaaacagtgttttttggtttggtttggttttggttcctggtatttggttttgaaacaggctatagtaaagcagcacatctctggctcattacagtctctgcccctcagagagagcgt

SEQ ID NO: 584623 - DNA, 174 bp, Homo sapiens
cctgttttgattttccccaaaattatgatgggccttagttcagaaaacccaaccttgctaggagcggtgcctcacgcctgtaattccagctttttgggcggctgaggccggggggctgctttaacctaggagttttagatagcctgggcagtatagtgagatcctttttttcca

SEQ ID NO: 584624 - DNA, 250 bp, Homo sapiens
gtcagaccaaataatgagttcaaagctctaataagtctcccggcaaagaaaagcctgggacctgatggcttcactgctgaattctatcaaacatttaaagaactaataccagtactactcaaactattccaaaaatagatgaggaggggtaacttccaaactcattttaaaaggccagtattgccttgatatcaaaactagacaaatgcacatcaaagaaagaaaaaaaaagtcgacgcggcctgaattt

SEQ ID NO: 584625 - DNA, 1061 bp, Homo sapiens
tcctacgagatgatgatgcagtgtgtgtcccagcatgtttgtgaccaccccactgccatgtccatctcaatgctgctgccatggtcccagttatgtgtggcatggtgcaggccaagtcacagtgtgtgttgctagcagctcccatatgggcaagcatttacaacagcaggcacagggctgcttgggcattcttctgttggattaatccctcacctcctgggacgatgtggtttatcttgtgaggtgctgtaacctgctggcccacttcatcaatgcctacctggtggatgacagcttcagccaggccctgtgcatcctggagctcataccaagttctgttgatggggcttgcagtgagccatgctgacctacccctatcctgctagttaggcgacctccatggctgtgcaccacacttgcgggctgcaagctggagctccccccttactccccagtgttcaaatcctggattcactgactggaagtacctgagtgtgcagtggccagctcttccgaggctccagccttgccttatccagccgggatgtccatcaggatcatgctttgccctggagtaacctgacatcatctcaacaaacacggtctccaccctggccaccgtggtgtgcaagctgaacaagcttggggccaccttgcccgcacgcatccagacccaacaaacacaccagcttgtgctccaggccagagcggggcttacagttcccatcttggccatggtgtcgtgtacaggatgtgaggagctgaccgggggcttgagaccgcaccccaccagtgctgtcgccaacccgcgacacaccatacgggcaaggtcaggccaagaagacgagcgactgggaaaagatccgcgccaaagcatcggcaaaatacgcggcgagcccggacacagaggcaccaaggagccaaaggacagggcgccagggggcccacaggatggaagtaggacaagtgaacactgggggcgaaaccgcacgccgggcacgccaccaagacagcccgcggcgcaagcggggaaaaagtgaagcacagcaacgacggacagg

SEQ ID NO: 584626 - DNA, 341 bp, Homo sapiens
gctgcattactacagagacctgacgacggctgaatacaaatgatgtggtaaatctataactcatctaacgttctataacatacccagctgtagtagctattcagctctcgcaagaaatccttcatcatagccacactccacagagtgggataaaaacacaaaaatcttggctatccaaagtccaagaatattggtcctagataaagcatcagatcagaaaaacaggaactgctcaagttaattgaagcagacagaaatttaatacagggtgttagatataaaactgtgggaagggctgaaggaagcaaagagtgtgtgtagtaaaccccgtcgttaagctg

SEQ ID NO: 584627 - DNA, 136 bp, Homo sapiens
tcctcctcgctgttcaccttgaaccggccgaaggagctgaagcggttcagcaggtacagcatcacggccaccacgtggcggcgacgacccattcgaacgactgccctatcaactttcgatggtagtgggtaccgag

SEQ ID NO: 584628 - DNA, 810 bp, Homo sapiens
  misc_feature (293)..(293): n is a, c, g, or t
accctaagtaatcaagtggccatggtccaagtgataagtggagcatacctggtatggcagtgagatggtccccatgtcaataggtgagtggaaccacattctctagaagaatctttgcgttgaggtggtcccgtccagttctatgtaaactcatcactgcttcatccacaactatttcatatgggctcttacatccatagcgcactctctctagagatggatatatactcatatgtctcacactatgatgagcgttatgagtgagcccgtattcacacagacagtgtctgtgnacatgcatagtgcagtggaggaccagccccgttcaacacatgaaatgttgttatcattcttggcaagtgtttatcgtgtgatgcgaatcatttgcacagtatcaccttcaatatgtgtctgtcgtacagattcagaatgccatctccccttaaagtagagaagcacagtgtagtcattcctggtgttggaggcacatcaatgattctgtgcatgttatgagagtcgtgtaatgagtttgtagtagacgcgattattatagtcacagtacgtgagagatctcatccacgtgtaggcaacgtgtgtcatatggctcagatttttgttcgtcatatagaactccacggcagatgtttgaaagatcttcatatgctgcttctcgcacggcagagtagatctgtcatactagaagtgcattgacgagcagccacctgcttggtagttcccatgtaggacaactaacaaagctgcaatgatggtggtgctgcatatgaacctgcattcatgaccagtgatgac

SEQ ID NO: 584629 - DNA, 216 bp, Homo sapiens
ttatcggtgcagttcacttgaccaagagcagaataacggtacttctgaaccaactcctcagatatagcaacttcagaatcccagatatgccctgattggggtggcctctcatctggattccgggatagctgggatcacacccttgtatatcctaaagcggagggtcacagagagcagggccaagggcggcggaggggggtccggagctcgaattcc

SEQ ID NO: 584630 - DNA, 418 bp, Homo sapiens
agtttgaggcccaactgggcaacatagggagaccccatttctttaaaaaaaaaaaaagagtagccaggtgtggtggtggtgcctggaggcttaggtactcgggagccttaggtgggaggattgctggaacccaggaggttgaggctgcagtgggctgtgatcacaccaatggacttcagcctgggagacagagtgagaccctggcccccttcttaaaaaaaaaaaaagaaagaaagaaaagaaaaagaaaaaaagaaagaatcaatctagaaggttcaggatgaaaggatttggagtggcaggggaaacaggccattgaggtaaggaaatgaagttgcgcaagaacattaaccagcacatttggcggacaaggatggccaggattatttgaccggggatccccacaggtgtagctggg

SEQ ID NO: 584631 - DNA, 127 bp, Homo sapiens
gtacaccgtggtatatataagtggcttataagcacctccaagcaactggctcctatttgcatcttcacgcatcatctcaacacctactatatcatctgccacaacttattaagacaaaactagacca

SEQ ID NO: 584632 - DNA, 823 bp, Homo sapiens
  misc_feature (199)..(199): n is a, c, g, or t
  misc_feature (612)..(612): n is a, c, g, or t
  misc_feature (711)..(711): n is a, c, g, or t
  misc_feature (713)..(713): n is a, c, g, or t
  misc_feature (803)..(803): n is a, c, g, or t
  misc_feature (807)..(807): n is a, c, g, or t
  misc_feature (816)..(816): n is a, c, g, or t
gcaccaaatggcgtgatgacgccgtgtgcagctgcgggtggtgcccggtggtgccctggtggctcctgggcattgtgcgacccgtgggtggcttccgcggagtgtttcggcgctggcatccggtgcctggggtctctgccgataggacggggccagcgggccagaggacctagtcgagaagcctcagctcgatagcaantggcctgatcgaataaagtgattaggattagcccagatctataccaaagttgagggcacgctatgcgatcaatcggcacatagaagcgactcagatgttcccttaggatggaggactactagtcgtcttgtcatcactctgtcgcgcattttaagggaactcaatcgagcatactagtatgggagtgtgtccattgccctgtggtggtgccacttactttcttacaagagggcacttggagcggttctattgacaagcatataattgccctatgttagcaacgaagaagtcaacgacgcgcagtttgtgccggctcagactgcgatcacaaaggctatctaagagggaccatatctgtttagcgtcatacgaggcgaccatatccaagtagtagtcaactgatcggagatctngtgcgttgtgtaaacgttgctttcgcaataggagaaaggttaggtgacccagcacctggccgaatccccttggtatgagtggcccaattcaatcacgtngngccccaaaaagtctgtcctcgcgattcgggtccccacaggttggctggcatgatgaggctaacgtggcggtgtgaaaagccacatgtatnctgngacaaatgncgcctca

SEQ ID NO: 584633 - DNA, 206 bp, Homo sapiens
aagcccccgttttttttttttccggggacttttaaaacatccttatggtgcccaaagggctttttttaactttaacctttttttttctgttttttttcagtggaaggccccgggttgttttttcaggtttttttaaaaaaaatttgggttttaatttccccctttgggcccatttcaaaaccatttaaaaatttttttttttttta

SEQ ID NO: 584634 - DNA, 397 bp, Homo sapiens
gcagatttaattattcttgaaaaaattttttatcttcaaagggactcaagctgaagacctcctttaggtatgtcgtcggtagatacctacctccagtggctggcttgttttagcctcatggtcaagatgaggaatctcagagtggactgcagcccatgctcttttccagagcgtgtcagaggacaggctgtcacgaaggcaggcttcacagtgccggtttcctgagaccacgggaaatgtggctgaaggggtcattgatgtctaacctcctgtgttattctgggtgcagttctaatgcccagaccattggtgtcccctggaatgtgcccttgggtcagagcaaactttaagttattgttaatgaggttgtgcatatttgcataaactttcaaggtga

SEQ ID NO: 584635 - DNA, 623 bp, Homo sapiens
ctgatacacacatatacacaccctatggaactggacccaacaactggattatcatgaggtgttgctatgatgaacatgatcctgactatactcagagctgtagagacctgattcatctaaccttgacgagatacacaggtccactggaaattagacacgcacagacttgtacacccagaagacccctccgacctaacggcggccagatgagatgcagccctaactgacacagagtcatactagggacttgtctttcgagattcaggaaagctctgccccagaacaccagccatttgaactgagtcactaaaacctccaagtaaagatgggcttagtctaaaagttgcaagaatcccaatacctcgcaaatttaacttgacggggtggcccgaaacccaattggccgtttaatgggggcccaccattgaacggcacaggtttttcacacttagccctggaaaaaccccgggttatccaaccaatagcccttgcgggaatatccctgttcgcatattggccaaattggaaaaaagcccgaactaactggctttcaaaacaattgcaaacttaaacgtacatgggaaaattttaaggcatttttgcggtgttcccgagatttttgg

SEQ ID NO: 584636 - DNA, 588 bp, Homo sapiens
catgatgacagatgagcggcggctcctgtgccgcgggaccgtgagacgggttcgtggccggccatttagggggactgcttgcgacacctgctgcgcccctccggactggttccttgtggcccctggaagctcgctggtgggccctgtgggatggcgtgcatgctccctgctgtgaggcttgcttggcctgcctggcttggctgtggtgtgactgctgtgtgtgctgtgggtgccttgcttggcgcttcttggccaatcatgttgcctgcttctgtcacggtgcctgctgctgttgctgtggctgcgcagcatggatctgcgcagctctacgtgccgctctactccgagagctcactgccgcgttctcctcggcctgcctctgtgcgccggctgcacggctgtcctgtgccatgcctctgccttgatggcggctgtaagccggcgtcttcgtttgggacgaggagaggatccaggaggacggagttgcagagatctattaatgagatgaagcggttggaagaaatgtcaaatatgtttcagagctctggagtccagaccacctccagaacaaagcccaacagaaggcat

SEQ ID NO: 584637 - DNA, 127 bp, Homo sapiens
ggtctggtagatcgtatatgggaggctgaggtagggaggatcactttagccggggagatcaaggctgaagtgagccatgatgtggccactgtactccagtctgagtgacaaagcaagattctttctt

SEQ ID NO: 584638 - DNA, 738 bp, Homo sapiens
gacagctgactcccgtagaggaagacactgtggaggccagttctggagctattgcagcctcggtttgcccggccggggacccgagccgaaaagttatcgtcagaagtgtcgggcaatagacccgaatttggacaaatctttcccttcgcgaatggccacagacccatcattgaagggctcgttttaaaggggacgccacagacagggtccgaaacctcctgaagaacaaaatctctgatgccttaaactcttcgattttcgacagattcctaatagacagatacattacgaaggattaacaaactggttgcgatcgggcgcggacagtggactcgacgaagaacagctggccttttttccactgacgctggaaggcccaaggtttcacaatgccagggtgcactttccagcgacttacacggttaatcccaagaatggtccaatttacaacggccgccacagcttgcaacgaatttccgtaagcgctgagtgcacaacgcgacttcacatttgtacggcagaggggtggtctaacgatgtggggacccaggatattgtggggacccagtttacccccaattgaaccgggagaacctggaccagcggatctattggcaacgctgtggcgccgtggctgtacaacgcccccaacgacacgggttaggagaggacaacaacagaggtgtgtgggctaacaggttaaagaggaacggacacctcaattcgcccagataggct

SEQ ID NO: 584639 - DNA, 736 bp, Homo sapiens
  misc_feature (150)..(150): n is a, c, g, or t
  misc_feature (333)..(333): n is a, c, g, or t
ggcggggggttcctgcagacccccagtgcccccggccggtgcacctggagtgtgtggaccttcaggggccacccttggccctcgaggcctgtcgaagacccagtatgtgcagagccacgtgagacaagggacatgaaagggtcttgcaanggtgagcctacgtaggccagaacgggcgccagcgtcactgcgagaatgcgacctctgcggagctcctgcttcaagccacatggtaccctgctaccacccgatggtactcctatcttgcgcgagtctatgcactccttgggggcccctcgacttcctgcctttagcctacatgcgcggggtctngccctgtggagacttccacacggacccccgcgtagacatccgcgcgagatgcatgcgaggcgcagcagcattggatgacggcccatgtgctggtcatgtctgaccagctaggagctcgcattgtgtgacgccagcactatctatgccaccccagaagtatatggatagaccaccaggcggcacattacgacaagggtcaacttttcgtacacaaaacacacaaacaaaaccaaaaaagaaaaaaagacccacgcagagagcaaaaactcaacaaaagaagataagagatgagtggagcgaagaaaggaaaaaaaaaaagaaagaggtaacaagagagaaaagatgtgggaacaacatgtgggcataccaatgaagcgcgtgggattagcgccctgtaacaccc

SEQ ID NO: 584640 - DNA, 281 bp, Homo sapiens
ttgcagtgaaccaggatcacgccatcatgccattgcactccagcctaggtgatagagcaagaccccgtctcagaaaaaaaaaaataaaatattccatgtgcccagctagttggggtgtgtatttttgccagtactcttaaaattgccttaggtttaaagttattgggttttgttggtatctcccatttcacggcttgctctaaagcatgtgttttgggggaaccagtttagtactgttaaagttctagaccatttaaaacaactagagcagaaggtcgacg

SEQ ID NO: 584641 - DNA, 710 bp, Homo sapiens
  misc_feature (43)..(43): n is a, c, g, or t
  misc_feature (78)..(79): n is a, c, g, or t
  misc_feature (92)..(92): n is a, c, g, or t
  misc_feature (94)..(94): n is a, c, g, or t
  misc_feature (168)..(168): n is a, c, g, or t
  misc_feature (186)..(186): n is a, c, g, or t
  misc_feature (293)..(293): n is a, c, g, or t
  misc_feature (314)..(314): n is a, c, g, or t
  misc_feature (390)..(390): n is a, c, g, or t
  misc_feature (560)..(560): n is a, c, g, or t
  misc_feature (615)..(615): n is a, c, g, or t
gtgggcacctgttgcttgtgggttggtctacgctgtgcgcggnggacgtcggaggcagcggggagcggatcggggccnncggggcctctccngngccgcagcggcagcagttgggccccccgccccggcctggcggacctgaagaactgcagtgaagtgggggcctgngggtggacccgcccccgngcctggcctgcagccatgaactccaacgtggagaacctacccccgcacatcatcctgcctgtgtgtacaaggaggtgacgacactgacctgcagacccacccgatgngcatcaaggtctttcccaacngaggagtgacctcaccgacctccagtgtcaccatcgagggccctgaggggaccccatatgctggaggtctgttccngcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaangtgcctgctgatccaccctaaccccgagtctgcactcaacgaggaggcgggccgnctgctcttggagaactactgagggagtattgcaggtcagggcccagtctactcacaagagatccagtgggcgccgcgggccagcgcaaggcgaac

SEQ ID NO: 584642 - DNA, 194 bp, Homo sapiens
agcgattctggaacccggcatcagctcagaacacatctggggagagagcagtcgctggggtgacagtgagagagctgtcagcggcaatgctgtggatggagtggggctcatgcatgcagacgctggtgctggcctgcatgtgcctctccactgagcccctagattttgtggtacgggaagcatgtatggtgtgc

SEQ ID NO: 584643 - DNA, 201 bp, Homo sapiens
gcgctttggagccggccccaggcagcgtgtgtcggtcgcctagtctggagaactagtcctcgactcacgtgcaaggatgatgcttaaatgaataacaaggcttatctctaggattcattagtgttgagcccctggcgcgtttatacacacatgggagccccagctctcgcacaagcgcattctctctctacacctgagata

SEQ ID NO: 584644 - DNA, 220 bp, Homo sapiens
gggggggttttttttcccccccctcccgggggggggggggggggccccccccccctggggggggggggggggggggtttttggggggaaaatccccccccccctttttttttttttttttttttttggggaaaaccaccttgttttttttttccggggggccccattttttttcccctttttttttcccgggcccaagggggggggggggggggggggca

SEQ ID NO: 584645 - DNA, 282 bp, Homo sapiens
tccccgctcgggacctgtactaatcacaatgctgtttctcttttgtaaagtggacatacagtacttccttttttttattagcagcaagtccgtctaacaattttcaaatattgtcctctttcctcgattgttctcttttttaccagtctcttgcccttcaaacaaagaatacctcgcctccacatcagcccatttaatgtttccattggttaggtcttggactatgctgggcagctcagagatctctgctacttatctgccgcatttagtcacgggtcccaa

SEQ ID NO: 584646 - DNA, 125 bp, Homo sapiens
ccctgtcgcgatctcaatggctcagcgacttgcgtccttgagcattcggcgaagggatgacctgcacgccggccggctgtcttcatgccgccggacccacgccgtgcttgttcattgcgtatgat

SEQ ID NO: 584647 - DNA, 299 bp, Homo sapiens
cggctaatcggagtgcatggctgtatctcggtgtatgcacctctgcctctcaggttcaagggattctcctgcctcagcctgccaagtagctgggattacaagcgaccctcaccccagctaattttttttttttttttggtattttaagtaaaagatgcggttccgccataattggccagggtggacttgacctgctgacctcaagtgatccagccgcctctacctctcaaagtttggggataacagacgtgagccattgcacacgggacagccattgcactccggttagccattgcaat

SEQ ID NO: 584648 - DNA, 215 bp, Homo sapiens
cggagtcaagccgttcccgcccagtccgtcctgcagcagtttgcctcttttcacatgacagatgcggctgtgttccttcggccaagggactttccttgggcgggtggagttggcccgagccatcttccaagacgggcgggtagcccccattggggcgggtaaaggcttcttctccagggtccaggcaattcccaccaggcagatacattcgggta

SEQ ID NO: 584649 - DNA, 182 bp, Homo sapiens
agacacaggctcagatggtatgattttctttaaggatcgtttataactggcccaatgtttacaatatgtggcaattcatttatggatctatcacctgtcatcataactcgcttctgcttgtcatccacactacacctaggactttatagacaaactggtgacttgaatgccaagtcttgtag

SEQ ID NO: 584650 - DNA, 324 bp, Homo sapiens
aatgtgtggtgttatgcgagaatacatatataggtttatgggaatattgaggtaatttccgaggcacgcctaaagtgaacacgaggaatacaatgaaaagacctaattagtcgtggactgcgaaatgagtagtagaatgtttgggaaccggctgtaaagcggacatgaacatactactatcatttcaatactatatttaaattatatcatcaaaactgtatttagattgtattaatgtaaaaactaacgatacttgtagacggttggaacacataacataatttacggaaacatatgggtaaaccaccataacaccacacaatt

SEQ ID NO: 584651 - DNA, 278 bp, Homo sapiens
tgtgattgcttttggtcagtgcccctggctcatgcccggctcctctatggcaatgatgcctgaggatctttggagctaccacgtggctggtgcagagcgtgggcacggatggacgtgtcttccatttcctagtgttcatctgaataccacagacctggactctaacgagtgtgtctagaatttgccctgtttgaatttgtacccctaatctatcagcatttttggtgtctcccagtgatcaaaaagagagtggttgtggaacctgttggccttatgag

SEQ ID NO: 584652 - DNA, 123 bp, Homo sapiens
aagggaaaaaaaaaaatgggggcccccttttccccggcccccttgggtttttaggggcccccccccccccttgggttttttggttgggggggcccctttttaaacttttttgcccccggggga

SEQ ID NO: 584653 - DNA, 937 bp, Homo sapiens
  misc_feature (40)..(40): n is a, c, g, or t
  misc_feature (629)..(629): n is a, c, g, or t
  misc_feature (860)..(860): n is a, c, g, or t
tggtataggtaatgagagtataggtgagcaggccacctcnagatgactactgggattcatgctataagtattcatttttcctaggtatttggaaacataattttcaggtcaagagggaggggaattttgtattttttgtatttgagaagataatgcttttgctttactgagacattgtttactttgactatttttggttcaatactactactgagggcaccatttatgactctgaattgtatagttggaaagttgctaagcatccccgcccctagtgggtgagtgtgtgcacagtctatcaatgagagaggtcaagttcaagacccttacgtaccgtctcctgttcacttatcatttttaacagagaattggatatggatgtaccccgcgtataggacgggcatatacaagatgagatgtgattggtcatttgtctcgttctttatcgtgttgcggcatatgaaatgccgcgtatgatctattaactgtaatacattagttctagcggcccctggcccgctggacctattacagcatttctctttagagaggagtgattaatgcccgcgtagcgaactccaaattgcgcctggcttgatagtctctagtctaatctctcccgtcagtantcatatcgcgtattagtcgaatctattgtatccgccgcgtattctgactcccccccccgtgaagcatgtgtatccgatctccacgtccgacctggtcgcttgcttgcgagttatgtgcgaacggcccgacctctcgcgtcgctagtacattcattattgtagcttgtggttgcatagccccttgatcgtaggcattagatgtaggcgcggaaggaatcgctgtatgtactntaaatgatgaatttagtctgtagcatctatgtatgatttctgttttgtaccgatgcatgaaagaagaataatcgggg

SEQ ID NO: 584654 - DNA, 545 bp, Homo sapiens
  misc_feature (269)..(269): n is a, c, g, or t
  misc_feature (288)..(288): n is a, c, g, or t
  misc_feature (353)..(353): n is a, c, g, or t
  misc_feature (377)..(377): n is a, c, g, or t
  misc_feature (388)..(388): n is a, c, g, or t
tttttcagacactcagatgccttcagtactatttcctttcctcataaatgtagttcacattgctctctgtaccccagtgtcaaaatctagttctcaggtagctctaggaaactccagtgggtggcaaacatgttcaagttacagtgctctatgtaatgaagtcccttactccttgaaaggtttcaaagagagaggggaaatgacataattccagaggtcagggaagtatgtatccgtgtgtatcccatttgtgtccctagtgtctaacntatagtcagtactgaaaanaaatttgaatattattgaaaatatggaatatgtgcgtacatatatatatacagttgcttttatcnacttaaaaattttttaatttttanttttttgtagngatagggttttgctatgttgcccagattggtgttgaatttttggcttcaagcagtcctgcctctgcttcccaaactgctggaggttgcagtgagctgagatcacccactgtacttcagcccgggagacaatgcgagactccgtctcaaaaaaaaaaa

SEQ ID NO: 584655 - DNA, 200 bp, Homo sapiens
tctaacgtgatcgagccatccttttgttctaaataattcttcctccctccctacctgtttaatctttaacctcttgaggcgcagacttggccaggatgaacttggagcaagggttgaccttcagtgcaggaacccattctctaaggccactgagttctaggactggagtaggagaggagctgttgtcaaggttaaggtca

SEQ ID NO: 584656 - DNA, 460 bp, Homo sapiens
attcgcggccgcgtcgactttttttttttgagacggagtctcgctctgtcacccaggctggagtacagtggcatgatcacagctcactgcaacctctgcctcccgagttcaagtgattttcctgccttagcctcctgagtagctgggaatacaggcatgcgccaccacacctggcaaatttttgtatttttagtagagatggggtttcaccacattggccaggctggtcttgaactcctgacctcaagtgatccacccaccttggcctcccacagtgctggccacatgtgtgagccactgtgtccggacatgcctaattaaaaaacaaatctttttttttgtagagatggggtcttgttatgtttcccgggctggtctcaaaccccaggactgaagtgttcctcctgccctcgtagacgcggccgggaatttagttgtagttgtcgacccggtaatttcg

SEQ ID NO: 584657 - DNA, 143 bp, Homo sapiens
tgtgtttaaggtgccaggtatacgtgtaacatatcctaggtacatgcgcgttcacacagctatacacgaagaatctcagcccttgtacttttgcatagtctgatacgtgtatgagactatgcaaaagtacaagggctctcgtg

SEQ ID NO: 584658 - DNA, 617 bp, Homo sapiens
agcggagctggattggatcaccagacctctcccaagaggggcctggcttcctcctcgctggagaactcggtacggagctcccctacgtaaatcctctagggagagtggccaggtagccgggatcagtgaagaggcctctggtgcccaaagggctgtccgcagaggctgatggtcccttgcgaatgtgcacagcggaggagaggtgacatcagacttccagccgagttcaggcttccatgtcagactgcgtgtgtttatgcagagggtgcaactcaggaattagctgaggagaaacgtacaggtccaaatttaacctcctctgagagacctctaaccctgctcatcaccacgtcctcgctagaaaagggccctctcacagggaagaagccagagggagagcgtcggaattctcctccccatggaggaagagtgcttcctctacccgttaatgtatcaagctgacaacaattcaaaccgaaggaaactaggatgtgacaaataaaggaagccttggcatgctctgtgtccactggcgtcgggcaagccccggtggaagtccaaggaaaagagtctaagacccaaacagatggtatgcgccaaaagttctgaagtgtatc

SEQ ID NO: 584659 - DNA, 102 bp, Homo sapiens
gtcgacacggaatctaaaaatgataccagtcgtcgaccttaaaagttcaaatggtcggctgggcgtggtggctcatgcctgtaatcccagcacttttgggag

SEQ ID NO: 584660 - DNA, 155 bp, Homo sapiens
  misc_feature (23)..(23): n is a, c, g, or t
aatcgtcgtccctctctcacacngggcaagagcgagatccatctctaaataataataataataataataaataataaataacaaaccagtctttattttaaaagaaactttaggaaacaaacccacataatagttgggaaccagtgtggagagag

SEQ ID NO: 584661 - DNA, 502 bp, Homo sapiens
caaggctgaggcctcagccccgggccctgggctacttctggcctgaccccgcagcccctacgacagcccgcagctctggctcctccggctgcccctacgcctacaccacagtcctctgaccccagaatgtcatactcttgctcccaacccacagcactttgcacccaagacacacgtctactacctgtagctttgcttgtcctccaacatggcgtcacgctgatagaacacacgcgacaaggcgcgctcggcgaaacatcagtcaggtccccacgaatacatctcacggcaggacataagacgcacacaacgacccacccttctccaccactgccgctgcccagagcgcagcaccaacctgtagaacaaccaacacctacctatgcaccaaacgtgacaagtctcgctcagcacaccgaccacgcccacgagccactacacacggcggaagacacgcaacaaccgaaaccaactaagtcgccccccatcctagaccccacca

SEQ ID NO: 584662 - DNA, 258 bp, Homo sapiens
  misc_feature (5)..(5): n is a, c, g, or t
gcagntgggagcagtgctcatgcctgtaatcccagcactttgagaggatgaggtgggaagatcgcttaagcccaggaattcgagaccagcctggccaacatagtgaaacccgtctctacaacaagtataaacacttagcttggtagtggtggccatgtgcctgcaactcccagtatactccaggaggctgaggcaggcaggatcgcttgaacctggagaggcagacggttgcatgtgacgctgacgaccagtgcaatt

SEQ ID NO: 584663 - DNA, 402 bp, Homo sapiens
tttttccatgtggaatgcagatgggtgctagaggagcctctcccacatcactatagtgtaatattattacaccacactgaaatgtattcagaaacagatgtttcaatttcattctttctccagaggtggtccagttgtaccaatgatactattccttgcactgaatatatataaacactcttcagtgtttatattggggaaatactgggaaagaaatatatttgttaaggatgaaggctgtatctgttgtctttataaacactggttcatttcttttgagggtggaatgcatttttcttcctgttcagtgctttatcaccatctgttgtttgtggtcacagtgaccatagctatgtagcggacgtttccaaatgtatagagtgaaataaacagttactagca

SEQ ID NO: 584664 - DNA, 328 bp, Homo sapiens
tcacccgaagaccacagaagcttatgaaaagtaagtgatgagatcaggcttgtattttagaaataaaaacttgggtatatctattctttacagaaattgactatgtactgggccacaaaggaagcttaaatgaattccaaagaatctatagaccacattcacaaaccgcaatgtggtaaaattaaacatcaacaacaaaaagagagccaaaaaggtgtagatacaatacaccttaaattagtaactgcagctgcttctgaggaaggggccaggaagtcagaatgaacttttttttttaaccacgtacatctattacttacgatttttt

SEQ ID NO: 584665 - DNA, 988 bp, Homo sapiens
agcggaggtgccactggtgtagcttctgtcaccctgccacgatcgggccgtctccctgagcgttggtacaccatctgcttcattctccaccgcgcctatggtcccatcttggagccagcgtgccgggcctggcggtccgcgggttggtgagagagcggtccgggagagcgatgaaggcctctgggagatgcgtgcatgctgtctctatactcgagtcttcttggctttcctgtccatcgcttccatgcgtgttgcttgcctgcatcgtatgcgggccccttggcagtcctgctgctggctcgccgaggcctgcgccaaggatcgtctgaggcctcctggtccctagtactcactgggaccattacactggcacgttttggtcgaacgcaggaggcccacgtaccctccctttgcacccgaggccagccggcgtcccagctggtggtcgtagtgacgtgaaatgcatgcgggggtgcccagcgtggggtgtcctcctctggaaggggtaggagctaactggtggctatgcatacgccattgttggccccgagtgccttttgatggaacgcgcatcgattcgactggtagggagtaaaggcgcccgagtggacaaaggccacgatgggagttgccgggcctctgcgtggatgtagcgccctcaaacctcctttggtcagaacctaatgcccccagtgtagcccctaggccgcggctccctggaaccggttgtttgagagtgcgtgggatggagcggtcgtgcggctgcctttggattgttccatttgcgctggtgtcagtggacgagctcaagggtattgaaagaatcgcaaagaaaacacccggaacgaacttagggaatgcattatgggacagatttctatgagaatcccttagagcacttagtaaaaacatcacttcgaatgttcgaacccccgttatagtaaagcagcgatgtgtacttgaggtgacacgtgtattggaccaacca

SEQ ID NO: 584666 - DNA, 179 bp, Homo sapiens
ccacttaaggatcccctgagagaatcatttgaaccccggaggtggaggttgcagtgagctaaaaacgcaccactgtactctagcctgggtgacaaaacgagaccttgtctcttataacaaaaaacaaacccattcttgctattgtcatttaagtgggtttgcaattgtaaataacactg

SEQ ID NO: 584667 - DNA, 144 bp, Homo sapiens
acccccagacacgacggtgaaaaacgcccctgtggaaaaagtttttttttcccccccgggggggggggggaaaaacccccccctcgaaagggtgttatcctcccccccgcgccggggggggaaaatcccccctccccggggggg

SEQ ID NO: 584668 - DNA, 111 bp, Homo sapiens
acaatggtggtcttctcagatgctgtaggaaagacctctacctatcagtgaaagtatctacccagaccaagaggtattttagtttcctgacttgcgtccgaaactgagaca

SEQ ID NO: 584669 - DNA, 206 bp, Homo sapiens
  misc_feature (1)..(1): n is a, c, g, or t
  misc_feature (41)..(41): n is a, c, g, or t
naagggaataatgtctattgtaatttagataggttatgtgngagtataattaaaatatttgtgaatgagttatttttatatagtctgtgatctgtctgaaaactacaatcttgtttaaagtaaccaaagcaaaaaccttaaggtacaatcgttagggtttgttttttggttttttttttctgggagacggattgagaccctgtctc

SEQ ID NO: 584670 - DNA, 449 bp, Homo sapiens
  misc_feature (292)..(292): n is a, c, g, or t
acgaaggaaccacttgctggctgggcagatcaggaccactaaccctggcagtggagagttgaggaccacagtggtgaatgaagcaggtgccagccacactgacctcagtgaagataggcaggaaagtagaaataaaaacatcgtaccccaaggctccttaaagaaggcagtttggttctacttgcctaggaactcatacctggtgctgaactggaagcagaattttctgtggcatcttgtgccccttcgatattctccttgttctccccctgtttcttcagcgtccgggtcntggaaggaagtgtaggtaatcgaggcagacatggaacaacagatgaggaggaggctgctctcccgagctcctcagctacctctgtaaggaggacaaagggaccggtaataagaacaatttcatgaccaaaacggggaagtggttccttgtcgggtac

SEQ ID NO: 584671 - DNA, 192 bp, Homo sapiens
  misc_feature (94)..(94): n is a, c, g, or t
  misc_feature (111)..(111): n is a, c, g, or t
  misc_feature (152)..(152): n is a, c, g, or t
  misc_feature (164)..(164): n is a, c, g, or t
  misc_feature (169)..(169): n is a, c, g, or t
  misc_feature (173)..(173): n is a, c, g, or t
  misc_feature (181)..(181): n is a, c, g, or t
agttttagtttaaagaatttatatgtagcaaggaaaaggggctttttaattttaatccctttgatcaaaagggcttttttccaaatggggtaanggatcaaaatgaacccngttgatgtgaattcagttattgaacttgttacttgtttttnccaaaaatgttnttaanaaangtcaatgngggggataata

SEQ ID NO: 584672 - DNA, 434 bp, Homo sapiens
  misc_feature (244)..(244): n is a, c, g, or t
  misc_feature (259)..(259): n is a, c, g, or t
  misc_feature (284)..(284): n is a, c, g, or t
  misc_feature (317)..(317): n is a, c, g, or t
  misc_feature (319)..(320): n is a, c, g, or t
  misc_feature (333)..(333): n is a, c, g, or t
  misc_feature (409)..(409): n is a, c, g, or t
  misc_feature (427)..(427): n is a, c, g, or t
ggcagtcatttggatggtcctgtgaggtagaaaacattgtccaacgttctacgcgaggaaatgtggctgggccacaggactggactccccagtcccgcttttgcctgaagacttcgagggacgcattggagcgcaagctcctgcttggcggtgaggcagaggggctaacgaccttcctctcctaaattcactgatgcggcggcaagaatggcaccgcctcgtagagctaccgcatttcccaaantcgtagtctcaggancatttatactcataaaaatgagggncccaagctttttgctaatgtgggttacagctancnnatgtttaaccacntctaagtttaaaatggctttaaagtttttgttggtttcgttgtcagccgggcgcggtaactcacgcctgtttcccncactttgggaggctgggngggcttt

SEQ ID NO: 584673 - DNA, 83 bp, Homo sapiens
  misc_feature (27)..(27): n is a, c, g, or t
  misc_feature (29)..(29): n is a, c, g, or t
ggacggtagaacgcagggcgcacacangnggattagagtccaccaggtgggctctggggaactcgtggttgggatcaggggcg

SEQ ID NO: 584674 - DNA, 293 bp, Homo sapiens
tacgatgttctcaataagttctagctcatagaaaatgaacatctatcttgtgtgcactgtgtctttcatttatacgaagcagtagctgctggttgtgtgtggctttcagtattaacatcattcacagagctttcctcttctgaatgtcatgcgcgctgtgatgtccagttctatgtcatcagtacacaggcgaataatagatggggtttattaaagcggagcaagtctgccttttacctggtgcgcatgagtggggtctttcagagtttggtggctctcccatgtttctatac

SEQ ID NO: 584675 - DNA, 117 bp, Homo sapiens
ccattgacatgtatggcgaggttaagagaaagatcaaagaaaacctatgctatgtattacttttgtcctcactgtgccttcttattttatgtttattcagttctttgtttagaattg

SEQ ID NO: 584676 - DNA, 356 bp, Homo sapiens
ggcaaataaatacaagagattgcttgcttttctctttaaagaaggtgcatcttagttgcgcaaaatgctaagaaatatttaggaaataaacgaaagaggtgggctggtcccagcttaagaccaccttgtactgcatgggcagatagtgctcattgtaaatctccttctcaacgacagaatcactctgcggtttacgcaaacctttaagccttatagcgagttgatagtgttctgaacacatgaccttcctcacatgccaaaactgtctgccagtttttgaccatccggtgttggtcaacaaagctggaaagctcactgaactagcggcatgtttctccggtgatccctaaagcttg

SEQ ID NO: 584677 - DNA, 972 bp, Homo sapiens
gctgcaccggcagagtgctgcgtgggcggacgcgcgtggccggcgcagccatggtgaagattagcttccagcccgccgtggctggcatcaaggtgtcgacaatggctgacaaggcgtcgcgcgtcggcccctgtcgccgtgcctcggacacctgagatcctgctgactgcctggctagggaggagcagccccacaacatcgatccaagagggggagctcagtgggcggcgtgtgctacctgtcgatgggcatggtcgtgctgctcatgggcctcgtgttcgcctctgtctacatctacgagatacttctttcttgcacagctggcccgagataacttctttccgctgtggtgtgctgtatgaggactccctgtccctcccaggtccggacttcagcatggagctggaagaggatgtgaaaatctacctcgacgagaactacggagcgcgtctaacgtgccttgtgccccagtttggcggcggttgacctgcagacgtccatcctatgactttccagcggggctctgactgcgtaccatgatatctccctggacaagtgctatggtcatcgaactctagacaccattggtgactcgccccattcgcaacttctgggagctcctcattgaacgtcaacagggggacctaaccgtgacggcagaacgtacatcattcgcaggaggacatggggggtcacgtgcacgccaatgtcacgttgacccaaggacgtcccttgaggatccgttcatatagcaaccttgtgccacacggggcaaacagcagcgcccataacggggcgtcctgtggccccgggtccacacacgtatcaggggcggatacgcaacgcgttgcggccacagacacgtgccaatgtgcccacccgtgacaatttgacacaaacaccttacctagctgcgaaaacgcgttctatttctcaggggtttcgatgtgaagagcccatgctcaccccaca

SEQ ID NO: 584678 - DNA, 407 bp, Homo sapiens
  misc_feature (254)..(254): n is a, c, g, or t
  misc_feature (265)..(265): n is a, c, g, or t
  misc_feature (275)..(275): n is a, c, g, or t
  misc_feature (300)..(300): n is a, c, g, or t
cggacaggttacaaggattgttatacttggtcttggcctgtgaattatagatactgtgaatggttcaggagtctcttaaatgtatcttgtgaagggtatgttgacggtcttcatagcgttcagacgtctatgaatggtaacaaatcatataattggattcgacatgtaaactactatgttaaactcacccatcatactttgagattactcagctggtagtacgaatatagtattgcccgtcatcctgtatgaangagagatgtgngcttcctttntgagtcttgtgttaggtgctgagancttttacatgggcttatacagggagagagtcttcaataaatgtagtcagcactattttctgcatccagtgtggttgcgtttctcacctgagagtaatcaagataaca

SEQ ID NO: 584679 - DNA, 325 bp, Homo sapiens
  misc_feature (172)..(172): n is a, c, g, or t
  misc_feature (183)..(183): n is a, c, g, or t
  misc_feature (193)..(193): n is a, c, g, or t
  misc_feature (218)..(218): n is a, c, g, or t
gtaatggagtcgtgtgtctctcataacagatgtatgctctctagtacttgcgtaataaatctatcttttgtattctatacaacgacgacatgtaaaacgcaccgatgagactgttggatgaacgacgcacgtggttggaagactatagtatagcagcaaatcctgtatgaangagagatgtgngcttcctttntgagtcttgtgttaggtgctgagancttttacatgggcttatacagggagagagtcttcaataaatgtagtcagcactattttctgcatccagtgtggttgcgtttctcacctgagagtaatcaagataaca

SEQ ID NO: 584680 - DNA, 710 bp, Homo sapiens
ctgcctagtcatttcaaagtcgctggtctcccggctttttgatacctcccttgggctgtccacgactgcccttgtagaattcctcccagggcgccataagtgttcttaattgagccccccctgggtctaatatctccgatgggactgaattctttcactaacgtaagcctcctgagttacgctgggtgcttcgataccgaactgagggctctgtatctctccgctcatcttcaaggtctcctgataagtttatcactcccctgtatgagcgccttatttaagaactattctctccgaactagtgttttaagactttactcgtacactccccccctcaggttctatcacctccttgtggagaaatacttatccttagtatgtggcatcaccccccttctctctctctggtgttctcacaagttccgcctttctctacataccgtcacaggcagcactcacgccacacaatagtcgccccccccgtagaatctgcctttacacagaggtttccgcgaccccctaggggggcactaccgcctccctccccattgccctcctcaggcatcactcctggtgacgccactattgaggccgccgcagcccactattgttaggcacccctacgcccgccgatgtatcggtcacgatgcctccgtaatcaacccggccatcctaatatcgcgggggcatcccgttctcacaatagcaga

SEQ ID NO: 584681 - DNA, 755 bp, Homo sapiens
tatcaaggttttaaatctcggagaaagggctttcgttgcttggtaatcggatgcttatatacctttctgataagcacaacattggctgtacttcatcttacagacaccgagataaaagttaaccctcctcaggattttgagatagtaggatcccggatacttaggttatctgcgtatttgcaatggcaacccgcgccactgtctctggatcagttttaaggaatgctagcagtggaatatgaacataaaataccgaaacatggtagtgaaactatggaagaccatctattactaagaatctagattacggaagatgggttggatcttaacaagggcatagaagcgaagatacacacgctttgaccatggccgaatgcacaagattggatcagcaaggttcaaagttcctgggcatggaacttatcttattggagtatctaccacaaggaattcctagaaactatggttcagggatatggactgcgtatattacaaatggcgatattgactctgtgcttgtgaaagctggcataggtgtacttcttgataccaattacaagcttgtatgacctggtatgagggcttggatcatgcattacagtgtgtggatgacgtcaaggctgattggacgaaatataggatgcagatttccctatttggaggcatcagactataaagatgtctatatttgtgtcaatgggttcagtcagagaaaaagcgtattagatcagttatttcaccttttcaggttaaaa

SEQ ID NO: 584682 - DNA, 465 bp, Homo sapiens
tggatggcttgatgaagaacagcgaaatctaatgcttcacagttcccgcactacagttccccagttccggaaagccttatcagcttgctcatgagagtgaaatccaatgcctagtattgaatgagatagcccaggaatatgaatctagaaagatacaaacatcctgtagaaaactgatagcaaatgctcaggcttcaagagaaaagggtccagagccgcactaacatcaaagaattttactgtgaaaacatggcttcttggccgctccacagccagtctatctgaggtgctggtgcgactttaaaacatattttggggctggacatggtggctcgcgcctgttatcctagcaccctgtggaggccaaggcaggtggattgcttgaggccaggaattcaagaagagcatgggcaacatggtgagacccagtctctacaaacaaagctcacacctgtgatcccagca

SEQ ID NO: 584683 - DNA, 765 bp, Homo sapiens
agcggggaggcaagtgggtggatcacctgaggccaggagttcgagaccagcctaaccaatatggtgaaacccatctctattaaaaatataaaaatggttgggcgcggtggctcacacctgtaatcccagcacttggggaggtcaaggtgggctgatcacgaggtcaggagatcgagaccatcctggctggcacggtgaaaccctgtctctactaaaaatacaaaaaattagctaggcctggtggcatgcacctgtggtcccagctactggggaggctgaggcaggagagtcgtttgaacccgggaggcggaggttgcagtgggctgagatggcgccactgtactccagcctgggtgacaagggcaagactccgtctcaaacaataacaacaacaacaacaacgacaacaacaaatatatatatatatatatataaattagctgggcatggtggcggcgcctgtatcccagctacttgggaagctgagataagagaattgcttaaacccgggaggcagaggttgcagtgagccgagatcacaccactgcactccagcctgggtgacagagtgagactctgtctccaaaagaaacaccaacttggccaaaataaatcgtcggtattttgaaaatgctgtgaattgacactaatacttcattttttgccagtcatgtgatcaccgtattatttaccagtgtagggggaaaacgcaaagaactgtttgtaggaaccctgctggtttgtactctcctcgtttctcactca

SEQ ID NO: 584684 - DNA, 800 bp, Homo sapiens
ctgatccgaggattaattgcgatggaataagacctccgaaaggaaagaaaggaacggctagaggcgtagaagggcaagattaagaaggaaagctccaagagggagctgcttatccgacactagcccatactaaacgagacccactagcacccgctagcctgcagccctaccagctagcttagtgaatacgcaaacaggcagtagcctaggaatagaggcctctatcacctagcaaaaacgctagtagagccagcagtacacaaccacagagaagagaagcatgaggcatagagatactagtaagacaccactagccaatctagagccaagaagtcagtagaaagatacaggctacacctagagacgtagcgtactcataagagacatagtagaaaaagccacagcttacaaagaaggtaacgggaacgtagcccaacggctcattcccgggtacccttcacaacgggccgtgcatgcaccgggataggaagccttgggcccttgaaacccgactaatcctgaaagacgagacaagtggaagacaaagcgaaccagaacaaaaatgaaggacatggcgaaaacctgtactcagcaaggccccagtgcccccaggacccaagccccttttggacagacaaacacacaaagcggcccttccttctcccgttccacggaacttcgaacattcgacgggaaaacttcagaatgaattccaattccaagccatcaaaggtacacttacatagcaacctgtcctacaatccctagaggccatgggacaggccaaaagtcccctcaca

SEQ ID NO: 584685 - DNA, 387 bp, Homo sapiens
tcctggcagacccttctcttccaccaaacgtgtgcacatccttgagagccgtgagcaacttgctcagcacacagctcaccttccaggccattcacaagcccagagtgaatcccgttacttcgctcagtgaaaactatacctgttctgactctgaagagagctctgaaaaagacaagcttgctattccaaagcgcctgagaaggagtttgcctcctggcttgttgagacgagtttcttccacttggaccaccaccacctcggccacaggtctacccaccttggagcctgcaccagtacggagagaccgcagcaccagcatcaaactgcaggaagcaccttcatccagtcctgattcttggaataatccagtgatgatgaccctcacca

SEQ ID NO: 584686 - DNA, 1118 bp, Homo sapiens
cattggcaacaagggagtggaacagtcacccgtaaggcatgggcaaatgaccagctgggaaccgacgctgccttgatagcatcgtggacttcgcaagtaccctatcgctacccaacatcagacgcacaacttgatcaaagcctcttgcaggctctgactcattccaaggaattgtttaacaactatctcgggcggggatatgggacactggtccccgtggtcgttgctcggacggcggccagcaccggggatggcgctctcaacacaacgcccgggctcgagtgggggtgggacccacccatgagaggcatccccaggatccaagcaccgctaaacacaccgggaaacggcgtgaaacagaacacggcaacggacaagtggcaaccaaaggagagagcgccattgtgttggccggcctgaacacgtcgcgttcctatttcccgctggagacgccggaatcaactagctggattggcgcggccattttcaaaaatggcttccaatgagaacaatctggttggctcgtgtgggtccaacagtgggaactgtgctcccggactccgcgggggccaacagcgggtttacggcccatggaggtttggcaaccaaggggcctacaacggacgacatgtgaaccgccctaatccgaaaaattcgggcgaaccatggcccaacgtccatggcgccattgtacacgacctatggggcgttcccaagggggttttgcaactctaaagttccgcgctcgcaaaaagcgagaatttactcactacgggggccccgaacacaagtagaatggctctggcccgggggcacctttacttaggacacacccccattggtacaaactcgaaggggaatttggggcgccacgcaaaccggggcccattctaacgccattagtgggccaagctgggcaacaagcgcgtcctacaggcccccaggaacgtgccttcggatgcactcggtgcgcacacacagacccgactctcgacggacaatcaccggcacccgggattggcccgatcgacgggttcacacacaacgaaggctcttgcgcggcacacagcacagtcagcggctccctcacgtcaaaaacaacgttccctcgtggaaaa

SEQ ID NO: 584687 - DNA, 305 bp, Homo sapiens
  misc_feature (72)..(72): n is a, c, g, or t
ccttttcttttcatagagcagtttggaaacacttctaattgtaaaatctgcaagtggatatttggacctctntgaggccttcgttggaaacgggatttcttcatacaacgctagacagaagaattctcagagtcttctttgtgatgtgtgctttcaactcaccgagataaagatttctcttcatagagcaatttggaaacactctttttgtagaatttgcaagggtacattgagagcgctttcaggcctatggtagaaaagggaatatctttccataaaaggtagacagaagcaatcgtcgacgc

SEQ ID NO: 584688 - DNA, 563 bp, Homo sapiens
ctgtaagaagactgagtcgtcttggcatacctatgtgccgccactaccccatctcaatgtcaccttgctttgcattcttggatagcttgtatatgtagtagattgatgaataatttaaagaaaaacacctaaaattcgaaaaatgattgtaggatcaaaaaaggcagatgcacttacttcatactcagatgtttaggagcagtatccttttaagattagttggattggctggatttgaacgcatacaaatatgcagcatgcaatatatgcttatatttccatttcaatttctgatatataatgcacttcttgggagcagtactgaatctttgatgtattcagtccatgtactcaagtgcaatataacaatgtaaccaaatctagcataattcaaagttgtcattaattaagtaagcctaatataaacaaatatatgtatcattaaggtaaacaggaaagagtgattaagtgaggttattacccctaaatggccattctgcattgtattcaggctggaatgaatattcttaccagttttgaacactttgcaatatcctaaggta

SEQ ID NO: 584689 - DNA, 512 bp, Homo sapiens
cgctgctattgttgcagtggtcgccgtccatgtggtgctggccctctttgtgtatgtggactggaatgaaggctcacgacagtggcgtgaaggcaaacaggattaaagtgaacatcacctttttatagcattaaattcattctttaaaatgataaatgctggagggggccatctgatttgaataaagttgaaagaacatgttaaagtcagtcttaaggagtcacgtttgagtatgtaaattttgatctttctaatatgttggcttggatatccaggcttacctggattaatttggattgtaaatgagaaattggcaaagctaaattagttaccaggaatacgtcattttaattagacacccctttgtaagaattttatcctcctttaacaaaacatgttttatttttttcctcacaattcgcccccccaaacccctcctctcttaaatgttaacgctgcgccccctatggggcctccatcctcattatgtctcgccccctctctccttaccg

SEQ ID NO: 584690 - DNA, 436 bp, Homo sapiens
gcaaaggaaagggggagatgttgagcatgtacatacagcgtggctacagctggctcccactattgtctccagtctcgatcagctgcgcatcactcaggatttcaatggtgcgcctggagattttagtggtgatacctaaagcctggaacaaggaggtcttctcgggcccgagaccagtgttctgggctggtacagtgacttcacatggggcaatggcaccagcacgggtcagcagctggcaccttattggccagcaacatgtccctgatctcagtgaggtcctccttggtgaacacaaagcccacattcccccggatatgatgcagcagtttctccagagctgggttgttttccaggtgccctcggatggccttgcgcatcatggtgttcttgcccatcagcaccacagccttcccgcgaagggacatgcggatct

SEQ ID NO: 584691 - DNA, 176 bp, Homo sapiens
cgcttatctttgggacggcggcggaactttggacgtatctggaaaagcagagtcagcctgcagacaggggactggtgtgggtgctcttcctgccccacccctgcaccaggcctgctctgccttgcttctccctggggtacggggaaaagtgctgggggcagggtgctcagtggtga

SEQ ID NO: 584692 - DNA, 217 bp, Homo sapiens
tgaggtgatcccaggtgatcggggtcttccgtaagccatgcttattcaatctccagtcgagccttttctccttaactcatagtcaagagagcttcatcccatcctctgataactatgcctactccgaccttaaaacttaaaggcttggcatttttcttacttcttttgcactatgtttgaactattcagtatcacaaaacagtccctatcttgatag

SEQ ID NO: 584693 - DNA, 97 bp, Homo sapiens
gcagcacaagagtcatccatggatacagttccaatcattataaccacttctaaaacaagatcatcttctgcagcacctggttttagtttatccttga

SEQ ID NO: 584694 - DNA, 234 bp, Homo sapiens
ctaacgaaggttggagctgctgaaggatagggctgctcagttacctgtagcccagaagatatcgtgaacaaggatgccaagagcacactgcgggttgctcatatggtctgttctgcaagcacacgcagaaaggcacacatgggacagtgacgccccattggagccccagaattgaccctcacgtgcctccaagagcccatgagcctgccctgtcaggcccatgctggaggggcc

SEQ ID NO: 584695 - DNA, 408 bp, Homo sapiens
ttagctcataatagtgtattttaatagtagaaaagacataaagggagtgtctgtgtttgagtttttaaactcactaaagcagctacatgactgctgttgatggtgctttttagtcataatagtcatgtatatgattttgttttaaatacaagagtgaagaaagaatgttgtggttttgtcaatactgtgcttatagatatcatattgtctcagataaagcagcaaacatgtctttcagcatactcccatgctaaaatatgaatgaggattgtgtgttatttaaagtctgtatgacctattatgatgatattaagatattttttgttggcataatagtctagccgtattatgaggatgcaggatttctgtttaaacatttggatcctccattaaaaatactaaatatca

SEQ ID NO: 584696 - DNA, 369 bp, Homo sapiens
aagactccccatggtatcgaatggctgagccccaagtcctgcctgaggacatgcaccgctgtgctcactttcaacggcatcaacatggtcccaccgaataccacgacgccaccattgaagaccatcatccgcttcctgcagggcccgctcctcccgggactcatctgcaggctctgacaccagtttggagggtagctgcacccatgggtccaagctaaccagtccccagttccccagacctgctgtgacttccatttccatcgtcctttctgaaggaacagctcctgaaaccagtctccctgggctgagacaacctgggctcttcttaggaagagagaattcaaaccacttccctcatttgggagtagg

SEQ ID NO: 584697 - DNA, 314 bp, Homo sapiens
  misc_feature (43)..(43): n is a, c, g, or t
tctgagatccttatgtatcgccacacagaaatcattgatgcantatcacattatggcagaacacactatatatcatctcactgatgcaaaaatatatttgacaaattcagcactctatcagaaaaactttagaaaactttaagaaaatttggctgggcgtggtggctcacacctgtaatccagcacttggagaggccaaggtgggtggatccattgaggtccagagtttgagatcagcctgacccaacatggtgaaaccccgtctctactgaacatacaaaaattagccaggtgtggtgttggggataacatca

SEQ ID NO: 584698 - DNA, 153 bp, Homo sapiens
ccagaactcctcagactgtggcatgccatagcctttgggaaaagtccacttgaccctctagaaactgcatatcagaagtatggacctgtactctagctttaccatggtaggcaagacatttacttaccttctggggagtgatgctgctgactg

SEQ ID NO: 584699 - DNA, 678 bp, Homo sapiens
  misc_feature (505)..(505): n is a, c, g, or t
  misc_feature (599)..(599): n is a, c, g, or t
agcagtgtctcacacctctaattccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgggaggtagagcttgcagtgagctgagatagcaccactgcactccagcctgggtgacagagcgaaactccgtctcaaaaaaaaattaacttggcgtggtggtgggcgcctgtaatcccagctactcaggaggctgaggcaggagaatcactagaagctgngaggcagaggttgcagcgagctgagattgtgccagtgcccttctgcgcaacacgagtgaaactctgtctcacaaacacattatataaattagtngtccttattatgttggttgaatggataaatttgttcaggacaccaatattcttggcttaatgcatggggttatcctttc

SEQ ID NO: 584700 - DNA, 166 bp, Homo sapiens
gcaactggtgatgttggcattgtcatgcaggccaaagatctcagtgcatatcatttgagtggtatgtgctcttgattgtaggagcagtgtagcctgtgtcaggtctgtagtgtaggctgtggatcttggtggtcgactgccctgatggcgctgtactctgtgctca

SEQ ID NO: 584701 - DNA, 150 bp, Homo sapiens
  misc_feature (1)..(2): n is a, c, g, or t
nncaggtggggtcagagaagagggatgggaactgaaagcactgggacttaggcaaagcaaccaagactggccaaacctggtggtgcaggctcagaggccgagcgtgtattttcccctttacaatgcggatgaatgggagaaccaagtctc

SEQ ID NO: 584702 - DNA, 289 bp, Homo sapiens
cctggaggtggaggttgcagtgagccaagatcttgccgttgtactccgagcctgggtgacagagcaggactctgtcgtcaaaaacaagacaaacaaacagaaacaaaggaaactcttatgaattgttgtagggctggaatttgtcatttaatagtgtcagactgtggttgatcacaggtagctgaaattggggaaagcggagctgtagataaggggcctacatactttcagctggatatgagctcatttgtatacagctgtcagcgtagttgatctctctgggcttctt

SEQ ID NO: 584703 - DNA, 425 bp, Homo sapiens
taaaatgacatacttaatcttggtttgtgttaattctgaaatttgaaatgggtgtatttcatagttattgatcaagatagcagcagcacctaaaggtgtttgtaaaacgacaggggtcccttttcatcccttttatgtgagtggtgcttttcctgaatcctatcccaagctcaaaatatgtaattattcttttaattttaatattttatttactgtaaagagtaaactccagttgctacagtattaatatgtagtcaaatctaagtagaggccttttcagtacgtcatatccaagctagcacaaaaaataatttagtacaggaataaggcaggagaatcccttgagcccggtaggtcgaggctgcagtgagctatgttggtgccactgcgcttgagcctgggtgacagagcaagaccctgtctca

SEQ ID NO: 584704 - DNA, 181 bp, Homo sapiens
agcagaggcccacagtgaactgggaatatggaaatggcccttccacacagacagtttgggaggtgcggccctaggcgagcaggaggaacctggccagtgaaggccacagccgcatcagcagggagacaggcctgtgtgcacaatgctgccattaggaggtggtttcgaagcccgggtaccg

SEQ ID NO: 584705 - DNA, 383 bp, Homo sapiens
  misc_feature (280)..(280): n is a, c, g, or t
acgtgaatacgccctcattggcctccgttagagctaagattacaggcatgagccaccgtgcccgtcctggggcaattgttataattatccaataaataaactattggtgacagtggttttccaatgtccttggcttttcagacaatttgtttttatattttgtgtttgcaaataatttgagcatgccatatttcattttatgctgtggttattgttgcacagaagggaagaaatgatgggcttgattttttaaagactgttcagatctggaggttttggngagattgtgttttcttattgttggcggcttaatttcctgcttgaaagggtgggtcccatatagcatatgaataaaaaggataatttcagtagaaaaactgctt

SEQ ID NO: 584706 - DNA, 318 bp, Homo sapiens
actggaaataggaagtctagaattatctgaatgaagcaggaaggtgtgtaatgtccctgtgaacaggaagtgctattttccatatgaacaggaagtgctaaattatccatatgacccagaaagtgtggcaatatccctatgaaccaggaagtgctacaattatctggatgaaccaggaagtgtggcaatgtccctatgaaccaggaagtgctattatccacacggaccaggaagtgtggcaatgtcactatgaaccagaaagtgtcacaatttccctatgaaccaggaagtgctacaattatccatctgacccatctt

SEQ ID NO: 584707 - DNA, 122 bp, Homo sapiens
tgcctacacggagtcggtgtgtcaagaagcactaagtttgggtcccaggcctgtgccttttgtcctttggcaagttgcttcacctctctcagcctgatggtctcctctatctgggatgatgg

SEQ ID NO: 584708 - DNA, 167 bp, Homo sapiens
tcccatagaagagggggtctcgttaaatggcccaggtgggtctcaaattccgggccctggcaatcctctcacctcagccttccaaagtgctcagattacagacatgagccactgtgcctagcttagctctttttttttttttttggaaaagggattttggcagtgtc

SEQ ID NO: 584709 - DNA, 209 bp, Homo sapiens
  misc_feature (14)..(14): n is a, c, g, or t
ccccttcccccttngggggtttttttttcccctgaaaaggggaaaaccccccttcccaaggagggttggggtttttgggcaaaggccccttggggttaagggcccaaaggggcctaactttggggcaaaaccattttttttgggggtgggggacccccccccgtttttgggtttgggggggaaccccccccaaaaaacccgttttttta

SEQ ID NO: 584710 - DNA, 456 bp, Homo sapiens
  misc_feature (36)..(36): n is a, c, g, or t
  misc_feature (70)..(70): n is a, c, g, or t
  misc_feature (122)..(122): n is a, c, g, or t
  misc_feature (182)..(182): n is a, c, g, or t
  misc_feature (220)..(220): n is a, c, g, or t
  misc_feature (224)..(224): n is a, c, g, or t
  misc_feature (243)..(243): n is a, c, g, or t
  misc_feature (253)..(253): n is a, c, g, or t
  misc_feature (259)..(259): n is a, c, g, or t
  misc_feature (268)..(268): n is a, c, g, or t
  misc_feature (334)..(334): n is a, c, g, or t
  misc_feature (356)..(356): n is a, c, g, or t
  misc_feature (372)..(372): n is a, c, g, or t
  misc_feature (389)..(389): n is a, c, g, or t
  misc_feature (414)..(414): n is a, c, g, or t
cagatagagtttttgcgctccggaggggcaatgatnttgatcttcatggtgctgggtgctagggccgtgntctccttctgcattgggtcggcaatgccagggtacatagtggtgccccctgntaggacattgttagcatagaggtccttcctgatgtgaatattacatttgatgatgttgtngttggtggttttatggttgttagttgatttcttcccgntganggatgggtgggacagggtntctgggcagnggaaangttcatttncgttggtgttgatttgcccattaggcaacttgtaagtgttctgaagggaggttggggatgcggcanttgccatctcattttcaaagtncagagctacataacanagtttctccttgatgtnccggacaatctcacgctcagcagtngttacgaaggaatagccacgctcagtgaggatcttcatgagg

SEQ ID NO: 584711 - DNA, 397 bp, Homo sapiens
caggagtgagagagggaggaacaagttttcttgaagatgttttaaagctggaacaagccttcttctgttggtgcttgaactcttgcctgggaataacttttttaacctttaaaaaccattcactttgatctcctctacctctttcctctctgtttgcctaactcccgcctgctggctccgctttcctctctccccttgttgttatttttagtctgtgcgtgtggacacttttggagagttggaagggatttttttctcctgacttgaacatagggtgactttttaatattgtattttagtgtggattatctctttggaccgcgccggacttggcctcaggaaagcaaccaaggctgcggaaggcggctggtgcagaacgctctgctctacagaaggg

SEQ ID NO: 584712 - DNA, 369 bp, Homo sapiens
cactggcaatggctatgagggcacatattagcaaagcagtcacattagacaggtaccagctgcgtttctggaatgaccaatgggcagtttcataaaaactcaggtgtcaggctttaatgcactaggctccagatcctctagcccttggtttgagcttaaactcttggaaaacatgtaagaagcacaatggttcattactggggtaggagtccagccaagacacctatcttaacagtactgctctaaaacctcatgagatcaccaatgatcataaccaagcccttcaggcctatgacaaccatccacccgattatccaggcccaggaactctgaaggattccaaggtaaagaaagggactgatacattct

SEQ ID NO: 584713 - DNA, 1421 bp, Homo sapiens
  misc_feature (1296)..(1296): n is a, c, g, or t
gggtcccgcgggtctgtctcttgcttcagcagttgtttggacggaacagatccggggactctactgtccagacctccgagctgcgcctctcgcatttgcctctgccgcttgtcagagctccgtggacccatcattcctcggcccatcatccttgtcgtgtctagcggtagccattgactcagtcagcccgatctaattgtaggttatgctctcttgtccttgccaaatcacaatgccatttgagctcctcagcattcagttcaatgaacttattactcgaccagactgttgaatggcagccgtcaacgagcgcatgagatcgagagtatatggttacgctttgcctaggctcgtccataaccaccatcacctcatctcttcgggcgttctgatttccgcacccgcagattgcatagttggcgtctgagaagtgcggtgcatgccactttcttcgcgcagatattaggcgcgagtgcagaagcgacgaagtggcataacaggagcctgtgcgtccttgaatatgagttgcgagagagagcgcaaggcgtaggactgggctccgctgcatcttcttgcccacggtatcatttcataggataggcccacgccattgataatgcagttgcacgtttgggggtgttaagaaaaccccactcgaaaggaaacaggctcattgaacaaaagccatgccctacttggggcctcttagtgcaggacacacataggccttgcacatcccaagggccaccccatattttctgggcatttcttttccaatcggccctccgttgtgcgatattcgtttgcactccgccaatcggggaacaccctccccaagtgcttccttcgttggagcatattgccttgtgcaagtagcattcccaacttttgctcttaagtaagtccgcagtgcgcacaccggttgggacataggcctctaagtacaagaagcataagggacattgggttgtttggaaccccccattcccttggggaagcccaaaagtccgttcccgcagacaatgggactttggggggttggggggcccggggaaagtgcccctagggagaggacttaggggcggacctcgacacgttaagatcccttccttttaccgggagagacagggccttgccactcttacgtggccaaagggccgaaccggacactcttgaggaatccacagaccctcttccgtaggaaggtctcccccaagggcgggaacattgtccttctgaaacagtgggggcgccctccccgtttcggtcaccaacaacggctgagatctcacaggnggagctgtggatctctgagccctttatatggccgcgttcgtttgccacccgtacaccacaggcgcacacacaattcaagaggcgccaaggtcatttaaccatataacactttaatgtcccttaaa

SEQ ID NO: 584714 - DNA, 696 bp, Homo sapiens
cgaccgttgactattctctacaaaccacaaagtacattgtgaacacttatacctattattcggcgcagtgagtctggagctcctaggcatcagacatctaacgcctccttattcgagccgagctgggccacaccaggcaatccttctaggttcacgaccacatctactaacggttatcgtcacatgcccactgacagtttgttaactacatcttcgttcaatagttaattacccactcagtagagtcgaggaggctgttgtgcatagctgacatagtttccccctaagataagtcgttgttgccgcccgaaatattggctgattccccgcgctattaacacaaaccataatgtcttcttgaccttgcttaaactcccttctctccttactcctgctcgcatctgctactaagtggaggagccggcgtcacgtgaacaaggtttgaaacagttctagccctacccttattcattgggaacctactccctagtcctggagcctccgatagacctaaccattcttcttccttaatacctagtcaggtgtctcctctatcttcaggggccatcaactttcattcacaaacgatttattcaatataaagatcccgctgacataacccacaattagcgaaacgccccctcttcgttctgatccgtcctaatcaacagcaggcctacttcatgctatctttcc

SEQ ID NO: 584715 - DNA, 739 bp, Homo sapiens
  misc_feature (700)..(700): n is a, c, g, or t
ggtgcaattaacagactttgagaactctgcctatgtggtgtttgtggtactgctcaccagagtgatcctttcctacaaattggattttctcattccactgtcaaaggttgatgagaacatgaaggtagtcacaggaaagagatgctgtcttgcagggaatgtgttatttcaggaaagatatttgcaaaggtggcaactgcgacgtgcgtggcatgcgttgtggcaaggcccagaacatgcactggagctcgctgctataggagtacaccctcatgatgcaatatactaccatcatcatatgggacaggaaggtgtgttgtcctggactgatcccaaattctgaactcttaccttgaaaacatggtaacgtggatgtggatcaccagatgtagtattctgaactacctaaatgctacattcacgaacgcacgagcatctggagaactaattgacagttgccagatggatgagggagtttatcgcaaaccatcctgactactagcaagacatgtgtcataactgatgaaactgacttatgtgccttatttcgaagtgttaaccaagatttgcaaatgaattatgtgaatgcccagagttacttggatcaggcatttaggaaagtaaaatatagtggaagtaaaaactgatcatccaactagacattctacagaacgaacaaatgccttattgacgaactggntacagtaacatggctctcagcccgtgtgtatactctgag

SEQ ID NO: 584716 - DNA, 135 bp, Homo sapiens
cttgcatgtaccggggcacaccacaggtcaggccctcagctgttcatgctctagtgagccactaatgacacagatctccccctgacagaccaagccatctgacatgcagggtccccgagtacattgcaaggggta

SEQ ID NO: 584717 - DNA, 787 bp, Homo sapiens
ccatggttaaagcgaagagcaactctaaattctcggagcctaaatttgagatccttaggccagtacaggatgtaggtcctgataattgaatttgcttacatgagaagcctttacagagtcctaaacattaaatcaaactgaatgtatgcatttacggaaatcacccttgactagtaaagaatttaacttgtataaactcgttgggtactcagagaaaggtagcacgatagtgacactatagctaggatacagaggaaattacagggtaatacgttttgtctattcatgtatgctctccaatcaatgaaaataaagtgaaaataaggacccttaaacaaagtggaaaagaccgttcattaccagttggtgtaaggaataccaaaaatttcctcccctcacgtaaaacgataaggcccttcatccatcacttctcatctaactccttcatccatcgatagggcaggcaagctggagggtggaataacaacccgaaaaaagcccagcgtacgacaaaaatcgtaagtacatacgtccgtcaaaattaaccacacaatatggaattgaattaataagccagataacataccggaaacaatccctaaaaaataacccatttccttaattcgatcttatccatttgtttgaaagggtaaaaccttgaatatgagcatgacattaaaacacaaaattaaacttacactgcggggcgaaaagatccaacttagcaaaaaggaaacctttaaactctccttattgcctggatacatcccgaagtaaaaaaagacaa

SEQ ID NO: 584718 - DNA, 148 bp, Homo sapiens
ggattgactctagagtgatcccccaatagtcaaacagtgccatatttctgaagtgctacgattggatgagtatttggatgttacaacacactttcttgaataccactgttagttggcctccaattgccattcgctattgggtcgtcca

SEQ ID NO: 584719 - DNA, 657 bp, Homo sapiens
  misc_feature (57)..(57): n is a, c, g, or t
  misc_feature (184)..(184): n is a, c, g, or t
gttgaatcattaactcacatgtaggatatgggtacgcctgcatgtgagtacaaatanaatcggttccatcaagctatggctcaggaaacgtcacgaataaaggcctgggctgaaattcaggttctagaaagcacagtaacacatacggtttcttctcatcatgtatagacaccattcttggtcntgatggggcttgtaagggccatcaatacgtggatagactgagtttcatacatctccagtagacatgatgtatgagacagcagcgtactggtcttactctcgagcatcatgcacatctcatcaggcgcatagcaaggggtggagggctgatctactgaatggcgtcgccggtcaccacgagctggttctataacccaattgctatctctgatcaccagcgatgtactaagcctgctggtttcatcagggcagcaatgaacgtctctatgaagtaacattgtctagagggagttcaccaatcatggcagatactaagtgtatgtagccggtccaaagattagcatttcgcctgcataatctcatgtagcatttcccggttctgttgcgcacatattatctatgaacccatttgcacgagtagtaaccgaactcagccactgtcagagtgagagaatgattgaacctgcatctagg

SEQ ID NO: 584720 - DNA, 926 bp, Homo sapiens
tgtgggccgtccaggcaggccacgtggctcgggaatcgcgcggatccgtacccgcctccatcgaggccccgtgctcttagggcctgctcgccagtggcatgacgggagtcagcctgaacacgagactcgcgcaaggctcaggggcggtggactcggtccctccctgggattccctccgaagggttcggaccaccagtcgtgctcgacagcctttcccctacccgggcatgtcagctactccaatccagtcccccgtctgtgtaactcgtactgaacgctataggtctcgagtcgtgtgtcaacacgacagcacctcgctagtgcagtgtgtccgttcaaaagtacgtcagcatggacgcagttggtctgaggccataacttcagagctttctcagagatctagatttacaatctcgcatgtttcacttaaccgggcgaaacatgccccgagccactgagtgctgtagcttcagtcactgaagagttagatcctgaacccagcggtcgtcaagcagactgctctcaactgccccagccgtctgggcacctgaggagtatctcccctcagttctacccatctcgtaaggcgtatgcagccgccttcgccccaacgtctgtcgcagactgaggagaaatggggggagttcatacggagaagcccccaatctcgccattatgggaatagggaaccttcgcatcagccgttaaacacgtgggaaatgcatgctgcccccagtgactcttggtttacgtctcgcacatacagaaccaggttggaggggaagaggtgggtctcagttagcaggggtccaccagggcaagtcagccgcctccctcatgcgtctctggtcagtgtgccttagggtaggcctctcactcccaccactctgggcccttgggatacctccggggaggagccagtagga

SEQ ID NO: 584721 - DNA, 616 bp, Homo sapiens
  misc_feature (28)..(28): n is a, c, g, or t
  misc_feature (322)..(322): n is a, c, g, or t
gccttccgaggagtttcccaaaaccctncgggccggctttgaccgcgctaagatggcgactcccatgcatcggctaatagcccggagacaagcattcgacacagagttgcagcctgtcaagacctttggatcctgattcagccatccatcgttattagagacagtgttgcccaggctggtctcaaactcctgagctcgggtgatcctgccttggcctctcaaagtgccaggattataggcgtgagccactgcgtccagcctcatacctgagctttagatgatattgtgaatgtcgtatttataacaataaaaaacaaactcnaaaaaaaaaaaaaaaatttgggggcggctgggccccgggaaaaaagttttcaaaaacacatcggtgggggcggcggggcgcccacagtagggtagggggaaccggggccaacaggcggcgcccagagggaaatgcgggcccaggaaccaggcggctgtgggtttccccacattaaaaaaagcgcgccggggacaccgggcgcgctctcgaaagcaatctcccgagggggtttcggagcgccataaggggttcctacacaccgggggtcccaggggagttcgaaaataaattagc

SEQ ID NO: 584722 - DNA, 997 bp, Homo sapiens
  misc_feature (28)..(28): n is a, c, g, or t
gccttccgaggagtttcccaaaaccctncgggccggctttgaccgcgctaagatggcgactcccatgcatcggctaatagcccggagacaagcattcgacacagagttgcagcctgtcaagacctttggatcctgattcagccatccatcgttattagtgaagcaagtaagcaagatgtaggatgtcgatgaaatgcttggattgtggatgttggacttatgattgcataggatagggagaatacgcatacgaataggccctctaagggatcgggcatgattcgtaaatgaaaggcttgaaaagaatgagaaaagggattattggttggaacatagagcgattggaggagaacatatgtatgaaaagagaggccatgtaaaaactgggtctaatgagtgtaccctacgcctccgagtatgcgtggagcagtgagagtccttgccagtgattgttcatcgaggagacgtgaagaatcattttaccttgcttctctcgctcagagtgagcgtgactctggtgaacgctccctgctaggttctcatcctcagtctccatctcagacctgttcctcctccttctggattcagattcagattccacgcgcttgcaggatcatgtagcgacagcttgtttgcagtctgtcgatgatcaccaaaagaataagatgtgagaattgagtggctgcattcaatattggactgatggtgctgtactctgtgatgttgagcttgaggggagtctgactatgttaaggcaagagtaaggtgagattttagaatcaagtcgtaatgttacatggagagcttgagaaatgggcaggtggagaggacttgtggggggactggttgttcttaacttatccgagttcgcgaagcacctgtgggaagtgttctcggaaaacaatgtaaggtagggggcaaaagggggggggggagagagggatcaccgaggagggaagtgtttcaaaaagtgtggtgtaggttcgcacaacatttt

SEQ ID NO: 584723 - DNA, 979 bp, Homo sapiens
gagccggtgtctccgactgcatccctgctgcagcaaccggactggagtcggatcccgaacgcacgcttgccatggactcagcactcagagatccgtataacggtcgagtgccgaggcagggcggctccctaccaagcagaactacgcggccgtgcttccaggcccgagggcatcggcgctggcctacggcagcctcctgcatcaatcgtgggttcgtctggccatcttctatctgggggccgctgtagcatcctggtactgctgcgccctggaggggagaaggctatcataggatgactgaaataatcaccaggccgggaattgcctgcccgcgttcctgcatcgatctggtcaagctgcacatctcgttggggctcgtattctcttattcgaaaaattattcgtccccaggagtacatctaatgctccgtgctgtgcatggtatttcttcgtgctgggaatcctgtgccctgtcccagacacatcatgcccttcatgaataagtttttaccatgccagctttccaaatcgagagtatcagctgttcttcacatagggttctggggaagaacgaggaagagatcatcaattatgaatttgacaccaaggacctggtgtgcctgggcctgaggcagcatcgttggcgtctggtacctgctgaggaagcactggattgccaacaacctttttggcctgggccttctcccttaatggagtagagctctgcacctcaacaatgtcagcactggctgaatctgctggggggaacttttactctacgatgtccttctgggtattggcaccatgtgattgtgacggggcaattcctccaggcccataaatggtgttcccagaccggggaaaaggtcgagaaacacttgccgctggctggatgcgctcaggactaagcggggggctgaaaagtaaaaaccccttacatggcattgcgggcacaagataaaacgcaagcaccaatgga

SEQ ID NO: 584724 - DNA, 541 bp, Homo sapiens
agcattaacgcccatcatgttttctatcgccccagggagaggaagcaggtgtagacagcagcaagagggagttgtgatgagggaattatctctgtagcgtagatgtgtgctcacgttctctgaggagttttgaaatcagtattgtttccgttgccctgaatggttacaaggagagaacactggacttggagtcagaaaactttcatccaagtcattccctgctctaagtcccatttctgttccatgagattgtttccacctcagatgagattagacttaaggtggcattggtattggctgtggtaaaacaagatatcttcgagggctcttcagtgacttacatccatacatcccttttatgggatagtggcttctgaaagcttccttggcagtggcagatagagcattgcacttatcttccctagtgttcaccaataagttgactttgatttattacacataacttcttactagccagtcaggttcacaaaatgatgtggagtgaatttctttttatgtaataaaaaacgttatataccca

SEQ ID NO: 584725 - DNA, 341 bp, Homo sapiens
  misc_feature (28)..(28): n is a, c, g, or t
gccttccgaggagtttcccaaaaccctncgggccggctttgaccgcgctaagatggcgactcccatgcatcggctaatagcccggagacaagcgtaagtaaggatccggttcgggtccactggagggctgggagcggggaaacgcgcgtcaacgggctggtgtcggacccctattgggaccggcggagaatgtccgtttctcaaacactcttctggctcccggggggctcgggcccgggcgataagtctggtgaccgggggttagcgatttcgcggaagacagccgcgtaaagtctgcggcacgggacagagcggggtttgaagacaactgtcgcgtttgg

SEQ ID NO: 584726 - DNA, 533 bp, Homo sapiens
agcggactccccattcttttttcttccagtgtgctaatctactttctgtttctttttttttctactttctgtttctatggattgcatagtctagacatttcatataaaaagaatcatatggattttgtgcctcctatctttaacttagcataatgtttacaaggctcatctacattatagcatgtgtcagtatttcattccttttgtggctgaataatattccgtgtgtgcatatatttatatacaccatatttgtttacccattgtcagctgatagacattgggtgtttctactttttttgactattaagaataattatgctatgaacattctgtgtacaagtttttatgtgcacatatgttttccatcatttctgtgacgaaggatcagagattgggtattcgggcagactgttcccgatcatctgcagctgaaagacattctcagaaaacaagatgagtatcatatggttcatctagtatgtacttctcggatcctcccagttctccaaaatccagcaccaatagagaca

SEQ ID NO: 584727 - DNA, 303 bp, Homo sapiens
atccccagctgcgggcgcggcgttcccggtgtgccatagaagatgccttggtgaaaggactcattgaggaagtaactttttagctcggctttgtatgatcaagagaagttcaccacaggaatcggcatgcagtgcggctatgttttctgcgagcactgagttatgtatggggtgcgagagatgttaaacggttagggtatggattcctggatgacagacgctggatgttgattaccctgctgggttttggtcctgtccttcatgcggtgggaacccccctcgcactcgggaacgccccccgca

SEQ ID NO: 584728 - DNA, 501 bp, Homo sapiens
  misc_feature (86)..(87): n is a, c, g, or t
  misc_feature (156)..(156): n is a, c, g, or t
  misc_feature (195)..(196): n is a, c, g, or t
  misc_feature (206)..(206): n is a, c, g, or t
  misc_feature (236)..(236): n is a, c, g, or t
  misc_feature (417)..(417): n is a, c, g, or t
  misc_feature (484)..(484): n is a, c, g, or t
ggaaaacaccctcagacacccacaataaggactgctccatcgcagccactggaaaaggccatctgcccgcttcccccaccagcggnngaagaagaggagggagatggatgatgggctggctgagggagggcgcagcgatccaacacatatgtgatnaagctgttcgaccggagcgtggacttggaccagttcagnnagaacacgcnactgtacccaatctgccgcgcctggatgcnaacagcccctctgtgcgcgacgtgaatgctctcccagctcacccctgcccccgctgcctgaggatgaggagggctcagaggtaaccaacagcaagagtcgttgatgtgtacaagcttgcccgccaacccacacccccgggggccaaccgaagaatgcctgcagattcccgcatcccatctncacttgcagccttgagatgcagggcaccctgacgatgagcctctgagcccgagcccttaaccttcanattcatttattgcaaca

SEQ ID NO: 584729 - DNA, 151 bp, Homo sapiens
cagacatcctggcccagggctttggctcccttggcctgatgagtccgtcctggtctgccctgatggaagacgattgaggctgaggcgctcatgggaccgtcacccgccactatcgggagcaccagaagggccggccaccagcaccaaccaa

SEQ ID NO: 584730 - DNA, 586 bp, Homo sapiens
gaaaaaagaaatatccacaatgatctgaaatgcctatctgtatgagactgtcctttgttcacattttttcaagcaaatatcacacaataaattgaatgcaggtacaaatgacatatcaaacatcaaagaaatttgcaaaagatgtaagactgtactaccttgggtttagaaattttcttatcataaaagcatttataacaatattttgtgagcttttaaggaatattttaagtatttctgatttaatttctagtgataaataccaatagatataacccacatacacaaaagctccttgggccctcaatatacttttaagagtgtaaaggaatcctgaccccaaaactttgagaactgctgccttcccctctaactttattccttccctagaatttcttccttggaagaaacattcctttgccattctatgttaacttacatagttccattgaggccagttttgctacctctctcccatctttccacatccctctcttgacacaaaacctgaccaaaggactctaccggcccgccccatttccagtgattagctgtcaggtgggctaagcaagaaaatctgggtttt

SEQ ID NO: 584731 - DNA, 284 bp, Homo sapiens
gagactggagtgtaccgtgatgatgggtgacgggatgttccaggtgatgggtgagatgtcgtgtgtagattggtgagatgctccatgtagagggtgatgggatgtaccgtgtgacaggtgacgggatgttccatgtgatgggttactgggatgtcccgtgtgacgggatgacgggatgctccgtgtgacaggtgatgggattgttccgtgtgacgggtgagatgttccatgtcagccgggtgacgggatgtaccgtgtgaagggtgcgatgttctgtgtcaccg

SEQ ID NO: 584732 - DNA, 493 bp, Homo sapiens
gttatgaaaatgcaaggtgaagaacatgaagtctgtgtctgtattcattttattccgaaggagctatcgtcttaggtgaaagttatgtaccaaccagattataatctctacccacatcctgcattttataggtctaagtttaactggtcaacatttaatatggattggagctattagtacatcaagtgtgatgggctttgttgcccaactgcttttacatgctgccctgaccccttcaacccttgtggcctttgcagcccttgctttgctgctgcttgccatattgctttgggtgttgtatgtggtttgctcagttgaatacatgagctgaatgagctcttatttttcttatgtttattaaccgcttaggtctatttggatgtaagggtgaaaattcatgtgatggaaatacttgtgtatatttaaagacccaattgctcctctggagcttgtacgttcaagaatgatacccctgtgtaataactgtactcgt

SEQ ID NO: 584733 - DNA, 1304 bp, Homo sapiens
  misc_feature (1103)..(1103): n is a, c, g, or t
agataatacgtgaaccaaagaaagacttagaccccaaaaaccctaatatccttggaaagataagatgatgcatccaatacaatcaagcatgctatgcaaacaagtccatgcatcaaaagagcaacagcaggcaacataagtcacatatcatatgtgcaatcaacacaaattccagataggcacaagtaggcaagaatcacacagtccaaggcaactcgtttcgagcaaccacagtcagcgaagcagcatgcagcatatgcaacaatcagcgcatcagcacacacatcaggcatcacagcaaaactccagcagtggatccacattagcatcgcagagccgtaagcatcaataatctcaaatcagcaacgttcgacagcagcagcaacaagcaaaaaaacaagacagacgtgtacataaacagacaatgacacaaatggtacccatgaaacggtcgacaagctagggaagtcatactatgccgcttgacaaggggacctggcatagacgacccttggacaacaagatgacagtgaaaggcttcaggtccaagaatgacccaagaacggataaacaaaaaggatggacaattcaacacaggggacaggcacattgaaaccaggaaggaggaacaaaagggactatcccaacaggtaggaaaaaaacccaaggggccaacaacaaggcaaacagggaagcaagggcaccatggggataacaagacgaacaccacaatggggcctttcaccataaatggggttggaaacaacgctggggcacgcgcacacaaaacagctcggggcaaacgaggcgaacacaagtacaaatatttagaccaatatatgcctttcgaatatggagaggacaaacacgggggagggcacatattcacaccattccttggcatcgaagacgcacaacccccgggggacaagatgggcaacagtaggagaatatgacaggaatcatcaccacaagggacacatccacaacatatgggacaaagagcacaccaacccagtgcaaagacaatatacacaccgcaagggaatccagaagaggacaaaaaatcagattatacgcacagggcagccagtacgggagangtagaccccaaaacgacacatgagcgatgggcgaggaaccattggacacaagagaacgaccaaacaagacacaagaccaaaatgggcacccaaaggacaatggacataacgtacaaggaaaacataaaacaacggatcggaagacaacaaggggagttatcaaaacagaacggatagtgcaccacaaggaaagcgatcccg

SEQ ID NO: 584734 - DNA, 638 bp, Homo sapiens
gtggtggtgcgcacctatcgtcctcaagagactgaggctgcagtgagctacaatcacgccactgcattccacatcaccctgggtgacagagcaacactccttctcttaaaaaaaaagggggggggaggggggagaacaattaaaagaaattaaggctgggtgcggtggctcacgcctgcaatcccagcagagaagaacaaaaacaacaatgaagccgaaatgaagataacctaaaagacatttacaaaattacctaaaaagaccaaatctaagaattatgggtatttaagaggaagtggagaaacagagaaagtggcaagcaataataacagaacacttttcacaacttgagacggcagatacaaatccaggtcacaggcacggtccgacataccaaacacgatgtgacccaaatcagactaccccaagggcatatatcactcagtcacggacgctctcgcaacacagggttcccacaaaacggacagacagagggatccctcacacaaggagagcccctggacgcaacaaggtacaaaaccatttagagcatttccaagttttgggggttcccacaacgagggacgtttctgcaacagggggacaattccattaccagggtacaagcaacggtggag

SEQ ID NO: 584735 - DNA, 980 bp, Homo sapiens
gcgatgccaacctgccgcgctgctagaatagtatgtctgcgaataatgtttgctgctcaagcgagcaccctcagttggacccctcctttgtgtggtcaacccacagtctgctccaccgggcgttttttttagcaagcgggccgccctaataagaactcttctcgtgtgtggagaaaccctttgcgaaaccttaccaggaaacacgcgcggctctctgtgacggccttaaacaggccggcgtccgtggtgccccctccccccggggggacccgtttcctgttttggccccccctgaataacaggccgggtcctggctcacagatgggaacacgcccccccccggaagaccgtggtgtcgcaaccgcccctcttggggcgaccaggccaccatttttgcagaatagggaaaaggcaccccaaatggtgtgggccgccccacaccccccctggagatggaccctgggggtaaatggccccccccgtctcgaagattgtgcagcaccacgggggggacaccaaaaggcagagggggaccacccatgtgccaggaccaccacgtgggtccgtagatagtagccaccatttgggcgcgctcggggcgaacgcacaacatgcacgtccgacatggggcgccaaacaaaatagtcttccccgccacgccaccgccggtgggaggaccacacaaccacagagaggggggtgaaaggggaaaaaaaacaaatgttgttcttgccagcaaccccgccaaaacaagttggcgtccacaaaaagagagagccccccctgtgtcaaatacacacgaggatacccacgtggccatgccacagaaaagggagacggacacggacaccgcagggagcccaccaccaggtagaaacccccactttggggacgacgaggagcgggcagggacatcctgcaggccaccgcggtttgagacccccggggcgaaaaacaaaagcggtgataccacaaacata

SEQ ID NO: 584736 - DNA, 310 bp, Homo sapiens
agagacttacgtgacctgataagaacccgtgagaaacatgtgcttccaggcttgattcgatttcgcttttatatttttttgtggacgacagaactctcaccttgggttcaccaggactgggagtgaacaggggtgacaaatactcaccatcactggtcaacgctccgtccatccggggtttacaagcaatgtactcgcgtgcctcagcccatcccaacgtagctggagactactaggccactgaccaacacacgccgcggcataaataaggacgtagtaacaacgtaagaagaatgggagaaaaaccaag

SEQ ID NO: 584737 - DNA, 314 bp, Homo sapiens
gtcaataggggctgcttcctattaaactgcagcttatctctattagcacttccaaagtagggtccaaagaattcactgggagccatgtacttagccttcagatgagtaacttttttttttttttttttattttataataagaaacagggtctcactaaattggcccaggcgggcctcgaactctggggctcaagtgacccttcaacctcggcctctcaaaatgtagggaattacaggcatgagccacggaaccgggcccaagatgagtaatgtatatgtacctcccaggctagaaaagattggtaaatcccata

SEQ ID NO: 584738 - DNA, 122 bp, Homo sapiens
  misc_feature (44)..(44): n is a, c, g, or t
ctgctgatcgcttagcatgaagactgcattgctgtccaccaacntactatgtttactatgacacggacatggacaggcgatgagcgctacgttccatgcccaggaagaggctgcggaacaca

SEQ ID NO: 584739 - DNA, 530 bp, Homo sapiens
  misc_feature (408)..(408): n is a, c, g, or t
ccccatgtcacagttattaaaataatagttctctgttttttattatgtactaagctgcttaaaagtaggaaggtaggaagtaaggccaggcatggtggctcacccctgtaatcccagcattttgggaggctaagacaggaggattgcttgaggccaagagttcgagaccagttggggcaacatagtgagaccttgtctctacgaaaaattttaaaaatttacccaggtgtggtagtgtacaccaacggtctccagctatgcaggagactgaggtgggaagattgcttgagctgagaggttgaggccgtagtaacctgtgatcgcaccactgtgttctagcctgggtgacagagcaaagccccacctcaaaaaaaaaaaaaaaaatgggaaaggaatattgggagattnagagtaggtataccagaatcatcaaagatagaggtaacatttttataactggaaaaatacctaaatattttctcaggaggacctattaaatctattatccagctctacattacaaaagtaaa

SEQ ID NO: 584740 - DNA, 839 bp, Homo sapiens
gcctgcgctttgcactattgtgggcaaaaatgtcttaacgcagtgggtgaacctgccatcccaccctgaccctcagcctgccacagtcccctacacacacacacacacacacacacacacacacacactacatggactatgcacacacgggactgtggcgaaggcaagtgctagtgcgtgccctgtcagggcacgtgtcctttccccatatctgtacagggtgtcccaacgagggtgtgtgacgggccgtggacagacgcaccctgtctgatcactcggtgtgctagtgttgctcgtgctccacgatgcgtgcacccaacagtaggaacacagccaccacacgcaaacgagacgacgcgatgaacaacacacccacgctgtacagcaatgacaccgcagaccgactgtgatctgctgtgacagccgcaccagacggcgcacgacagcgggcacttcatcgtttgagaacacagctggcacctcaaatgaacgttccctggctccttcctaacattcccccacacagcgcaagcacgtaacgtaccgttggagcgaaccccaactacacacgcccgaacgtcagtgtgatcgaacaggagcgaaggcgagagacgcgaggtagtcagtgggtagcggccacaccgagccgaagcgtcgtacgccccacccagcgaagcaccaagcaatagcgcgcgagactcccacaggcacgccgccgcacctctcgagcccgcaacgacgtcgcgagacacacacaaccacacgcgccagggccggtcaccgtacactgcaagaaaacagacggccagcgagtgcagcagcacggacaggtctcacgg

SEQ ID NO: 584741 - DNA, 317 bp, Homo sapiens
gtgttcagctggttgacagtgtcagatctgtgttattttactgttttcatcagatcattctatcaattggtaagaagggggtgagatgatctccctttaatccttttgagtgttgcttcatgccttttaaagttctattattaggcatatacacatttatgattattatgccttctgataaattcacccttttaacactacaaatagtgcctttaaaaaaatctctgcgaatagcaagtgaaaacctgacaacaagctcttggtgactctggacctgggcagtcctcagccttctgttcagctgcaaacacacaatg

SEQ ID NO: 584742 - DNA, 270 bp, Homo sapiens
attttttttcccaagaatccccaactcaataaaaccgtgaaacaattgctggggatgggtagagaaaacccatttatagtacttttctgccttcttgtggttttcggctttgcgatcagggactgaagatagaaggaaaaaaaaaaaaaaaaaacaaacacaaaaacatttcaaaagagaaaggaaaaaactttttccaaccaaaactcctaaaaaacccaaaaacagaacaaccaattaaacccgacccgacacaactaccaatgactg

SEQ ID NO: 584743 - DNA, 221 bp, Homo sapiens
tctagaggatcgtctatacaccatggctgttttatttaacaatgcctgttggcttggtatgcattaatgttgggatgtaaagatggtgtgtctatccaacagggagccacagtatttaaattggaccaacctaatgttacaacttacttggacggtggccaaactgtaaacttaaaagccttaacttaaacgtggtatacgggtggtatacgggtggtatc

SEQ ID NO: 584744 - DNA, 287 bp, Homo sapiens
gactcaggaggctgaggcagatgaattgcttgaatccatcaggcagaggtcgcaatgagccaagattgtgccacggcactccagcgtgagcagcagagtgagactctctctcaaaaaaaacaaaacttggctgttaatgtctgccctctgaattcacacacactatattagaccagaccaccatgtgtcattgtgtgtgtgtgtgtgtgtgtgtgtgtttgcctgcgcatgtgtaaaggagagagctgggtccctgagataatggtttccaaacattcaacccgtca

SEQ ID NO: 584745 - DNA, 244 bp, Homo sapiens
gtcttctatgaatagtactaccattttcaccctcttagatgctagctgtcatctctgtctctttcagattttttgttttttatatttgttttgaaaatgggattggattatacacattactccgtagcttacttttttttgtcttaaggacagtacagttaaatctaactcattttttaatagctaggtacattgtggtgtatttttttctatattcttcagctattcctgtcaatagagatca

SEQ ID NO: 584746 - DNA, 110 bp, Homo sapiens
atatcggctgaacatatcattcctacctctcaggagttgctgtgttgactaaatgaagtcatgcttgtgtatcacgctattgcaaaattacataccccaacacaatctat

SEQ ID NO: 584747 - DNA, 668 bp, Homo sapiens
gaagagagagtggggacgtccggcttcggagcgggagtgtacgtggtgccagcgactaacataagagagatggaaactatgggtgatcgtggcgagaaggcgagaagattgtctgattatagaagtggttcccagttgccacacccgttgaaatgggaggcaagcactgagactggagcctacacatgctccactggtgctcttgtgtggcaggaagacaggtcaggcccctggatactcttaacactatgcgccatattgagatacaataggcatcttcttggggagacgtagacacttgattggagtatttgggtacgagatcccatgtaaagtacgtctctgggaataatatatggatctgttgtcggggattgaagaagaaggaaggacatgggcagagttgacttaggctgtatctacaggaaaagctactaatgagtaatatatgggtcagtggttatttatgatcgaaactagtaaacggtctcatgactttctgatgtgtaccatcctttaatagatgctgcagtaacagaattcagatcatgagatgactgacagagatatttgtggggcgagacctgatttaaaagcataagatggcttgtggtctgatgagtatgttgagtgaagaatttcaatagtaactcacatttccagtaagg

SEQ ID NO: 584748 - DNA, 125 bp, Homo sapiens
cctaacttcaggttcctccgtctggaaatgtatactgtatatattatatacactcacacttctctatcctatgctcagacatgtgggataatgcgatgacacataatgaagaacgtcattaacca

SEQ ID NO: 584749 - DNA, 141 bp, Homo sapiens
cttcaagaccatcccagttcctgaaaaagatgccgcagtaccagaaggagctgaataagtattcaacgcacctgcatctagcagatgattgtatgaagcacttccaagggctcggtggagaagcttgtgtagtgtggagca

SEQ ID NO: 584750 - DNA, 301 bp, Homo sapiens
ttttttttttttggggcgggccccttcccttaagctaaaggttttcaagggtcctttatgtgggtccccggacccgccccttatttttttggggggcccgccaaagggaaaaccccccatttgtttttttttcccttaataagggggcttggggttttttttccttttttgggttttttaaaaaaagccccggggaccctttgggggcaagttttttggtttccttttcccgggggtaaaccccaaaaagggaatttttggggggaccccaaatttttggtgccaaagggaaaaggcttta

SEQ ID NO: 584751 - DNA, 536 bp, Homo sapiens
agatatagataataaacttatgaacagcaactataaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttggggacccttttggccccgactctttataactctgcctatttttttcttggggcccaattttgggcccacttggccaaatccccctttggggggggaatttacatttaatgggccccgttttaacacgcactgtcttgggaaaacccgggggttccccaatttaacagctttggaaaaaatccccttttcccccagtgggataatactcaaagggcccccccgaaatcccttttcaaaaaatcgaccatcctttaggcataagggaaattatgccgtttaatattttggcaaaaatcccggtaaaattttgtaaaatcaaggtttttttaaaccaatggcgccgaaatggcaaaactccttt

SEQ ID NO: 584752 - DNA, 448 bp, Homo sapiens
agagcaaagggatgaaaatgtaaaaagttggtgaaggtggaaaacaggtatgggagacctttgtgcacctttagaaattatatcaacataaaaattacaagaaagtctttcttgatcccccactcaagccccacctgcttagggaatccttgtctgagtccgcactatgtagactgctatcatttcattccccacactgcattaaaagagcctgttccagagccaatcattccagtggtagctagcacacccaacacctgagtgggtcagctttttaaaatcatcctccttctctataaaataaaaatatttttagtaataatcataacatgaaacaaataacaataaacatcatgaaaaaaatacgctggtaattctctgttgttgaatttcacatatgaagccctgccagttaaaatagataaattaataatagataccatagcgc

SEQ ID NO: 584753 - DNA, 170 bp, Homo sapiens
tggacgtctggcatacctgcgacttctggcatactggaccttctggcatacctggaccttctggcatacctggaccttctggcatacctggaccttctggcatacctggaccttctgcataatgaattaactagaaataactttgcaaggagagagaaggtccaggtatg

SEQ ID NO: 584754 - DNA, 197 bp, Homo sapiens
atcgaaccgagcttatccacctcgatgttggatcaggacatcccgacgtgcagccgctatgtacaggttcgtcttgttccaccggatttaaggtcctacgtgatctgagtacagaccggagtattccaggtcggtttctatctacttcaaattcctccctgtacgagaggaccagagaaatatggcctacttcacga

SEQ ID NO: 584755 - DNA, 825 bp, Homo sapiens
gaatttttgaattttcctagcatcgccctgtgctcatcaggtaatctgctaaggaggaaaaaagaaaagaaaaaaggaaaaaaaaaaaaaaaaagcaaaacaaaaacaaaaacaaaaaccctaccagaaaaccagaaagtagagagatttaccatataacttatggactttgaaatgtctgtcctttgtaaggcaagcagggaaggcctgggtgcgaaagcatgtgggctttggccctttcacggctccttggcagggcaggtgaggcttggcctttggaaaggcgtgcccttggagaaggctctgggcgtgaaacactttgacctttgaagaaacaccaatccacaaaagcggcgttggggctcaggcgctagcgcttaggaggtgaaagcatcaacattggaaccattcttcagggaacgccgcattcggcctctttccggaaggctcctcactttccagggacgcctgtcctttgcaaagatgcaatccatcgtctcctgggcttttctcatggctcatttaaattctctggtaagaaaccccatttggtcatatagctccaacgtgtaacatttggcggtcagggcagaacagaataataatggggaaatctcgggagttcgacacctatagtggacgttcagcgtcctctgaaatggtgctacatcagcgaacaagtcggcgcttgaatgggatttggaggttattttaacccatggaattatttttatagaaggggacaaatgtttgtgaaagtctctaataggggtatactctcctaaagtggtgtctcttggggaatgggattggatttattattga

SEQ ID NO: 584756 - DNA, 1869 bp, Homo sapiens
gcgccgcttgcgccgcatggcgtccgaatcggaaagcggggctgctgctgacacccccctactggcagaccctaagcttcccatggtgcatgcaagagcattcatcgcaggctggtcagaaacttgatccccggttcacgccggaaccctagcagcatgaccttggccacaggcagatgcgcacagcatagtagtgcaccttagcacggcacagcaacgcaggcaggcaagccagggcacaccgcccagcaggggctcggcgttcctcagaacccctacggcacgggcggtagggtcaggccacgccatggcagcggccccagcgaacgaacaataacgcgaaagaggtccaccccttactatggccacagtttggcgcaacagatcaaggacaactcgtgggatggtaccaacaggagtgattgaatgccaccatggtgaaacagccccgaagagagacacacacacactcaagcgcactattggggcacaagcgtgtgaccccaggagatgatgcgcttgcacacacgcaatttgcacaccgacaacacggccgcctatatacggctatcactgctggtcccgtggcacataccccatgacacggccacactgcagcggcagacaagacccattttggcagttccctatactcatgcgcacgcgcgtcgtgattggcccaacggaggacaccacaacttatatcaaccagtgcaagccgtaccattgggactgcgcaaccactctgtagtcttggccccatatgcgcgacatatgacaacttcacagcattgagcacccaaacagtatggacacaacatatacacacaacacaccagttacctgctatataaccgccatatggaggggacccacccagaaccaaaacgcgcggagcagcgcaacacaccaaccagttgggaaacgaaaattgggaggacaccagcatcaccagttactggcgatacaacaacagacggatggggccatgagcggtaccacaacggacgacattgagcggaacaccacaacgctatcacacacggcggcaacacggccgcaacggggaatcacccttgagggtcatcaccaccgcatcatcacagcggacacacacgcacacggggacgagaaagagaagccgcgcagtgggcggacacacgcacgttggcagacaaccattcgacgcgacaacgcatgtgacggcaccaaacgtcaccacacactcgaccgaagcgagacaccacacccgcagcatgcgtacgccaccaactcgagaagtcagggcgagcagcgggcagcaagcaacccgacctagcactagcgcaagacacagacagaggcaaaaacgagacgaaccacacgagcggacggaacactaggcaatgcgaagagcaacaaaggcgcctcccacccggacaacataggggcacagctgaaaacgccagtggcacgacaacgcgaacaacacagtatcgcacacaagcgcggagtaacaccgcgccgacacaaccacgagggccgacccaaacgaaccgagcacacaccaagcatgcatggcgagagacacccgacagagacgatacacaagtcaccacaccagtgggacagacgtggaccgaacaccagcaaagcgacgagaccgtgtcaggagagccaacgagggacaccaatctgcaaacacgaacactaggggacgagcacaccagaccacacacaccgaagcgcaacctaaacagcgaggcatacagcccgtgagacaacggccagccagaggagcaacacgacgcaacccagcacagcccacacgacacaggcaaacaacagccgaacaaccaagcaggggcataccaagtggaagcaggagaa

SEQ ID NO: 584757 - DNA, 338 bp, Homo sapiens
tggggggttaaaaagccccccccccaaaaaagggaaaccggttgtttttaacataagggcataaggttctttcagcccaggattttttccggaaggttttccccctttaaaaaattaggaaggaaggcccttccaaatttaaaaaaagcccaaaacaggcctttttttttgggatttaactctttttaccctcccaattgggatttggggttccaacaaaaggttgggtttgggggaagaccccccctttcccgttttaaaacaagtttgtttggtgctggggtttttaaacaagggccgggcccccggtaagcccccaaaaattttttgtgaaatga

SEQ ID NO: 584758 - DNA, 167 bp, Homo sapiens
caccatggtgtgggatgtatctgttgtctctagctactgtggcaaggagaggctggaggatcagatcagtccaggaggttgtggtacagtgagttatgacatgcccattcactacagcctggatgacaagcaagaccctccctccaaagaaaataaagctcaattaa

SEQ ID NO: 584759 - DNA, 104 bp, Homo sapiens
aattcatgcatatttcagacttagcatagtgaaacttccaacaagacctgtttttaggttccttgcttggttggtaagtactaagcgttgagagggttaccgag

SEQ ID NO: 584760 - DNA, 1449 bp, Homo sapiens
ttttttgttttagttggtttggggatcccgacctggggttaatacacaaacacaatttcttccatctctacacataacaatagtacaaaccacaagggtgcatcttaaaatggcgtacaaagggtgttaaaacctcaaaagagaagaaatttatataggtacgtggagcgtggtgacaagtggagaagcgcaaaaaagagaaaaaaacataaaagcgcaatggtgccttgggtgtgccgagagagatacaccttgggagaagagacaccacaccattgagagacggcggagggggaccacactctagtggggctgtgcggtgtgagagtgagactctccgcgagaaagacgcgtgggggtctctctcccactctcaactctcgcgccaaaatatctcagagaatgtgacacagagtggcgtggagagtgtgagcgaggcgtgtgtgtgcgcgcatccgcaggtgaggcccaacggggccacccgagccacagagcaacacacacagaggagacgccgaggcagacactacaccataggggtgtgcggaacaagagagatcctctgatggggcagagggtgtggtgggcaccctcttggaggaagacaaccccagagaacagagaagggccctcacgaagagagagggccccgagggggccctaaaaaacggagggggtttttcgggggcccaaggctggggcgcgcacttaacaaaaaagctggccctttggtgtgggggagcacaagaggctctatccacaactaattatatatgcaaccaaaaaagaggggggacagaccactgtggggcgcccccaaagacaaaaaacaagcgccataagggggcgccacacgggggcccgtggggggcccaaaacaaaattcccccagagggtacccactcccggggggagcaaaagcgggtggaccacacacgtgtggtggtggctcacccccgaagggggaataaacagccccaaggggggtcttccaaaaaccgctaacacgcgcgcacagaagagagcccccccacacaactgttttatactccccccggtgaggggggggggacccctctgttgcccccacacttaggagaagagctctgggggcagactctcagtgatgaaggaaacaacccccgggggacacaccgcgccggaaagtcagaagcgcgttgatcaaccataaaggccgccaagatagaacaccagcagcggggggagaggggggagaacactcgttgtgtgcaaagccaaagggggcccaaccacgcaacaggagggacaatatccccaaaaagacccgccaaacaggcgagggacgcgacgattttgttgtgtgggcacaaaaccgcggtggggaggccgccccgcggggtcaattgtggggcacccaacaagacaaaatgagacgatatgaggacagtaggagacccgatgaggaca

SEQ ID NO: 584761 - DNA, 1278 bp, Homo sapiens
cgacagcaccgcacctgccagagctgatcctccctaggccctgcctaaacttgagttggcccccaaatccctctggctgcagaagtcccttacccctcaatgagaggaggggcagtgaccagatcttttgagagctgagggttagagggcagttgagccaagcacacgagattgtgtcgcctctgtcccctgaagacgacctgcaccctccatgcggatgccagagactaggggaatggaactgatggaagattataacttacgtcttcaaggtggtgctgatcgagtcgaatcaggtgtggggcacacgacctactctatctctccacggattcagcgcgacaactgagttcaagtccacgacacgcgcgccatccaccgatcggggcttgagttctccacacccgcactgtagatgttgtggcaccgactgcctgtcaaaggctcagaatctgtgtgacatcatgcttggccctgcgaccgcgctaccgcagctcactcagcactcaggcgatacttacatcgatggctgcacgtgagcgtggcctctcctgtgtgctcgtcgacccgtagacccaatgcacgcagaaccgtactgctgtcggtgcgacacgaatgcgcctgaccgcgacgctcctattgcaccactgcgttgcaacgtcgcgacgactacgatcggctcatcgcatcctgcgcgttacacccaccacacgtgaccctccacggcacacgcgggccccgggcaagatgccacacttgcctgcgaagcgccacgacatagcttaccgccgttgcacatctaccaacctaggcggcacgcttgtgactccttctccctggcgccaccagccctctacgtccctcctggggaacattcgtaaccccaactctgctcttcacgcctatcgacgccttctggaagcacgtggtaccgctggcaagaagacacattcctctcggcctacacgctcgttggctcccaaccgcgcctcatcactgaaccgatgcacacctcaatgcacgtacccgtggtccagccacatactcgccccatctcacccctttacactcgggtcgcgaccagtctatgacccccactacgtgactcttggggagacaacatcacgccagacgcactagcaagcatccccttgggcgtcgagaactaaccactactgcgcactcattgcttagcgctattcctagctaccgctccatcgaaactctcttggtcgtgccacgccgtaacaacaccttacgccacctagacacacttgg

SEQ ID NO: 584762 - DNA, 266 bp, Homo sapiens
ggtcgtcgtaacaaggtagtgactgggaaaagagctatgtcggggaatatgatatgacaggctggggataggactaggagttaggtattgtaatgtaaaggaggggaggtaatactggcggataggaatgggcctaggatgcatatggagggcgactggagctggggccatcgatacgcgtacgtcgggaccgcggacatgtacagagctcgccaaggactagcggccacgtgggccgcgcacctgaagcgctggcacaggccgac

SEQ ID NO: 584763 - DNA, 909 bp, Homo sapiens
tagatttatacatgattgctcctgcatgaatagactgtgactttttctttttacttctcccttccttcttgattacccatagtatagataagcatgcatactttaacttctactagtatttcctcctttagcatgggtcgtcgttcacgctttaacgactgcgtttacttcgtcccttggcctttgaactcatagagtaagcttagtgcaaaggcttcaggtagtttaaaatgggcctcttagctttcttcgtagagtcattaaaacgtttttctatttaggtttcttatagccaatagtggggctgagttgtcgcacctgtgattttttcaaccttatttggattagtcagaaatgactaactgctttgtcttcatttcataaacagcaaactctgcatttagagtcacctatttagaacggtcgttacatgatgacagattctagctggttctctattgtcactcgttggtacagctgtttggttccacttgcaacatttgtacatataccttaatgttgtcaagtgccttaatcgttaaaatctctgcgttcaaagtttcttgggcgcaagggtcggtttacctcacattttttgtctccattatctaaatatcctagggtacctcacactcagtgtctctcattgctgccatggctgtcaggttccagtcgacgtgcgtaggattacttcgaacattgcgctgattcctactttcccatgtgggcaccattcaggttccgatgtcagttgtcattacctggtttgatttcctgcccacttcttgttacctttttgccccttttgtgcgccctttgttgaggtttccggtttgggccgctcacgccagtcttcaccgtcggttggcgcaacagggtgccgccccttttttccctcgggggtcgccc

SEQ ID NO: 584764 - DNA, 2115 bp, Homo sapiens
  misc_feature (37)..(37): n is a, c, g, or t
  misc_feature (1329)..(1329): n is a, c, g, or t
  misc_feature (1655)..(1655): n is a, c, g, or t
  misc_feature (1827)..(1827): n is a, c, g, or t
gccagaacgcaggtgtcgtgaaaagtagcctcgtaanaagccaaatagtgggagaggaatcatgactcatatcaacatggtcgtcagttggacagcggtaggattcgggcaacgttccagcacactacatggccattctgagtctattaaatatgcgtgtgtgcatcgtagcaaaaggaactcatatgaataatatcagaggaagggagggctgcatgaagaatggtgaagaggtgctcgcattctagagataatgtcacttgggatcctgtaggtacttagaaaactcgtagacacgtctcgtaagacgttcgtagaaagtttgcgttcattccaacgcaactttagactaactacttcccatgtgttcgcggacacattgtgttggaagaacacgaagtcacaggtgacattagtagtggcaacgttataccagtttaagcaacttggccacacgaaggggagcgaactacgtatggagctctatcaatccatagacaaagcaagtgggaatttcaaaccaattgcggggaacgacttactgtctcatgtgccgtgggcaccattggtgggccttctgctcccccgtacgcattttgggttctgggcatggacgtggggtcgtttttggctggcaaattaagttaggagaaggtcctagggtttaaatgcggtacgccacaccgcaaaataggcgagtccaaggtagccgcaccgcaagggaaggtcccaattaggcaccaccatttaccttggagaacgtccttaaaccacctaaactgggggcagatcggtcggaagatatccaaaaagctacaacatttgcgtcccagggttgtctctaaagccaagaaacatcgtgtgagtcttcacaaacatgggaaaggtctcaaacacctcatgatacaatggtccccatcagacacgagcagtgaagataagtcggacgggggacataccattcgtgtctatcataaccagggcggacaccagttgccaccagacgatgtcgttttacgctaatattacacccgaaaagacatttgtgggggcgtaacaaattgccctccgcgaataccatcagcagatacagccgaatttatttggggtctggctccaaacaacttaattcgttagcggctcaaagggacagcttaggagcttgaaagacaacaaacgaattgaggcactcggtgacaacgcgcgcaaaaaaggtagggatgcattaaacggattagagcgcctatcggagttctcgtacacacacggggtgcggcactttggtcgggcccaccacgagcttcaacgcacacccgagtgtatacaggntgaatatggccgtgcaccatggggcccagagagctcggggtgcaacaccacaatatggcgtagcggatctattaggaagctgtggccggcctatctgggtcgcacacttctaggatatcttgccggctacaacagcggcagccgaacagaactgtctgcgctgtcggcgaccaactgtaagtgaatcgcgctacgtgtacacattctatggtcgcggcgacactggtcgaccccatacctaacccacaggcgacagtgcgctacatacacaacacacacacacatgcgggcgctggcgacacaaacagcgagccacccaggtgagnccccaagcgtgatagagcgccagcagcaagtgagctggacaccagggcggcgttgacactagcagacagcacccacggaagcagctaggcggagctccacgcaacactgcagcgacacacaactacacaagtacgtctactagcggacgacgcagcacacaacccgccggcngacacaacgagtccactcgaacaacacagcagaggaagcagcactacaggcagagacaccacggcgcacgccgcgcaccaacaacgactcgcgaagccaaacaccaaccacgacgcacaccgcacgccagcacaaccaaaccgcccgatgaaagacagcagccactccacaagcacagccaccagcaacagaccacagcagagaacagcaacacagaccagcgcacgcacacaaacaacacccagcgactgcgctgatccacctacagcaacacaccaccataacgaa

SEQ ID NO: 584765 - DNA, 87 bp, Homo sapiens
ggatttgctggtgcagtacaactaggcttaataggggcatgccactgtactccagctcgggcaagagtgcgagactctgtctcaaaa

SEQ ID NO: 584766 - DNA, 629 bp, Homo sapiens
  misc_feature (285)..(285): n is a, c, g, or t
ccgctgaatcattttgttggtttccctcggtctccccggaatcaaacgtttgtccattctgagaacttagtgtatgttatggtactattgcggtccgttgtattctttccgcgccttcaaacaccacaggcggtcgagagccacactgttcctaggcgcccacgcagactttctttgtctccaccacgggttgctcgctaacaaaacagctctgatgtaggtggttcttctgcattcgtgtgcgccacgcgagagggttttaagaaggatggcttagataatagngatcccactgggtccaccctgtgaatcacgtcagaaaaggcgtttttgtaggagacacgtgtttggtgcaccacaaaggtgctgctatatgttgtgtcaactagttggtggacgacacgtcgtataatcttttcgccgcgcccctccttttatagagaaggtttttaatcctctgctcacctgttttacagggttcttgcacaagtacactacgcccgcttgtttctcagcagtttgttctaaaagtagtgagtgtcttgaaactagtgtttaggcaagccactttagcgtgacactaatgttggcaccactataacttcccccttggcccgcaataaacgcaa

SEQ ID NO: 584767 - DNA, 259 bp, Homo sapiens
cacatagtcgattccaaatatcagatgcgtgctacaggaagtcccttgccactcgctaaagagccagcccagttctctctaaggagaatggcccaatcctctccctagtccactcaggggaggtgataacattgctttcgtgtaaattatgtgatgcaaaatttgatgaagtcttcgcctcattacttacgaatctagttcaattttgaatgatgagcctgacgtgcccccccttccccctattttggccccctaatcg

SEQ ID NO: 584768 - DNA, 162 bp, Homo sapiens
  misc_feature (25)..(25): n is a, c, g, or t
  misc_feature (45)..(45): n is a, c, g, or t
ctatctaaatttacattcaagtggnaaaacacatcagctgtgttntaataatttattgagtctctctcaggataggatattttatgctgtggtgcacaaagacaaaatctcgggagattaacaccacagacatttagtttttgctataaatcagtgggaacg

SEQ ID NO: 584769 - DNA, 558 bp, Homo sapiens
  misc_feature (17)..(18): n is a, c, g, or t
caacgatggtcctcagnnctacttgggaacgaagcaggagaatcgcttgaacccaggaaacggagattgcagtgagccaacatcgcaccactgcactccaacctaggtgacaaagcaagactccatctcaaaaaaaaaaaaaggttttggttttggttttcttggagagggagtctcccttggctgcccaggctgggagtacaggggcatgatctcagctcactggcaacctcggcctccggggttcaagagattctcctgcctcaacctccctagtagcggggattacagggcgccggccaccgggtcgggctaattgtaatattttaagtagagtgggggtttggagggtcagggtctcaaactcttgatctcaagtgatcggcccacctgggcctcccaaaaggcggagattagcaggcataagctacggcacccagccccaaaaaagactttaattagaaaaaagctcatagaatagggatataaagaaaatatctttgtgcagcggtacagtgtataggggttaaaagctaagtgttattacaagagttcaaa

SEQ ID NO: 584770 - DNA, 361 bp, Homo sapiens
  misc_feature (45)..(45): n is a, c, g, or t
  misc_feature (219)..(219): n is a, c, g, or t
  misc_feature (312)..(312): n is a, c, g, or t
gttaaagatgacagggcccagctggggtcaagtttgagccttgcnagttcagtattgggtgctaagcacaggtggccagtgtctgtgttttgtcacgtattttgctttggcgccatgatgaaaaaatgttaattggcttaccccacgcaaccccttcggccacacttgcaaaactaagaggcttttgcttaaggttccataaaacagaaaaagaatttnctttgtgatgccgcagttgggcccttcagggactatagtgtgggcaagcagagtcactagggaccacctggggcaaagggtaacctaggaagnctggggatgcttggccaaaaggtaaagtatttctttacccattaggact

SEQ ID NO: 584771 - DNA, 239 bp, Homo sapiens
attattgctaaatattttgtttatactaagggcccatttttttaagcccctgggtttaaaaaaaaaaaaaaaaactctgtttctccaggggatgatattggtgagttgccaaaaaaccaatacagcatatctgcttttgccttctgttgtttatcttacccgcagatattaagaatgtatgccttatgtaaaatgcccaattatatatttttgttgagttttttaattaaagccttgta

SEQ ID NO: 584772 - DNA, 863 bp, Homo sapiens
acacaacctttttttttttcccaaaggttttcaatctacagtggatccaatccggggaatgtggaaccgtggatacatgggactgactatatatggttaataggcatttggataacttcctatgagtataatgcccatttaactttattttttttcttttcaaagccatatgaaggattaaggcctcaggatcttcgtagactaaaagatatgcttattggtgggaaactggcagacatgcttcaggctcctctctttactggctgaagctttacttcgagctcagggtaatgaaccgaaaggtcttatgcttctaagaacatgagtaactttggaaacttctgagtttttaaaagggctattttggtattggaatacagaacaaaagggttggttaaaaaagcctaagtggtgtttggtggcagtggttacttctatactcagttcctcataacatctgtgtatttggaagtataaatgggcatatatctaagaggagacacgggaaaatccttttagaaatggagctactaaagcaaattatagaatgtctaatcttagaactatgtctaattcgagtgagatggagcattggaaatccatagtcctagccgtggttttggacattaatttgggctgaagtcattcaggtttaaaattatgggtagttcaattaaatacctaagaatggtggctataagtatgggtcaggtggtataatgtaatatggtagctaatttttccccattgaagtgcacaagtgaaggtaaagggtcactgggaacttttttggccctttaaggggggtacttgttactgggtttggtataggttatagagattatagttttataaggaaattt

SEQ ID NO: 584773 - DNA, 439 bp, Homo sapiens
gtaccgccagggtctaagaacccctatccataggactcaacaaatatatcctattggttctttagatatactatagcactaaattaggtgctagggatataatggtggaacattatatcccactgatgctgtggaaccgacataatagtagaagaaataaggacagagaacagtcatctttgaattcttctgaacagcctggaagtgacagtattcttagagtagccccctcttagtataatacttccttctttcattatcttagtaactagcctcacttggagtcctgactagggaaggtagttacggagaggatggatataaagagcctcagtcagtatatgataaagttagtccgagtcagagtacaagggaagcttgttactagggcactacagaatgggtaatcgagataggagaagagggcatatatatactg

SEQ ID NO: 584774 - DNA, 634 bp, Homo sapiens
ccggggccacacctgctggccgcccaatgccagtgcaatggcccagtgtgcctgacatctgctcccagcgctcgatgtgacctgagtgcctgctgtgtgagtgacacctgtgctccctcgtggacctgctctggattcctggccctggactgtccccttgtgagctctgcatctccaacctggaacccaacccagaagtctcaagtttgactgcatcactgtggctgtgcaggatccactgagtggtccacagagaggggcgcccatctcctgcgtctcagttatcctggtaatttgttgtatcttgcccatattgtatcgttgcctcattaacttggctttctagtgttgcacccaccttgccaccagagaagtccaaatcctgacttctctccaaggtgtaagggaattctgtgccctaaagaattccgactcagatccgaacgtgggatctggtggaatcgagggtgaaagaccagagggacaatgtatctactatcccaactgtgcttcagcgccacacctggctgctttgccaccatctggcttggcggcgactcgcggcagccggttggttgacagcgcgatacctgagggtgactgtggctgacacacctgcgaggacgtctcgatt

SEQ ID NO: 584775 - DNA, 961 bp, Homo sapiens
  misc_feature (114)..(114): n is a, c, g, or t
  misc_feature (116)..(116): n is a, c, g, or t
  misc_feature (169)..(169): n is a, c, g, or t
  misc_feature (171)..(171): n is a, c, g, or t
  misc_feature (173)..(173): n is a, c, g, or t
  misc_feature (269)..(269): n is a, c, g, or t
  misc_feature (271)..(271): n is a, c, g, or t
  misc_feature (295)..(295): n is a, c, g, or t
  misc_feature (349)..(349): n is a, c, g, or t
  misc_feature (383)..(384): n is a, c, g, or t
  misc_feature (398)..(398): n is a, c, g, or t
  misc_feature (421)..(422): n is a, c, g, or t
gggcggccgcacctgcccaacccaacccgcacggtccggaagtcgccgaggggccgggagcgggaggggacgtcgtcctagagggccggagctgggcgggcggccgaggacccngnctcccgcgcaggacggagccgtggctcaggtcggcccctccccaacaccaccncngnggcctccgccccttcctgggcctctcggtggagcatggacccgaaccggtgcccatccagtccggtgccatctgaagcccccttcccagcagcctngngcaccatcttctcattcatctccnaggactgtggtctccaagctgcggatcatggagcgcctcaggggcggcccgcanagcgagcactaccgcagcctgcaggccatggtgnnccacgagctgagcnaacggcttggtggacctggagcnnccggtccaccaccggagtctggctgccggacggtgccttgcggccttgacctgtgcccttgctcttggcttgccggctggttccctgggagcgcctctttccctcgcccagcgcgccgagggactgcactgcaccttccgcgcctctgcgccgaactccttacaagggccctcggctggccgccttaccagccgctgggggtcgttgcgcccgtgccgtcacccgtggccttcttgcacgctgcccaacacaggcgagggtcttccctgggaggcccatgaacggtgggggcccccgggagccaggccgtgcagaatgcttaggcgagggcctccccttcatccagcggtgtctacaaggtctcccagaaggctctaacgccgagcactcccttggcttgaccttgcccttaaggcggggaaagccagggccgcaccggctttacctgcttggcgaatcttgcgcttggggtggaccagggccgtggaagatccggggcagaagccttctggggcgctcgcgcggaccaggagaaccta

SEQ ID NO: 584776 - DNA, 855 bp, Homo sapiens
  misc_feature (114)..(114): n is a, c, g, or t
  misc_feature (116)..(116): n is a, c, g, or t
  misc_feature (169)..(169): n is a, c, g, or t
  misc_feature (171)..(171): n is a, c, g, or t
  misc_feature (173)..(173): n is a, c, g, or t
  misc_feature (506)..(506): n is a, c, g, or t
  misc_feature (508)..(508): n is a, c, g, or t
  misc_feature (532)..(532): n is a, c, g, or t
  misc_feature (586)..(586): n is a, c, g, or t
  misc_feature (620)..(621): n is a, c, g, or t
  misc_feature (635)..(635): n is a, c, g, or t
  misc_feature (658)..(659): n is a, c, g, or t
gggcggccgcacctgcccaacccaacccgcacggtccggaagtcgccgaggggccgggagcgggaggggacgtcgtcctagagggccggagctgggcgggcggccgaggacccngnctcccgcgcaggacggagccgtggctcaggtcggcccctccccaacaccaccncngnggcctccgccccttcctgggcctctcggtggagcatggacccgaaccggtgcccatccagtccggtgccatctgaagcccccttcccagaacatgagccacagagcaagctgaccccaagtgacacaagcaccctcgcagccctactgtactttccgttacctagtcacagatagaatggatgacgtcggagcacagtgtttcaagtctcgaaagtcgtccttggtcacgtttcacacgcagttgtcatcagatgacgaacggaagaggtcttgctggacccctacattgccacgctggacagtggcctaggtcaggtctctcgagcagcctngngcaccatcttctcattcatctccnaggactgtggtctccaagctgcggatcatggagcgcctcaggggcggcccgcanagcgagcactaccgcagcctgcaggccatggtgnnccacgagctgagcnaacggcttggtggacctggagcnnccggtccaccaccggagtctggctgccggacggtgctgcgcctgtcccgcgccctgtcctggctagcagctgttcctggagggccttgcgtaccagccccgaggacgcacgcacctccgctgctcttgcgcctgagctcctacgatgcctcgttggccgtctaccggcccctgggtctgtgcgccggtgccgtacc

SEQ ID NO: 584777 - DNA, 156 bp, Homo sapiens
  misc_feature (143)..(143): n is a, c, g, or t
  misc_feature (149)..(149): n is a, c, g, or t
acgaaacaacaaagcaggggatttctcttctgattattatcataaaaaggtccactgtcttatatacacatgtatataatgttacattccatcactgtaaaaagtcccctttgccccctcccccaaaaaaagtttcagtctangcctcncaaactt

SEQ ID NO: 584778 - DNA, 117 bp, Homo sapiens
agaagaggcccaatgagccagcataagacacaacagaagacacagagcaagacgaacattaagaaatggattgtggaacagatgaagaagaagaaaccgtccctttgctagagcctt

SEQ ID NO: 584779 - DNA, 308 bp, Homo sapiens
  misc_feature (12)..(12): n is a, c, g, or t
  misc_feature (32)..(32): n is a, c, g, or t
  misc_feature (71)..(71): n is a, c, g, or t
  misc_feature (128)..(128): n is a, c, g, or t
  misc_feature (224)..(224): n is a, c, g, or t
aaaaaacaaganttttaggatttttgaaacanttgatgagctttggctttaacccaaagtcaccagctgtnttagctcttaagagagtcaggctgtcctttgaagctttgaagctaggcattcatttntcccctctagctaggaaagtcctagatagcatcttcttccaatagaaggctgtttcaactacactgaagatccgttgtttagtgtagccatctttntcaatgattttagctacatctcctggataacttgctacagtttccacatcagcaacttgctggtccgttttccacttgtagggt

SEQ ID NO: 584780 - DNA, 890 bp, Homo sapiens
  misc_feature (220)..(220): n is a, c, g, or t
ttgtggctccggaaaggcgtagggatgccaacgatgaggctgctgtcattggtggtgtgggctctatttgctgtcactcaagcagaggaaggagccaggctttggcttccaagatcactgactgaacagagtacgccgtggagcggacgatgacctgagccttgcaagtacaacatctacaactgttgtgctgcgaagtgctgcgattaggacgtggaanctatctgtatgattccttccactccagacagactattgggcattgtgtgctggcaatggcctcaagtgtacagaatgggtaccgagattgctcgcctgtcatagccaatgtctccggccacactgtggtcctgtcgccctctcaaggctggttatttgcaaccttcacgctcggcaacaattacttacctggtcccaggaggatgggcccgttgtgattggtgtctaccagtgcagctggaccagggaggaatcctggctcagcgggaggttggacaggcgattctccgcctcattttctggagctgggcaggctttggggtcatgacccttccctccatcggatatccccctgctatgtggtactccagtcaagaggaaatatgatgactcccgaaaaacgaggaagaacttgattggggcttccacagccctcctgctcccagaaatccagggtcgctctcccaatgaaatccaggtgtttccagactccaaggggtatcttatatggaaatctcttctctcttagccttggcaacttttcctgtatcctggcctgtctcagcatagtgaagacagccctaggagtcttggaaagcctccttgtgtccatcggaaggataaaaggaatgctttggatagttgagctaaagggccttgatgccatgagt

SEQ ID NO: 584781 - DNA, 307 bp, Homo sapiens
gggggggggggccccctcctggaatcccggccctttgggggggttgaggcagggggatccctttagtccaggggtttgagcccagcctgggcaacatggggagacctggtctctccaaaaactaaattagttgactgggggggggcatgcctggggtccccgctcctgggaaggttgagatggggggatgttttgggccttgggggtcaaggccccagtgagctgggattgggcccctgtactgcggccggggcatcagagcaagcccccctttcaaaacaaataagcaaaacccccaaaattttta

SEQ ID NO: 584782 - DNA, 127 bp, Homo sapiens
agctgagggagatggggtagcgtggtgttgagtggaccatggggtacgtggagttgagggaactgggcagggcacatgtcacactcctgtactgggcattcgtgttcctgcttcaggttggccctgt

SEQ ID NO: 584783 - DNA, 112 bp, Homo sapiens
tggaggagaaggcagagaatgaagtgtggagggcaggcctgggcccactgctcagggaagctccccccctccagatgctcccttccatccacctcctctgacagagaggagg

SEQ ID NO: 584784 - DNA, 413 bp, Homo sapiens
tatgaacatcatttgtagtcttgtattaggtaatagaagttaggatttcagaacgtaatgggagacttgggggagactgcttgttttgaagttgaaagcagtacattcaaatatgtaagtaacagcatagaaaaatgtatatagggttaacgtgcagaggtttgtatttaggctttcctgtaaggttaaatcctgttgtttaaaacaaatattcagataacaataacactttaaaaccattcaagagctgggcatggtgactcatgcctgtaatcctagcactttgggaggccgaggcagaggaatcacttgagcccaggagtttgaaaccagcctaggcaacgtggcaaaatcccatacctacaaaaattagccggaagtggtggcatgcaactacaggcccagctactcag

SEQ ID NO: 584785 - DNA, 383 bp, Homo sapiens
agaatgtgggcttcaccaaggacgtgggcaacatcaagtttctggtctgcgcagactgtgaaattggaccaattggctggcattgcctagatgacaagaacagtttctatgtggccttggaacgagtttcccatgagtaactgaggggtggggttctcatctccatcttcaaagatttaccttcttcccacaagaactggcctttttggtggtttatactgttccgtggcctttttgtttgtgcttttttaatttctgtttcccagcttttttcttttgtacatgcatagggatatttcctgtatcctaaaccctaaagttcttgccttcctggcttaattatactttgtttcaattttccctaagcttctcttttcccctca

SEQ ID NO: 584786 - DNA, 660 bp, Homo sapiens
gttctttcataatttggctctctgtttgtctgttattggtgtataagactgcttgtgatttttgcacattgattttgtatcctgagactttgctgaagttgcttatcagcttaaggagattttgggctgagacaatggggttttctaaatatacaatcatgtcatctgcaaacagggacaatttgacttcctcttttcctaattgaataccctttatttctttctcttgcctgattgccctggccagaacttccaacactatgttgaataggagtggtgagagagggcatccctgtcttgtgccaattttcaaagggaatgcttccagtttttgcctaatcagtatgatactggctgtgggtttgtcatacatagctcttattattttgagatacgttccatcaatacctagtttattgagagtttttagcatgaagggctgttgaattttgccggccttctacgcatctattgagataatcatgtggtttttgcctttggttcctgttatgtgatgcattacatggtttacattgcatatgttgaaccagccttgcatcccatggatctgaaccacttcgctctggcgcatgcttctcgtcgcgctctgcattccgctctcgcaccttttatctgccgatttcaccttatcgttttccg

SEQ ID NO: 584787 - DNA, 281 bp, Homo sapiens
agggttctctctatcctttctgtttatcgactcccaactccttgttgttcattcatctcttcctgaatctgtgcccctgtaccctgccggcctccctggaggaacaacgcatgccatacccctttactacccaaggcattaccttagcagttcaccttctcttttctgcacccttaattacttttctctacagcatatatcccaccagcatccaaatacaccctcctcttaactatccactcaagaaccgtctcttgctcctctgccccattccactactt

SEQ ID NO: 584788 - DNA, 625 bp, Homo sapiens
  misc_feature (8)..(8): n is a, c, g, or t
  misc_feature (241)..(241): n is a, c, g, or t
  misc_feature (243)..(243): n is a, c, g, or t
  misc_feature (263)..(263): n is a, c, g, or t
  misc_feature (265)..(265): n is a, c, g, or t
  misc_feature (277)..(277): n is a, c, g, or t
  misc_feature (290)..(290): n is a, c, g, or t
  misc_feature (360)..(360): n is a, c, g, or t
  misc_feature (403)..(403): n is a, c, g, or t
  misc_feature (458)..(458): n is a, c, g, or t
  misc_feature (561)..(561): n is a, c, g, or t
  misc_feature (579)..(579): n is a, c, g, or t
tattggtntgttaattgttagtgcagttttttaatcttattgtaggcttattctgaggagaatttttttatgttactgatactaacattagttcttctatagggtgatagattggtccaattgggtgtgaggtgttcagtgatatgtttgggattttttaggtagtgggtgtggagcttgaacgctttgttaattggtggctgcgttgaggcctactatgggtgtgaaattttttactctntntacaaggttttttcctagtntncaaagagctgtncctctttggactnacagtcaaatttacaaggggatttagagggttctgtgggcaaatttaaagttgaactaagaatctatctnggacaaccagcgatgaccagggtcggtaggtttgtggcctctncctataaatctccccactattttgctacaaagacgggtgtccccttttagctgtnctgaggtagctcgtgtggtttggggggtgtgagctttggctctgcttgcaaagtgatgtctagtgaattcattatgcagaaggtataggggtgagtgcttgcnatatgatgcttggttatnattcttcatctctcccttgcggtactatatctatggcgcgaggttt

SEQ ID NO: 584789 - DNA, 143 bp, Homo sapiens
atgggcgatgccaacattactactcaggtaccccagatacagaaggaaatcatgcgtgtgatcggaactcagtttacacaaactgagggggcgccagccctcgtaccacccctgttaccccagggtccatctgacccactctt

SEQ ID NO: 584790 - DNA, 357 bp, Homo sapiens
  misc_feature (12)..(12): n is a, c, g, or t
  misc_feature (46)..(47): n is a, c, g, or t
catgtcctaganccattgtttgaatattaatggtgaaagacacccnncaagagaatgaaaagacaaacccacagactggggaaaatatttgcaaaacataaatcctgataaaagacacatatcctaaacaatataaatggctcttgaaaccccaatgacatgaaaacaactcaattaaaaagtgatctgagcggacttcttttgagaagtgtctgttcatgtcttttgcccactttttaatggggttatttgttttttgctcattcgattgtttaagttccttgtagattctgggtgttagacctttgttgactgaatagtttgtgaagattcgctcccattctgtgggttgcctgt

SEQ ID NO: 584791 - DNA, 194 bp, Homo sapiens
atcacacgcacatctcactgtgctgacctgtgctgtgctattcactgccgtgagcatccagtcgcgaaccgacaggtattcatttatgtccgcaacacagatattgctataggctctgtgacatcatgaaggacatgtgtatggttaacttctatgggcacaaggacagagtactcggcttgaaggccttgttc

SEQ ID NO: 584792 - DNA, 231 bp, Homo sapiens
ttttttagtttttggttgaactcggggcttgtttgagttaaagctaattttgccagttccttgggttgggggcaaatctcctccagattgatgtgtagagaaggtagtgggcctgattaatccattgaggaagtagtagaattagccagttggaacactgagcaagtcattccctttgaggatcgatttctacaagtggaaaggaattgaacaggttctaagaagacggta

SEQ ID NO: 584793 - DNA, 129 bp, Homo sapiens
cccaacaccgggctggggcataactcgatgattttgatgatcgaggcccaggtcacctacatcctcgatgccttgcaacaaatgcagcgccatcgcatcgccacggtggacgtcaagccaacggtcgac

SEQ ID NO: 584794 - DNA, 686 bp, Homo sapiens
taaaggccatttagtaacatgtccggttaagtcttgtaacacaaacccggggttatgttctgggcgaaacattttgggcctagaaaaatgaattggggctttgccactagtaaaagaaataaaatgcccttttacgtctccctcccctacaattgacctttgggtaggccccaaacttgaaaagccagcctgatgataatactccaacctatccgtcccatagacaagatacccagcctttacgcggtggtcggtcgccgtgcaaggtcgcacctcacagtgtttagagcctccatggtctatcaacagcactgtgttcaggatagtgtgtgacacgcgcagcacatcgttcgatccgttcagagccagtcatgtcaagtcaagggctgccgcgtccttcatggagggccacgtgaagtacagaagccagtcaggttccttttttccatcacgaggatatggacacctggcctcagcttgagcccttaggtaacaagaacttcagctcctcctgacgccaaggatgattctaattgttaaaaattagatctgtcaataatccgtccttataaagaatggaatatgctatcctataagttccactggttgccccctgtgcagttttaagaaattaaacaaaagaagatattccctctcctttgaaattagacaataaaaatttggca

SEQ ID NO: 584795 - DNA, 182 bp, Homo sapiens
atcagcacggtgaaaaagccgacattggcgccggcgtcgaccacgcagtctccggccttgatggcgcgggtcatgacgtggatcacctcggattcgggcagctggcggttctgcgcgtaccagagcaggttgcggtcggactcaaactgctcgggctggaggtcgaacaggagcttggggcg

SEQ ID NO: 584796 - DNA, 310 bp, Homo sapiens
cctaaccagtatctaggatgtattccagaagggaagtgcaaaccatggtagtagagaaattatttggagaataaaatcatcacaatttttcacattgggtaaagacaaaaatctacaaattcaagtaacttaaagaactgcatatagcataaagtcaaagagactcagacctatatgtgttatcatccaactctaaaagccagacaaagagataatctttaaataacaagagattttgggagccgaggcaggcggatcacctgaggtcaggagttcgagaccagcctggctaacatggtgaaaccctatt

SEQ ID NO: 584797 - DNA, 760 bp, Homo sapiens
  misc_feature (10)..(10): n is a, c, g, or t
  misc_feature (170)..(170): n is a, c, g, or t
  misc_feature (219)..(219): n is a, c, g, or t
  misc_feature (227)..(227): n is a, c, g, or t
  misc_feature (329)..(329): n is a, c, g, or t
  misc_feature (360)..(360): n is a, c, g, or t
  misc_feature (386)..(386): n is a, c, g, or t
  misc_feature (452)..(452): n is a, c, g, or t
  misc_feature (454)..(454): n is a, c, g, or t
  misc_feature (460)..(460): n is a, c, g, or t
  misc_feature (466)..(466): n is a, c, g, or t
  misc_feature (480)..(480): n is a, c, g, or t
  misc_feature (482)..(482): n is a, c, g, or t
  misc_feature (491)..(491): n is a, c, g, or t
  misc_feature (509)..(509): n is a, c, g, or t
  misc_feature (515)..(515): n is a, c, g, or t
  misc_feature (520)..(520): n is a, c, g, or t
  misc_feature (525)..(525): n is a, c, g, or t
  misc_feature (559)..(559): n is a, c, g, or t
  misc_feature (564)..(564): n is a, c, g, or t
  misc_feature (567)..(567): n is a, c, g, or t
  misc_feature (583)..(583): n is a, c, g, or t
  misc_feature (640)..(640): n is a, c, g, or t
  misc_feature (649)..(649): n is a, c, g, or t
  misc_feature (676)..(676): n is a, c, g, or t
  misc_feature (679)..(679): n is a, c, g, or t
  misc_feature (684)..(684): n is a, c, g, or t
  misc_feature (691)..(691): n is a, c, g, or t
  misc_feature (694)..(694): n is a, c, g, or t
  misc_feature (711)..(711): n is a, c, g, or t
gccccaaganactggcactggccttggccacccattttctcaactttaggctcagtcagaccaagcatagaaagaacaggaggctctctatgttgcctgaggctggcagtggtgaccctcagaaatcacaagggagcggagagagctgtgttcaacatgacacgcttgangaggaagggggactgtgatggggtcgtttggcctactgccctggggggnccccaggnggcctcctctcctgttggctagggggtgaggtcctatgagccggggggggtgggggggcgtgtgggggcttcttctccccacggcccagccatgggcatggnggggccgtacctgggcctagagatgatagtntggtctgccaggcagttgctgccacnctctttcctgtgggtcccagcgggggtggcctggtgccctgtctcggctgtgctgcttcccggggngncaggcngtgggnggtcatgctggcgncntcctggccngccgcccggggggtggtnggctgntgtgntgggntgggctcttgccctgggttggtctcatggtgcanaagancantgttgggatcattctnatgcttcagggtgcctcatgtgccccatggggctcagacatcaggaggtgctgggantctatttanccgttcgatgatgcggttgtggtccangangtcanatgccancancttcatcccctcgcagnctcttgcatgcttgctgagactctcctgggcccctgggcttctgtgtta

SEQ ID NO: 584798 - DNA, 126 bp, Homo sapiens
cgttatgatgttcatcgcatcacggagctggtctccgagcaaagaaagacaacctgtgcaaaacagcagcagcaacaacagaacgatgtggtgaagctcacgaaggaacacgtaaaccgaaagaaa

SEQ ID NO: 584799 - DNA, 154 bp, Homo sapiens
gtaatgctcatatcagttcacagtccaggcggtaattcccaaactctgagcccatctgcgctgcacctcgtagccatcagggtactgtgagggcaccaggtggatagcgtgtgtcctgcaccaggctagcgcacacgtatgggttcccatacgc

SEQ ID NO: 584800 - DNA, 124 bp, Homo sapiens
ttttttttttcagcttcggaatgtgacaatttatttggggggtaaaagaggcttttcacccccctttcctggcgttgttacttttttgaagagcagcattatcatacggacaagacaggtcgac

SEQ ID NO: 584801 - DNA, 213 bp, Homo sapiens
tcatcgagctcgcccttattaccacgatcactcgctatcttttttttaaacagagtcttgctctgttgcccaggatggagtagcagtggaatgatttcagctcactggaacttccgccatcccaggttcaagggatactcgtaactcagcctcccgagtagctgggactacaggtgtatttttgtatttctaatagtgatcgtggggttgtaa

SEQ ID NO: 584802 - DNA, 1662 bp, Homo sapiens
  misc_feature (392)..(392): n is a, c, g, or t
  misc_feature (657)..(657): n is a, c, g, or t
tgggtgaaacaaaagaacacttacttaaaacattgtactggtggtgatgattcccaggggccactgtggttcagccgtgtgtggaccccgtggatgtgctatccacacccaccttattcccttgcagcttaatttaagctgtgactcttcataattttaacgtgagcttcttaatttatagctgactcagaattttggcttggggttaaagttctcctttttataatgtggtctctatagaagtgtgtttctacagagagtctcctcaaatattctcgagttataaacaagcataattttatgagggtggccatataaacattataaattagaaaaccgctgttaagttctccagaaagacaccccttaagtgtgtggtttctaaaacaccncttgagagagacacacacttttctcaaatgttgtgcactcccaaaatgtttgtgcacacgtgcgcccacaccagagtctcttttataaaacaccactgtggacactatagaagagacagacactacagtgcagtgtagacacaccattctataagacaaacaacagagagtgtgtctctccgaatctgcgacagagagagagcctcttatctcgctgtggctccccgtggtgggtgttttcccccgagtgtgtgcgtgtgacacnccacccgagtggagagaggtcctccgccgtgagactctgcggggctctcaactctccgctattttctactcgccccacacccctgtgttgagagacaacatgttgtggttgggcagaaaaactctccccgatgtggggaaagagaggggccaaaaaatatgtgggccacgagaaaggggttttcaccatgtggtctcccccggccgtttttgtggacaatatttcttcccttcgcgtgataaaaaagacaacaaaagacgccgagtggtgtaatatacacccccgtgagaacatataaaaccgcgcgaggcggacctaccactacccggaatagaggaccctccctcgttgatagaagcgcgacattaagcacaacttttggggacaatttctcccccacagaaaaactcccctgtttggcaagcccatagtgggcatttattaagaatgttgcgtctcccccctgcgggggaacaaggggcttgcgccttgatgaaaggttatcccccaattttatttttggttgcgcacaactctctcacacacaatatgatattaaacaacacaccatttcttatgtccttataaaggtttcccccctgtggagaaagacgcgtttttacgttggagaaccctcaacaacgggccccagccggtgttctctcttggcgcccaacaccaaaacggcagagtaggagtagtgccgggagaccttaggacccccctcacctaaaaagggggagcagccccagtgcgcaaaaaaatacccgcaagggggaggacggacatagggaagcaacttgcagcagggaacacggggggggccgtcaaacacacccacccgtggtgaagatggtaatgcagcatccccacgcttatataagcaccccgcggaaaagggtgatcagccacgaaacatcatataaaggggggcgcccactcgacgagagatataagacacagccgagtcgagggcaggagaacaacatctgggggggagacaca

SEQ ID NO: 584803 - DNA, 444 bp, Homo sapiens
  misc_feature (131)..(131): n is a, c, g, or t
  misc_feature (172)..(172): n is a, c, g, or t
  misc_feature (174)..(174): n is a, c, g, or t
gaggatccacggaccgcgaccagagacccaggaagctggcaaggcaggcttcagggggcactacggagtgctgtaaatgcggcttgaagatgactggctttttgaggttgccttcgtggcaaaactaattncttcagtacccaagtcctggcagtccaatacttagagcctnanagagatgtcaggttgcattcctgtggttttttttcttttcctgtgttcactgtgaaagtgattcctgggtgcctgtgaagccttcacccaaaagcaggcttataatggtgaaatttcaggcatggctggaggcctaaagacacagatccttggggaataggagcggctgagttttagaatggctccaggcaggagctctgtgcaggatgtgcagactcagtaaggcacaactcaggggcaccctaacccccggaggatctttgcctcgtg

SEQ ID NO: 584804 - DNA, 1397 bp, Homo sapiens
  misc_feature (904)..(904): n is a, c, g, or t
  misc_feature (968)..(968): n is a, c, g, or t
  misc_feature (981)..(981): n is a, c, g, or t
  misc_feature (984)..(984): n is a, c, g, or t
  misc_feature (1002)..(1002): n is a, c, g, or t
  misc_feature (1010)..(1010): n is a, c, g, or t
  misc_feature (1025)..(1025): n is a, c, g, or t
  misc_feature (1185)..(1185): n is a, c, g, or t
  misc_feature (1189)..(1189): n is a, c, g, or t
  misc_feature (1236)..(1237): n is a, c, g, or t
  misc_feature (1246)..(1246): n is a, c, g, or t
tgttctgcttgtctgcatggggtctatggttgcctctgtctttggttctggccccggcggttagtcgttgttgcttgccctgggtgtggtccgtaagtgggactgcgtttttcttgtgtcctgcatggtgggggatgcttcctccttaattagtggggtactgcccccatgttgtcgggtgccctccgctgtgttacacgccccccggattgggctggggcatttatcgcaggggggcacccacaaagtgtcttctatgttgccgccggccttggcagacgccccccggttcgtcttctggtgtttgaccccgtgaagagtgttttttcctccccccccctccggtgtttgcttcgccgcctattgccgtctcgtcccgcccaaccaactcagggctgttagcccacccccccgtcgcccccaggggtttagtccgccgtgtcccagactttttgggtttttaccgttggtgtgaggatactttttcatttgggccacccacccggtccgcagggcgcaagtaccagccttgtcccacccgccccgcgagagggaccttgtttgggaagtggggcccccctcccccgggaaaccttttggcggtgtaatggcccccggggcctcttcccggaccatcatgccctggccctccgtgtgcttggcgcctgccacaaggcctgttgggccacaggtcactccccctggaggctgttacccgggagaggcttcacttggcactgggcccctgtcccggtgtggcacccacacgtgccccacagctggttccagctgggtggaaccctgtgaccctggccgcttcttagaaaagaaacactcgcccacaatattatgtgatggacagatttcacagagaagagttgtgtgtgatagcacacgggcgctntcgcggagggacacccccctctccaggggccacttctcctcgggggcttacacaccttgaggcncccccgcgtggtnctncctcttgagactttccancacgcgancaccccacacttccntccaccctttgaacctctggggctggcaattgccctcacacgagccacctttgtcaagctcactttcctggtatgaccaccgaaatttggctacagcaaacacagggtggtggaccctcactggcccaccactggcctcccaggagtaagacccctgganccanccagccccacgccagagcacccagaggaagagagagaccctcacctnnctggggagntccctgccaccacactcagtcccccacccaccacctgaatctcccctcctcaccacgttgccatgtagaccccttgtaagaggggaggggcctagggaaccgccccttgtcatgtacccatccaataaagtaccctgtgctccaacccaca

SEQ ID NO: 584805 - DNA, 404 bp, Homo sapiens
aacacagctctatcacagatagcattgttcacttgtctcactactagaagatcttataaccagtgccgccttttcaaggctatggccagtctgcagaatgggagagatccctgtgcatgagctggagaaattcgaaagtcagaggaagggaagcagaggtctgcagctcagccttccaccagcccagctgaagtacagagtttaacaaaagctatgtcttcactccaaaatgacagagacagactactgaaggaattgaagaatctgcagcagaaatacttacagattaatccagagatcactgagttacatacactgaaggctcaacttcaggagtatcaagataagacaaaagcatttcagattatgcaagaagagctcaggcaggaaaaactctcctggca

SEQ ID NO: 584806 - DNA, 324 bp, Homo sapiens
tactactactactactaaattcgcggccgctttgacttttttttttttctttctcttttgatctcagtctctttccagacctcctaggttttattctctagtactaaatgttttctgctttactttttttttttcttagagacagacttttgctgcgttgcccagtctggagtacagtggcatgatctgggttcacgggactctccgtctcccgggatcattgccatacgctggcgtaagactctttattgattggaactactggggcctgccaccacacccggttaattactggagtttttagtagaaacggggtttaaccgt

SEQ ID NO: 584807 - DNA, 621 bp, Homo sapiens
  misc_feature (151)..(151): n is a, c, g, or t
  misc_feature (158)..(158): n is a, c, g, or t
  misc_feature (174)..(174): n is a, c, g, or t
  misc_feature (255)..(255): n is a, c, g, or t
  misc_feature (287)..(287): n is a, c, g, or t
ttctcaccgaacgatgttcggtcctatcatagggtgtctccttataacgtagtgagcccattcttaatgcataaatgtggtatgtctatccacactgtctctctcagtagtgcagacgtacagatgcccgttgcatagaagttcagtgcgncctccanccaacagtcataaccnctgaggatattgtttctcgtcagtagccgtaagcactggccagacgtaaggcgtaaacatttcttagttaggcatgatgcnccacgtaacctgtataatgtgtaagttatcanacatatcagtatagtggtatccaaccttagatatgcgcatttacaattatgtatggcaacagcaatgtgcagccgtcttacagtctttctggcgtttggcctagttgccctcgatcagtaagcacagccactaaatcatgggcccacatatgggctgtctggcagtctccaggcatgttttcggcatcaacaaggagcatcacattctattcaaggctcagcccccccggacctttcatcaaaccgtacatgtggagcctgattaatacaccggttccccgtattcacaacatgtgttcaacgcccatccttccaacaggcattattactggag

SEQ ID NO: 584808 - DNA, 306 bp, Homo sapiens
atgagatcatcgtatgcgattttcggacaattctcaattggaccatctatgctaacacatagtagctgcggaccaagggcttcactctatagtcgtgccgcaacatggtgaacctcatggatcgtgatggccatgggaagctgagcctggctggagttcaccatcctgtggagcccgggtccggaagttacctgtccgatcttccggagagttttgagccctggactagtcgggcagcatgagtgcctacgacatgcgtattggcattgagtccgcgggcttctagcctcagctagaagctgttca

SEQ ID NO: 584809 - DNA, 261 bp, Homo sapiens
  misc_feature (159)..(159): n is a, c, g, or t
ggggcccccccccttaggttttttttttaggggtttggtttttgttcccccggtttttattgggcccaaaaagggggtttaatttgattgcccctgccccccctgggggggggttctttattttttccccccccaatttcccggttttaagttagcccnactcctttgccattttctccttttttggttggttaaaaaccccccaattattatagttggggggccctttaccctttaaaagggtggcccctttttccttga

SEQ ID NO: 584810 - DNA, 211 bp, Homo sapiens
ggtgtacgtacagcccatccgagctctgcatgagggatatatgccttgttgagacttatggtcagagcacttactctaggcagatcaagcaagttgtaggatgacattccagcgacttctctagaaaatttatgtgctcacttgtgattcaagtatctgaacagggcctggcccaaccagcactctcggtattgtgctgctgattagccga

SEQ ID NO: 584811 - DNA, 227 bp, Homo sapiens
ctgcattcagcattaattatgcatattttcacttaattctcttccatttttaattttacttgtatttgtattttattttactttatttttatcttttgagatggagtcttgctctttcacccaggctagagtgcagtggcgcatctcagcttactgcaacctctgcctcctgggttcaaatgattctcctggcctcagcctcccgagtaactgggtttacaagcacc

SEQ ID NO: 584812 - DNA, 290 bp, Homo sapiens
agtcggtgtatactgtagctaccctgtcacttctcatggactctcctctccggctaggctttgtatccataattaagagtcttctgccagtgccatagctactgttggctgctggaaccgccatagccaccttggtttcgtggttaggcaaagtattggcctccagcgccataggggccagaggttctgcctccaagaattgcctcccttcatgggtccaaaatgtgacgactgattgttgtaagttcccaaaatgattgtagcttccaccaactcaggatgcttcttga

SEQ ID NO: 584813 - DNA, 270 bp, Homo sapiens
gcctggcgcgacatcctggaaggtctttgtacggaactgcccgtaaacaagcagctgaggaggatctaggagaagctcttctccaaatatggtcccctgtctgagctccactaccccatcgacagcctgaccaagaacaccaaagggtattgcattcaatcaccttcatgttcccctgagcacgctgtaacgggcctactcggaggtggcacgggcaggtcattcccagggcaaggatgctccaacggttgttaccaatctaccattcca

SEQ ID NO: 584814 - DNA, 184 bp, Homo sapiens
  misc_feature (5)..(5): n is a, c, g, or t
tagantcagaaataggttgagccctgtgtcaagggtcctcattaggtatcaaaaggtagcagccgtccatcttaccaagtatatcttctgtttacggggactgctaaacaggttcaagtggaataaactgggacagcctcaaaaagtgttgatgtggcctgcatgtgccaaacaacgtcctttt

SEQ ID NO: 584815 - DNA, 830 bp, Homo sapiens
cggtgtgaactactgacctttgctccggcctcgtcgtgaagacacagcgcatctccccgcctgtaggcttcctcccacagaacccgtttcgggcctctagagcgtctggtgagatgctgttgccgctgctgctgctgctaccacattgttgctgggccgtggaaggtcaatgaggccccggtggcgtctccctcaccacatcatcatcttctagcgatgagtccaacgcctttcaccgtgcctggagcggtctcgggcctaccactccgcacttgtgagtccaggtcacacgagtgcacctagttgcgcactgcggcagggatcggctcttgactgtagccagtgcgaccggtcttgccgtggtcctcatataggtcgagcttcctactgctacctaactaccttggcgctcactaagccccctgtttatccccctcccaacccgggtcctaactgcatcggtcgtcccgtgactagccttgcgatgcgcaccaagcaacgcaagatttatcagcacccagacagcaccggtccacttcatcggtgcagacaaaacaacccattgccaaaacaaacaaaacaagaagcgcgcccgtcaagcagcacagacaacgagtaagattccccacctagatgccatgcccagtatgcgcacccgagagcgcatcccaccccaggcccaaaaaacagggggcacatcacccacatcccctgtaacagcacagagaaacaacacctctgatttcgaaggggaccctggacaacaaaaatcacagaccaacgcagagcacaagccgcaccacaacaccaccaccccagcaacaaagcac

SEQ ID NO: 584816 - DNA, 922 bp, Homo sapiens
  misc_feature (323)..(323): n is a, c, g, or t
  misc_feature (685)..(685): n is a, c, g, or t
  misc_feature (882)..(882): n is a, c, g, or t
  misc_feature (907)..(907): n is a, c, g, or t
tttcttttttgggctggccgcgttagagcagtgcgcgtcgacagcctcgcgcacttgccaagaccacacctgtagcacactgatcagatataattcaacttcttgtccccaatcttcatccatatctcctccttactaacgactagatttgcactcttttatatttaatatatctatatccacctaccgtggacgccgggcacactcgcggcgagcgcgttgcacgtcgcctcgcaactatacagcgacaacgacggggacgagaggtggagaacaatatataagaaatacacagaaactaactgttgtattgtttatattgngctacgacgacggcatgttagttggggtggggacctgaggcgcagacgcggcgcggcgcggcgtgttggagatgatcggagcgcggtgggcgcgtgcctgactgtgcttgttgctgactcgccccctgctggcctgcgtcggatctcacgccacgctgcaactacataccactatccccaataacttgtcacttaatattcctcaacttatcatcatatagatagtatactctatatagtcttcttcctctctcccaccgtcgtctttcccttctctttccttctattagaggtatttagctattgccaacctgctctatccgtctggactctcttcactaccgtgcgcgacgccaagttgnatttcctctttctcgatcttctgtatctctttattcccaatatcctttcttctctccgttcttcgtcctatctcgtcatcgcagctctgtatgactgttttgtggtgtagcaggcggttagcttctcgagagtgtagcagtgcgcggcaacgtggaagacgcgggatgtattctgctcgagagtcctagttctctcngtggtccgcgtatggctatcagttnatatcaatatcaacg

SEQ ID NO: 584817 - DNA, 260 bp, Homo sapiens
  misc_feature (235)..(235): n is a, c, g, or t
cctcctcgctcttcctgggtcctctgcttttccctcaggtggcatccagcacgtccctctgctgccggagtcatcctcactcctcttcttaacaagtggatgcctgctccacgttgctgggtcagcgttggtgacttttgatggcttgctcccttcagcggacctccttcatgccttccagcttcttccttccagcttcttccttcttgcagggagtcttctggacggggtcctncttcagccggattcagctccttctt

SEQ ID NO: 584818 - DNA, 1601 bp, Homo sapiens
tggtggtggttttttggaacagagggtctctcgctcttttcacacccgaggcgtgcgagggcaggtggccacaagctctctcggcctccatgtgcagcctctccgcctctcccgggcctcaagggtgaatcttctcccctctcttcaaccctcctgtgaaaaagcttggacaacgtgcaggggtgtgtgttgccccacaatcaccgtggctataatttctcgtgtgatatattttaagtataaaagacggtggggtatccctccaatgtgttgtgccacgaggcgtgtgaatctctccaaaccctcactatatgcgaccaaccacaacctctgcgagactctattctctcagcaagagagtgtctcggggaatatatcacaggagagacatgtgaacagccccacccatatctccccgtggccctgttgaaagagttatttcccacaacacacatttaagagagaactcatgtgccaaagactccctatataatcccataaaaaacagtgtattttaaaacacccacagtcccctgtgcgcttctatcaaacctccgtgcgcgcgacacactctgtgagacactgttggaaagatctctgtggggccccgacaggcttcacatccattcaactcgctgcgtgccgcgcggagcagtcttttaaaaccacaccacacacacactatcatacagacaacccacaaccttttctggcgtcgggctccgacggtcacatcaaaaagagcaaccagacggcgctcacaaaaaaaaaaaatgtggggcccacaaacgcgcgtgcgggaccacctttaaagagacacccccccagaggggggcccacaaaaaagggaagaacacacatacccccacaaaccaccaaaaagaccactctctcaggacaagcgaacaacagcactggagcgacatcctgagacgaagacgcgacaattctgcgcacacaccaaccggtgggtggaccccccgctcggagccgacctaaaacaggacgcacaaatacgccacgaactacaagcacggagacaactacaagcatcgcccccagcgaacacaatccagggtcggaacgaaagcccccaacaacgatggcgcagtaaaacacacccctagcaacaacataagcaggagccacaccaacgacgacagaggtgaccccccccaaagtcaacacacacagagtccaccccacataaacaagcaacactagaagagaagacccaacagagcaccagcgtgggagaccaccacacatggtgaggaacaaacggcacagtcgacaaccaacggggctcatactagaaagaagcaacaccaggcgagcgaactaccaccgacgccgagataactacaccacagcgagcctgcacagaacaatcagtagaagaacagagcaccccccacataccactaagtcaagtccacagcagaaagaatgctgcggagtaagttcacaccccagaacacccccgcgggcccaacgccggacgaaaagcaccaaccaaaaaacaaaaaccaacgagcaatctagaggaagcacacagagggaggggccactaccaacacctcaacaggcagggtatgacc

SEQ ID NO: 584819 - DNA, 336 bp, Homo sapiens
cacaaagagagaccaccaaaatgtggtactagccggtgcagtataccggtggagtactctgactcagtgtacacagaacgttacatgggactcccaactccagaagacaaccttgagcattacatgaacttcaacagtcatgagcagagctgaaaattataaacaagttgagtacctccttattcatggaccagcagatgataacgtacacttacagcagtcagctcagatctccaaagacctggatacgatgtaggagtggatttccaggcaatgtggtatactgatgaagaccatggaatagctcgcagaacagaaaaccaacatatatatacc

SEQ ID NO: 584820 - DNA, 331 bp, Homo sapiens
gggccccggcctggggggtttttttttcccaggggggggagtttttttggggagggcccggcccccccctcccccccttttccccaaccgggtttttttttcccccccgaagataaaagggatttggccttttccccccgggccctttttttgtttttttttgggattgggggttttccttaacccccgctgaactaagttttggggggtttttttttaaaaaaaaacccgggttttaataaagccccttgggttttttccctttcccttgggggaagcctttgggggggggggttttcctggggataataaaacccccctgtttttttta

SEQ ID NO: 584821 - DNA, 802 bp, Homo sapiens
  misc_feature (175)..(175): n is a, c, g, or t
  misc_feature (199)..(199): n is a, c, g, or t
  misc_feature (201)..(201): n is a, c, g, or t
  misc_feature (204)..(204): n is a, c, g, or t
  misc_feature (206)..(206): n is a, c, g, or t
  misc_feature (208)..(208): n is a, c, g, or t
  misc_feature (237)..(238): n is a, c, g, or t
  misc_feature (240)..(240): n is a, c, g, or t
  misc_feature (279)..(279): n is a, c, g, or t
  misc_feature (598)..(598): n is a, c, g, or t
  misc_feature (606)..(606): n is a, c, g, or t
tggccggggaaaaacaattttttatgaaagttatagtcaagtcttttggaaaagttattggaaaggaaagatgaagtgattgctaagatgatgtctgtcaaaacagtcacaattaagaagtgtttaaagaagtcattgtacttgttttaaaaagcaatacttgccatctttccgntcttttttatcccggtgggtcctncnctngngngcagagatgtcacaaatttattcccactnnanggacgttcaaataatcactaacatgttacactttttggnttgggccccatataatatatttgtatagttcaaagaaaagtattcgatatttaaggtaaacagggtggaataaaaccaggttctagaacctttcccactcctaaaaactaatgaaataaaatcttattttctccagaagcccattagactgggcaaagcttaacctatagaggatctgggtacaagtttcccagattaaatttgaccaaatatagaattaattattttaaaattatgccattattcgggccgaatacaagggcaggacatcaagaccttcctggcttaccacttggaaaccatataatatatagtttgnctcttgtncccctttgtcggccgcctgggccccagccaacttttaactccgaacaaagctattccatcccgcccgaatttcaggcttattttggccaattcgccttttagggagttcgttttacacattacccgggccggggtgtacaacgcgggtgcttgagacctcttctttccccatcttagcccggggcacattcctttt

SEQ ID NO: 584822 - DNA, 536 bp, Homo sapiens
gacacctacacggatcaactgaggcaccacaatctcactggaaaggccgcgagtccgatcgatcactccgcgcagatcttgtccctgttcgccactcaggtgtatagccaagctgacaatgggtttttcccactcgccggcgatcgcatagtcaccgtatttggaggccaggctttttgcattgatggtcgcgtattgaccgaagaagcaaattttctgggagggcttcgcctctttaagctgcttgtgcaactgcgttcccgcagtcagagagtcaaaaagcggtaccgcagatgaagaccaaatctgcatcgctgaatctctctagggaaaagcccctcaacgtagatatcgatcagctgcgcgttcgatatctgcatcgagtagagctgttgtagcagatatccgcgtgaagcggttgataaccccccttcgaatgtacttgcgaccaggtacttcattctctttctccttggagctcaggcacggacgatccggtgactggcgtccctgagtggtttggtaggaatccgaag

SEQ ID NO: 584823 - DNA, 1155 bp, Homo sapiens
gcgattgtggcttgcgggaggtggtgtgcgccagtgttcggtggcctgttttggccggctatgcagtgattgtgcaggagctgctgatgctcacacttgcctcgccgaccgcatttcacatccagcagagtgaggcggggtgcagcctgctgagactggtttttcacaatggtaatgaaaatcctgccctgcgtgagtgatgggagtgcgacggcgcatgatctcgtgccgctgcgtgcctcgctgggaggcgaagggtgctgtggcgggctgtgctggaaactgtggctggggcccggtggtgcgtgacgcagcctgtgcccttctcagtggtaaacgccctgcgtgctccgggcgactgtgtgcccctggggtgccgtgtgcggaaggtgtggtgggtgcgctgctgcaggaggacgacggggcattacggcctactacaaagtggccgccacctgggggtatcccccattccccgaactgttgcccgagcgagccacgggagatgcacccctcctccttgtgacttgcgtgacacggggtcgtggcgcccgtgggccaatatgaagatggaggacttacgttcaaaggccagcggggatctttcacaagggtttatgcagacgcggggttggcaagcatccaaggtgcacagggggattgtccccagctagccgaggtaatacgtacccggacccgcttatccgtatccgcatcttcgggccctaagtacagttccgttccgatgtgggttacgcatcgtgaaccccagaagtggctgggagtccccggtggacaccgcagaaagatacggtgtgtaagggacgcttggacaaagattcgcagggagagccgttcgctcagatcccataggtagagtcgtcgaccaccagagggaacgtggtcgaatctacagacgagcttgcgcgagacagcgtcgaggtgccacgcggcaccacaggggcctggtgagaacgcgccgggggttaagcacgggtgcagctgcgcccgagtggtctccccaggagagccggctgagtgcagagcggtgataagctaccccggacgggcgggtaagaggcaggcgacccgtgtggggcaaggcgccggactgcgagcttaccagagttgagtccaagcgtcgggagcggtggg

SEQ ID NO: 584824 - DNA, 203 bp, Homo sapiens
agttgagaaaaagaaggaagaggaggacgatgaggaagatgagaggatgaggaggaggaggaagatgaagaagatgaagatgaagaagaagatgatgatgatgaataagatggttctagcgcagtttttgtttttctgggtctataaatgcatttaactcccccgggtacacaatctcactcctatttaagagaaaaaaatgg

SEQ ID NO: 584825 - DNA, 117 bp, Homo sapiens
ggctctcattgtggttttgatttgtatttccctaatgactaatgatgtcgggcaccttttcacatggttcaggatgaacttttttaaatataaatctgattctgttattccttgggt

SEQ ID NO: 584826 - DNA, 152 bp, Homo sapiens
tgtgatttggctttcccgctgtctttcctggtgatgccttagtcggggtactgtgggtttgtggtgggaacgacgggccattctgtcctagatgtagcctgctatgctctccgaagggccctgcgtggcctgtgcttgtgtgagctgtgtgg

SEQ ID NO: 584827 - DNA, 567 bp, Homo sapiens
cctaacccaaggtttcccaaaaatcagtcccgcacaatccattgtggctttagggggggcgtggtcacggcggaatgattgattagttttggggctgggcgtttaagttttgcttgttcgttcttcgatacgcttcctttgtatgagtctagatttctagcgtgtgatttgtttctgggtggcttcctttggtgtttcttagggaacgagtttgctaacggcgcgttttctcggtttttatttatcgagacggatctttctctttcgccgttaggaagtggtttcttgaaatgcgaggttcttaattaatattttatttcagttttctcggcgctttgcttatttcgctctgctctatgcttgcgtaatttctagaggatcgagtacggtttttgtcttttctcctctatgagtggaataatcttttcctctagtttttttttatggtttttttcgttgtctttagttttctagggtttaggtgtaggtatatgaacttttcttgttgaggttcgtagctgctatgtcgatgattccgggtggggcctttcccttcgctgacgtgct

SEQ ID NO: 584828 - DNA, 235 bp, Homo sapiens
aggagtccgttttccgatgcttctcccgtgcgcttttcttgtttttctgtttttttttcttcttccggagttgccacttgcatgagactgctcgtgagggcactgtctcggtgtcatctccgatccgtcttgctctctgtgtttccacgcgtgaccccattcctattgttccctgagtgccacagacgtctgtgtagcgcacagaccagacctcatccccagttcacctacaggg

SEQ ID NO: 584829 - DNA, 285 bp, Homo sapiens
tttagaattttctggtgaattttattctttttgatcaagcagtattttaagttttctatggcaagtggatgtatagcttatgtaataacagcaattacagaaggggtgtgggagaggccactgccaccagaagatccttacagcttttatttctaaagggctgctagacaagggacagctcacagctgtaatacacagaaaaatcaaactcatctttcagttctcagaaggtccagatacttcttgcactttgtgggcacagaatatacttctgccctctgcaag

SEQ ID NO: 584830 - DNA, 363 bp, Homo sapiens
  misc_feature (284)..(284): n is a, c, g, or t
  misc_feature (341)..(341): n is a, c, g, or t
ccacaatgcaattccacaccatacacactaagatagctgtattcaaaaagagagacaatgccaagtgttgacaaggatttggaaaaactgggtccctcatgaatttctggcgggaatgtaaaatggtacggccaatttgggaaacagtttggcagttctcttcaaagtcaaacataaccttgccataggatctagcaatttcattcctaggactctacccaaaagaaatgaaaacaagccgggtgtggtggatccatgcttgtaatcccagcactctggaaggnccaagggcaagaggatccacttgagggccaaaaagttcgagacttagcttggggcantcatagtttagaccctgtctct

SEQ ID NO: 584831 - DNA, 417 bp, Homo sapiens
acatgactgggtctagggcacccaggctgattcagctgatttcctaccagcctttgcctcttccttgcaatgtggtttccatggggattttgcttcagaaaagccaagtatgggctgttcagaggtgcacacctgcattttcttagctcttctagaggggctaagagacttggtacgggccaggaagaatatgtggcagagctcctggaaatgatgcagattaggtggcatttttgtcagctctgtggtttattgttgggccccctctctcccctatccattgctgaatccagtgatgattttggttttaaccgtgttccatccgcatgcattgctttcatttttccctcgccgctcagtatatgagcgcacaatgtaggtaatgaccatctcatatttaattaaatggtatagtcg

SEQ ID NO: 584832 - DNA, 188 bp, Homo sapiens
gcatgaggctccgtggacatgtcacgagtcagcatcatcttggctggtggcccacttcacctaggaagaaggaggtcttccccatcgccgggaagcagctgttgcagtcctcatataagccccggtctccagccgctaagatcaccaacatcccgtcattacacagctgctgattccctgagacgggg

SEQ ID NO: 584833 - DNA, 1085 bp, Homo sapiens
acctccctgcagcgccaagccggctccccaacctggtctgctgaacgcaaaccgcatgagagtttgctgcacgcgccccctggggcccccgtggctgcctgagtccctgctaatggcaaagacgccagcaagcgaggaagcgcagcggaagaaaaacaatgcgggcgcgcgaggggagccgccatggagggcttgcctgagttggcattggcatgtgctggctccctgccctctccctggtgtggcctctgcctggctggctgactgtgcccggatggactgctgctgctcctgaaaagttagactcctgtgtgcggtgtggtgcgcatacgccgacgtcccctcgacgtaccccttcctcgctgcagactccggtgaaaggaactatgtaaccttcggacccaggataggggagtgtgccagcaggggaccgagggtggggaacagccagagggagacgcgaaccaggccgcatggcgcgagggctcagggggagcgcagaggcgacggcccccatgccggcaggcaacactgatggagaaccggacgttgcccgaaccatgcagggtgcccgagaccgacaagagaagcgccacgaaggggcagacacggacatggtcacagaatacagacgaaccccacggctacgacacacggcgcaacaagatgcgccgcaatgaagaacgtacaggagagcaaagacctgggagcacccgcggatggccgcgggaccatggcccggccgtcttgagccccccggaaaaggaagttccctgaaagttcgcaggcatcgaagatcacagccactcaagcagacagagagcaccccgatggacaactggcccaaccacaaggacgaccgatgacaaaaaacatcaccacgacggtgacgaaaagagaaccgaagaatcaaaaaacaaaagcggcgaaaaagaaacaagtcaaacaaaggaaagaccatcaaccaccaccacaaacgagaacgcaaacagacccaacggcagcaaccaaatgctactaaaaagacccgaaaataacaggcaaccaaaacaacaccaacacaacacacaagagcaacacacacg

SEQ ID NO: 584834 - DNA, 112 bp, Homo sapiens
aacatctgtaggaacccagaactgggatttccctgagtttcccaaatcacctgtgtgacctgtttttgccctgcttgctaatggtttcttctaataaatgtttacttatata

SEQ ID NO: 584835 - DNA, 375 bp, Homo sapiens
actctttcaataggaatagctatggttcataggatttatgggtaatctatactgctgtggtatcttgggagtgatagctcctttagatattttatcttctgttataacccttacaaataacacagtttattttcatgaggcttgaaatagccatagctaatttcaaaagaatttacttcctgtggttgtaatactttattatagaaagtactgtacaaagaagttacagtttgagtgacagttaattctcacatatgtataaaatatattccatgttaattaacttactattttttttcccttggcatagtgttatgtaccatgagggtagacttataaccattaaacattttaactttcttccataaaaaaaaa

SEQ ID NO: 584836 - DNA, 970 bp, Homo sapiens
  misc_feature (498)..(498): n is a, c, g, or t
gctgaacagagagctggcagaacagaaggccagcgaaaagcagcacatcacgttagccttggagaaacaaaagctggaagaaaacgcgggcgatttgactctgacagtagcagaaatgcattagaacatcacagaagtgaaatacaggctgaacaggatcgagatagaggatagaatgaagtcagagatgccatggaaaatgaaagtgagaacccagcttcgacgacaggcagctgcccacactgatcacttgcgagatgtccgttagggtacaagaacaggaatggagagtctgaatttgatgcatgaaccgtgtcgtgagaaactctcgtgaacagagaattacaagttgtcggtcgtcgtcagtcacagagcaaggttgacaactttactctggatataaatactgcctatgccagactcagaggaatcgaacaggctgtgcagagccatgcagattgctgaagaggaagccagaataagcccaccaaatctggnctttcagatggcacggcagttaaacgtacagcagtgaagacctcatctgcagaaagcacctagctatcccgctgggctagtgcggttgaggccatcaaagccaactgttctcgataatgaacttcacccgagagctttaaccgcagctatccctccgagagtccctgaagccgtggggtgtacagtgaagagacccttagagcccgattctatgcatgttcaaaaacgtgtgccgaagggtagcaatgattgatgaaacagtaaatagcttgtaccagtaccttcatcgtcctacctaacagtccctgagtcctaatacccaggctcagcaacgtgaaggccgaccccaagagctctggccctagagggatatatacaccctttacatttactgtgcgtaatgctccctattggcttgagcatgggagacagggagtatagagcaagcttggcaatcagtgcagagggggac

SEQ ID NO: 584837 - DNA, 118 bp, Homo sapiens
ttgtattttggattttaacaaaattgtccttttccccgctccacggggttccccggttttttccaccctgtggttggacgcccaggccagccggaaatttttaaccggccggttttta

SEQ ID NO: 584838 - DNA, 206 bp, Homo sapiens
  misc_feature (81)..(81): n is a, c, g, or t
gctctgtagcagacagagtcacctctctgatattgggaggacgaagtacaggtgtcgtgtgagtgggagctgctctgctgncagatgctaacctgacttggatctgctgctcggtgttgccactgtcccattacatttcccactctgtctgctgcattcctctgttgcgggtaggcttgatatcacctctaggatgtccgagcgga

SEQ ID NO: 584839 - DNA, 484 bp, Homo sapiens
ttgggggccttttggtcacaagtttttttttggggttttccccgattttggggaaaaccggtttccccccttttagggaggttaaaccgcttccccccccccaaccccccaggcccccgagttatttagggaggaaggggaaaagggccccatttgcaaacccccttttcccggggggtgggggattttttaaaaaaagggggccgccaggttttccccttggaaaaggggcagggggggccccccaattaatgtggggtaggtccctccttaggcccccccgggttttccctttttgttttcgggttgtattttggggggaatttttagggggataccattttccccagggaaaaggtttggcccttatttcccccaggttgaaaataaccccccttaaaggggaaaaaaaatgggggtcccccccgggggggggcggttttaaaaaaatgggtccccccgggggcaggaatttgggccggga

SEQ ID NO: 584840 - DNA, 776 bp, Homo sapiens
tggtaaaaagagacattaaatacttctgtttacaaaattcaggcgtacatttcagttggcccgggaccgtgcccaaagctgtgtgctcatctctgcgcccctcatgtacttctgacgaggggggtgcagggcagggcaaagcaaagccgtggggtccggaggcttcactggaccacagggggcaggggaatgtgaatgtggcctggcccagaaaatctccccatttacatccgattttggctttggggcagataaacggaagcaaatggtcggggctgcctggcctgggtctagaggaaatgcgctggggccatcttcccacagggtcgaaacgtggcacgcggtcctcacggcaaaggggacgcctgggccaccaggggtcttgggacatcgcgctcacctgggaacccttgggtggcttgggccctcgagacaagcgcggctgtgtgccccgtggtagagcgtgtcgctggagaggtgaggtcgtagggtgcgctaaggtggcgtgcgactgttatgtggccctagagtggactccgggcctccctggggtgggcacgggggcgcgttaaaaacacagccctgtaacagaggtctcttgggggaagttcacttgaaaggagccgcggccatttggagcaagcccacggcccctcttgcgagggaaaaaccagatgtttcctcggtggccctcaggacaagaatccccagcgagtggccctttgatccccgggagctgcaaacgctgaccggtaggccccggagaaagcggtgag

SEQ ID NO: 584841 - DNA, 271 bp, Homo sapiens
  misc_feature (15)..(15): n is a, c, g, or t
  misc_feature (122)..(122): n is a, c, g, or t
  misc_feature (168)..(168): n is a, c, g, or t
  misc_feature (193)..(193): n is a, c, g, or t
  misc_feature (223)..(223): n is a, c, g, or t
  misc_feature (246)..(246): n is a, c, g, or t
  misc_feature (257)..(257): n is a, c, g, or t
tgccgacccctcagnaatataaccctcatgcctgggacccctgagagcttctgatcccagctattaggggacagaagaagcctccaaatctgggaagggtgctgaatgccctggctggactngggaaagtttcaggggcactgtatgggggtcttacctgggttaagncggaagggcctgtagggaaacctgntaggctttcaattcatgttctgggtaaccnggctgcctgtaggccccaatctnggggttggtgnagggaaataggggg

SEQ ID NO: 584842 - DNA, 172 bp, Homo sapiens
ggtcgcatgatagtaacagtcagtgcggtgcagcccatgctaggcagggccgatgcagcaggtctcgatcatagcttcccacactccacacagactggagaggtaagaggctagggccgtgcacaggctggaggcgttcatgcagctgagggcacttgagcacttgctctcg

SEQ ID NO: 584843 - DNA, 251 bp, Homo sapiens
  misc_feature (246)..(246): n is a, c, g, or t
ctggagctgaggatgctcgtctgatgatgggacatgaaaacaatgaatgatgtcgttatctggaactctatgaccttaatagagacttgctacaattggatataaaattctgctgttacaagtcacacatgagctgttgggaaacctcataagcagtaaatcaatgcaattcaatagagcagtgtcgtctgcgtggttggaaaatcaaatgaaccaggttgatcactgtcattgtcgtggatgcanactcg

SEQ ID NO: 584844 - DNA, 275 bp, Homo sapiens
tgttggccaggctggtcttgatctgagttcctgaccccaggtgggtgggtcgcccgaggtcgggagttcgagaggagcctgagcaacatggtgaaaccctgtctccactaaataggaaaaattggctgggcgtggtggcgcatgcctgaatcccagctacttgggtgactaaggcaggagagtttgttgtacctgggaggtggaggttgcagtgagtcgagactgtgccatttcactctatctagcctgggcaataagagtgaaaactccatcac

SEQ ID NO: 584845 - DNA, 537 bp, Homo sapiens
  misc_feature (1)..(1): n is a, c, g, or t
nagtaagggcttaatcctgccattttatggcatattctggttgttttgtaactcctcttttcatccattttggactaatgtctatgtggttaagtcatttcctctgatagtatgttaattcattgctttttatttgtagtgaatctgtgctaggtatgtgcattttggccgccataaggcttacatcaaacatcacaaggtattttacatagatggccacgtatgttagctcgcaaagaaactattagaaacaaagattctaccactctaaatagcaactcacagcatgaatccctaaagttcacccctgcagcaacattagcctgtgagtgaagatctggttccggagcacaccggaatattgcaaggcatccccctataccagtacgactgttcgtttacgtaacgtccttacattctccacggcttcagagtgcgacacattgtccccctaggctgtccaagcctataccaatatctgcaggcagaatacaagtcatatagtccttccagcaaagggcttcaaaggcatgccct

SEQ ID NO: 584846 - DNA, 1059 bp, Homo sapiens
ttcctactcctcattgtacccattctaatcgcgatggcattcctaatgcttaccgacagcgaaacaattctaggctatatacaactacgacaaaggccccaacgttgtaggcccctacgggctactacaacccttctgctgacgccaatagaagactcttcatccaagagagccccataagagactccgaccatcatctaccgatcaccctctactatcaccgcccctaccttagcgtctcagccatcgctgcttctactagtgaaccccgcctcgcccagtgagccaatcgccctggtccaaacacatacaaccctttagaggcctctctgaattgttatttactgatgctcgagcacttctaagtccctagccccgaattcactccaatactctcctcgtggactcacgaggattgaatcgatcctatattgcgaaacagacagcgctcatgcagattcggctgtcactttgacctgaagctagttaaactcgctaaaagcatatctcctctgtaatgccaatcgatcgacgcccgtagggcccatgttccaggccctgtgactataacttcaaaacctacttggatcaatgatcgctaggccgtgcgggggcgttccccctcgtttacattaccttccttcacaatagcccactcctaatgcaaacctccgttgacccaaaggaaacacgaccaccattccttgcactttgtaccatccacagtggcacccaagttcggactgcgaaccccgccttttgagacccccaaattaccaatctcatctggccactgagcgcaggtccctaccccaaagcgacccttaggagcgacgacaggaacacccaaaggcgcggcatatgaacccgccctgtcgtttctaacgagaaacgcgtggtgtcccccggcacatggagtgagcgcaagaatctcgtgggaaaacacttatgacctccatctccagccagcccttcatccacaagacagagctcgggacaaagttgaacgggccaccagggcatggggtcgccccctggttgtacgggccccgcgctcaa

SEQ ID NO: 584847 - DNA, 206 bp, Homo sapiens
  misc_feature (35)..(35): n is a, c, g, or t
  misc_feature (85)..(85): n is a, c, g, or t
  misc_feature (89)..(89): n is a, c, g, or t
ctctgaccaaggccacctgtgccccccagcatgcncgaccgggtcctgggcctgctgacgccagcaaggtggtggccaaggctgngggntgagcaggctacgtaggcagaagagcagcttcacagtagatgcagcaaagcaggcaacaacatgctgctggtgggggttcatggcccaaggaccccctgcgaggaggagaagcagca

SEQ ID NO: 584848 - DNA, 427 bp, Homo sapiens
  misc_feature (162)..(162): n is a, c, g, or t
  misc_feature (186)..(186): n is a, c, g, or t
  misc_feature (188)..(188): n is a, c, g, or t
gaggaggaagagcaggaggctgacaatgacggttagaccgaaagaacgaggacacgaacggtggggacggaacgaggacggacggaacgaacgaacggttgactggctgacgcgaaacgaaggaactgggacgaactggacacgcactgaagggacacgccntgggaggttccagagcctaacggngngccaaaatgcggtgtggcagcctgaaacgactagactgacggaatagacgattgttcgaataaccccaagaaaagccagacaagaaccccgtgagactggaaggcgcaattgggaacccttaaaggaaaccccaaaggccaaaaaaaactaacaaacaaacgcgggcacaacacaaaaaagggtttttttaaaaaaaaacgccgttttaaaaacaacacaaatataaaataaaaaacaa

SEQ ID NO: 584849 - DNA, 752 bp, Homo sapiens
ctccgagccggatgcgccttcctttcctctccagagcaggctgccctgcccgctggaatcccgcagcgtagagcaacctcgcatgcaccctcagaacatgcccctgctgggtgctgctgcctgggctgccgcttggtgaccttatcctgactgcccctgaccccgcatcctggaggctggccgcgaagtgtctgcctggcctcctccctggctgcatgcctcctgtggcctccctgtgcacatcactacgccgctgggtgccctggaaacctgttttccggctctttcgctttcggctggggctgtggcggcctgctggttgctcgcgctagtgcctgggcctggtgctgcatctgaacatgcccctgttgcgtctgcccctctctgtgcctgccgccctgggcctggcgaaactgttgttcctggtggacctgtgtgcgcacccctgcagccgggcgagctgctgcccagtgctcccgcgctgcgcggcaacctggtgccggctgctgcgttccgtctcccctgcctcgccccacccccccccccccccccccccccctccccgcccccgcccccccccccccacaccccaccccccccccccataacacacacgcctccatcccctcccacctcccccaccaccaacatcataccctacaccaactcacactcccaaaatccctccccccacaccacccaccccaaaccccaccccccctcccccaccccaacccccaccccacacaccc

SEQ ID NO: 584850 - DNA, 209 bp, Homo sapiens
ggggggggcccccgtttttttttccccccgtgaccccctttttttaaaacctagggttttttaccaagcttttttcccggaattttttttttttgggggccccccctttttcccccccccctttttttattatttaaagggcccccccgttgggggccaaagggggtcccccttttttttttttccctaataaacttttgggtttttta

SEQ ID NO: 584851 - DNA, 341 bp, Homo sapiens
  misc_feature (7)..(7): n is a, c, g, or t
gttcagncaacgccaacataatagctgggtttagaggctgtgtgactaagcctagtctaatttttgtattttaagtagagatggggttccgtgctattggccaggctgagtctcgaacacctggcctcaagtgatccacctgcctgggtttcccaaagtgttgggattacaggtgtgagccaccatggttggccaagagttctagatttattcatcctgcataactgcaacttggtattccttgacataagtgtcccctactcccagcatatggtaaacccaactttctactctcttgttattatttattagagaacatgtaaaaatcatgcaatagcttt

SEQ ID NO: 584852 - DNA, 132 bp, Homo sapiens
ctccgtctcaaaaaaaaaaaaaaaattgcctatcaggctgggcgctgagtcttgcccctgtaatcccagcgctttggaggcccgaggtgggaggattgcttgagcccaggagtgcaagacgtatctcttaaa

SEQ ID NO: 584853 - DNA, 152 bp, Homo sapiens
catggtattttcttctcttctggaaagttctgggcttgtagacccctcccctccttggcaaaggtatgggatagaggggtcagatgcagatctctactggtaaaatggggctcccgtggtatctccttgtcttccctacgggctccaaaccc

SEQ ID NO: 584854 - DNA, 433 bp, Homo sapiens
  misc_feature (104)..(104): n is a, c, g, or t
  misc_feature (124)..(124): n is a, c, g, or t
  misc_feature (143)..(143): n is a, c, g, or t
  misc_feature (147)..(148): n is a, c, g, or t
  misc_feature (163)..(163): n is a, c, g, or t
  misc_feature (334)..(335): n is a, c, g, or t
  misc_feature (343)..(343): n is a, c, g, or t
  misc_feature (367)..(367): n is a, c, g, or t
  misc_feature (375)..(375): n is a, c, g, or t
  misc_feature (414)..(414): n is a, c, g, or t
cagcggtcccgctggaccccggtcatcaaggacgatatgaagacccccgtggaggaccggttggacagaaacttgtggccctttgtatccgaccccgcccccanggcagttccaggccgctgtnagtgcccgtttgggtcttnggcnnaagaacaaggctggngtaaaagcccgggggggcccccggctctttgtgtatgtcatgggcggtgtggccatgtcaaaaatgagggccgcctacaaggtgaccagggcccccgagggcaagtggaaggtgctcattggctcctcacacatcctcaccccgacccgctttttgaatgacctgaaggcnntggacaanaagttggaggacattgccctgccntgaccccnggccccgccccctacccctccctttccagagaaataaanttttcccgtcgttttgcca

SEQ ID NO: 584855 - DNA, 152 bp, Homo sapiens
ataccagacgctgagcagatgctagacaccatgctacctacacagctgcagaaacatgagccagttaaaccactatataaattacccaggctcaggtatttctttatagccatgcaagaatggtctaatgcatatgctcattgcaacatctt

SEQ ID NO: 584856 - DNA, 316 bp, Homo sapiens
tgatatggagtgggactaacaagaagaacagaaggatgccctgcctacttaaagctgaacgctgacgttaattatgttatgtaaacaattacttccaaccacataattcgtttttttcaagcttcattctgtaaatcacctgatcaatattgagtttttctgctttagagatgttttaggaggggaagggaaaaaaccaaagcactaggctaaattattaaagacccatgagcgaggcgacaaacctaccgaataaagactagcatggacgaagataccgttatagaagaaaaagcttagacagaatttcaaaggt

SEQ ID NO: 584857 - DNA, 564 bp, Homo sapiens
gaccatgactacggctgcacgcctggtcgttcctcatgagctacttcttctgaacagttatctatacctcgctggttgctcagccacaaaataaatgttgggagaaatgatatataccactttcccagaaaaaaaaaacttacacttgggacttggcaaattcctaggcacaatttttttcagcagtaacaggaaaccacttatcacatggagacctaatgtaataatagaaaaatactcatgatagggagaaaccaagagaagttttgtttttgtttttttccaactgtgttcattagaacagcgtgttctaagtatttgaaactgaatgtttattccttgatactaaaagatcttctccaatcctatcactgatagtgtccaaattctcaccagattgctcctaagcttcaaatcagaagcagaaactggcaggccatggaccttaattgtccctcaggtagattttgtttggtatgcagaatgtttttaaaatatgagtgggtattgaaaatatgatgtttcacataaaacctcattctcggacccatctttgctcatggc

SEQ ID NO: 584858 - DNA, 981 bp, Homo sapiens
agcacactgtcgatctacagccaatactaatacctacgctccggtggtagtggggccatctcttttagaagagtacatgccccgcactggtggttcccccccgggtataatcccgggtatacctgcgcgcaggagtggtgtgttcatctccctcggcgcggcggttgtattgttctcccccccctggtggtgtcataatcactcggagaactccgttttttctaccaagggtctctcctggttctacatgcggctttcgcccccccctcttgggggcgcccctatggtcctcggggtattctaacgcaaacaacggggggtgcccttggcccacctggcgttttgtggggcccagggcatgacaaagttcctcacgcgccacgactgggctggaacgcgtgcccttgggggatgcacaccaaggggggacttctgtccccccgaggcacacggggattcaagccggcacactctggtcgccggtggcgaggccgccattcagaaaatctgcttgcatgtacaggaaagaagttcacgcccccttaccgttggcgcgccaccagtgtttgccccccgctggtgtagtgccactgaagcaaacggcacggccgggttggtgcggaaaagcccccacaatatttggggaggaatactctgtgcggttacggataaaaaattgtactcaaacccttgttaagcaggaggcaacaacttcggttatattttgggagaaagatttataatcgccagggccgcctcagagtgctgcttttcttcggggagtaatattattgagaactcgctctcgtggtggtgaatatagaaaatgtgacgtacccagtagattggagagggtagagatcttaacaccccggtggtacgacaacgataaaacacataagttgttccaagtccttctctccaaagaaataaaaaagggaaaaaaaccaacgaaattttttggaccacccccacaaaaca

SEQ ID NO: 584859 - DNA, 163 bp, Homo sapiens
gggacaactgtacgtttcgaagacccaccccaccaatcactctggagaggcaatgtgtgcagcctctctcttaagtgcaccttagagaggctttacgctgtgactggctgcaagcaggacaaccgtgagcagcattttgcttgtcgaaggcacaggtcctcgt

SEQ ID NO: 584860 - DNA, 1228 bp, Homo sapiens
  misc_feature (1228)..(1228): n is a, c, g, or t
gtgctcgcgatgtgtatccagtaattgagaatgaggtgggggtgtggccattcaggcagagaggctcagtggtagcgaggtgcgtagaaagcggggatggagctcgttcaatcgtcatgcatatgctgatggtgcatcggtagccagtgatgaatgggccatggtgaaacggagccgtgtccagacaggacacttcatgcggacgctgatattgcctgcgactagtccgtggagccttctagcccttagttccatctgtggcctgagctgtgtctttctaatgtcgctggtgcatagggcaacttttttccctcattgggccctgaggctcgtggccacatgctggctctcctcaagctgatcatccaagcgatttcctgtgtactagctcgttggtgcctgtgcccattggcaacgcacgtcctggttggtcctgcacatcgcggctcggttgcacataccgcctactttcgcgccactcctccccatagtctttctagatctctagtgccttcctagttgtgtgcgcattgtatttgacttcgtttagcatcatctatatattccctcgtgggccttcgcaacgttactgacatggcctttgccagtggtttaaacccaccgactctcggggttggcccacactccccaagttaatttcgttctattctgcccatgtgcaggaacactgctctcaatgttctgcgatgactcacccttggtcccgatggttctcgacatcaggcgccgatttctgctcggtgtggatctcctggctcccttcatctactgactgctcgcgcctttcgggcgccttctttccctttgctatctcctcgtggctctccctgtggtgcggctccctgtctggtctccgctgtatatgcgggatgtccccctttttttctttccgtttccccttggggtgacggtcgggtactgttccccctcatgtctgttcatctttccctttccgtggtccggtatatctttcgggtcctagcgttgttcctcgattgattcacatcgtccacatctgatgtaagtgcatctgcatttaactcacgtggttctctcctcagtcgttgctgttcgcctcttgtgattgatgtcctcgctcggtcattttttcgctcccctgttgtgttcatcggataggggtgacactctttttgggcgtttggcgttctgcgcatatttcctcccccatataggagtctcctggcgn

SEQ ID NO: 584861 - DNA, 448 bp, Homo sapiens
catcatggggttctggaatggagccacgtggagagcggcaagcgctcccctgactcccagagcccactgagcctcccgtccatccgtctgtccactagactattcagagagggctcacagggaccacacatgaagcaccttgttgctcagccacttggctgctccagttccaacccgggcagtgcgcagccccactcggggcattcccgcctgctgtatagccctggctaacacctgccacgtgctgacgggcccttgggcggatggctcgacgacagctgtttgcagagccttgtgggacatcccagaggtatcccttgaccctaaagcttgggctccgctggatcaagggtgaccttgagctaaccggttccccagaagagcttggactccatccgctaccattctccacgtgagctggccaagtgagactctgtgcaaagcctcc

SEQ ID NO: 584862 - DNA, 881 bp, Homo sapiens
  misc_feature (217)..(217): n is a, c, g, or t
  misc_feature (296)..(296): n is a, c, g, or t
  misc_feature (435)..(435): n is a, c, g, or t
  misc_feature (452)..(453): n is a, c, g, or t
  misc_feature (497)..(498): n is a, c, g, or t
  misc_feature (507)..(508): n is a, c, g, or t
  misc_feature (583)..(583): n is a, c, g, or t
  misc_feature (586)..(586): n is a, c, g, or t
  misc_feature (810)..(810): n is a, c, g, or t
cacgatgtgctgatctggggtcggggagcatgacgtggtcggtatagtacacgcgaaagtaggccgcgcggtagatgatgatgccctgcacggagacgctgagcccatggtccaggccccgtatgctgtcggacttggtggtcgtcacccagacagttctcgcgaggccctcgggagctcagcgactctggtgcactgacgtattgctcaccgtccnagctgacctagagcagggattcttgactgataaatcctagccgggagtactacgaaatgcacgagatgatggttcgtcngccagtccagcgacctgccgtgagtgccatgagttggcccagcagaaggtaccctcccagatactagcgtggtggcttggtccatcggccgccccaggaatgatgctggctgtgtacttcatcccttgaagggcgaagnttgagggcttgagtggnnggaaggtagcgaagtgacggttggcaaggttgcccctgccagannaggacagcnnacgcccgtggctcccttggggtatgcgggacaatggcaggtccaccgatggccctttgtacttgcttggtcgggncgngcgatctgcccttgctggcggtgcatggacctgcagcatgcagcccttgacccgctcgatgcgggaggccacgggccgtcattggagatgggcgggcgggcgatgccctccgggccagagaagttctttgggcgaaggagatgcgcctgttccgtactatggtggcagggcggggcagcgggaacgggaggtacagccggagaatcgtggcgcggagagtgaantggagaggcgtcgctgggctcagacccatgcacgccgctagttctagatcgcgatgcgggccgctctatgt

SEQ ID NO: 584863 - DNA, 413 bp, Homo sapiens
tgtactcaggccggggcacagagtgggactccatcttaaaaaaaaaaaaagtatggtaggcggggcgttgggtagctcaggccggtaatcccacaggtaaggagggcgaggcaggcagatcaccggaggtcaggaggcaagaccagccgggccaacagggcgaaacccggtctctacaaaaatacaaaagattagtcgagtgtggtgtctcgtgcctggtgtgtgtgtgtgtatgtgcatgtgtatatatgtgtacacacacacacacacgtggttctggcctggcacagcccagtgacaacctgggccccactctggtccctctgatccattcaagtcaggaatctgggtggtgtttgggaggcttgggggtcccaggttcatccatgatacaggtgggtcgccaaggggta

SEQ ID NO: 584864 - DNA, 311 bp, Homo sapiens
taaacaagtatgacagtcccacctacaggtcatttttaacgccaccaccggcatgactttcaacgaagtgagtttccaaaatgtttaacttggcctggcaccatggctcatgcctgtaatcctggcactctgggagactgaggcaggagactcgcttgatcccgggaggcagaggttgcagtgagccgagattgcaccattgcactccaacctgggcaaacatagcgagacttggtcttaaaaaaaggaaaaaaaaaacggaacggtttcttgcctctgtctacacgcacaggaggctggcctgatgggag

SEQ ID NO: 584865 - DNA, 161 bp, Homo sapiens
aaaaaaaggaatttttttggggaaaaaaaaaaacctgccaaaaaaactgggggcaaagtttggtttctcaaaaagttttttttttttcaggggttttgcccccccccccttaaaattgttttaaaaccattttttttttaaaaaaaaggggggcatttggc

SEQ ID NO: 584866 - DNA, 137 bp, Homo sapiens
cagggagaacacatagttagcgaggcaggcggcgacagtattattgatgaaactctgtctctactaaaaatacaaaagagattagtcgggcgtggtggctggcgcctgtgtcccagctactcagcaggctgcaaaca

SEQ ID NO: 584867 - DNA, 448 bp, Homo sapiens
  misc_feature (357)..(357): n is a, c, g, or t
aacccctgcgacagagaaggggactgtgatccagagactcagaataaaaagatccttcccttctatgcaggggggcaagtttactggggggttttgatttgggcctctcttccacaagaagctaaaggaagagaaggggagtgagagttcagggaggcccttcctaccctgtgaggcttgacttgatctggattggggatgacaggaatctcaccctctggggtgctggcaaggaggtctttgcacaggaaaaggggtagctcatttcagtttgttttttctttaaattgaatcctcaagtcattttctgttcacctgccgcacagggacaagcttgacttctattttctgtgtagngaaaacaatgtcatttatttggtttttcacctcagccctctcataggagcatagaatgttagggtctttactccctaatgatgtctgattg

SEQ ID NO: 584868 - DNA, 679 bp, Homo sapiens
actagattctagatcgcgagcgggagcggagagcggaccccagaagagccctgagcagccccgaccgctcgacgccggcctaagttaccaatcaacaccccgaagaggagccgcagcttgccgcagccggacccgagtcaccatctaccgacaaccatgagcagcgaggccgagacccagacagacagcggatggacgataacggatagagagacgatcgcagaggagtacgtcataagagcgagagcgcccgacgaacataacagtaaaagaataaagaataccgtaaaaatggaggaacaacgcatcagagacagagcaaggactaaagagaaggagaaaagagaggcacccgcgtggagacagaagtatcagagcgagatgtccaaataattcgcacagagagtataaatggtatatatagatcgcatctaaaacattggggatccaaacaacgatatgagagacaaacacagtcaacactcacgctaggggtagggccaacaaccacgaacgcaacattcaccagatacaactatggcaaacaccacgtaggaaccagggggtaagggagcaagcgagagaacgccagcgagggagagacacagagcaaagcaccaaccaatgacgcggggccccagcgcgacccattgactaatataaggagaaggggagcaag

SEQ ID NO: 584869 - DNA, 124 bp, Homo sapiens
gggacccgcctcgggcttcggcgatggctcctcggaacgaggcccgcggctctctggactcggccagacaccggcggcgcgcaggagatagcccatcgagctctcccggcagtggcggcggccc

SEQ ID NO: 584870 - DNA, 135 bp, Homo sapiens
gtgaaagtgaacccaagcctgggaactgcaggcctagacaatgcaggaaatggcttgaacctgggaggcagaggttgcagtaagccgagactgcaccactgcactccagcctggtgacaagcaagactctgtctc

SEQ ID NO: 584871 - DNA, 425 bp, Homo sapiens
  misc_feature (425)..(425): n is a, c, g, or t
tctagaggtcccccacgccgcacgagcggttcaaaggggggttgtctctggcgggcagagtcggggtcataaggtgctcagtaggggagcttttgagccaggatgagccaggagaaggaatttcacaagacaatgtcatcagttaaggcaggaacaggccattttcgcttcttttgtggtggaatgtcatcagttaaggcacgaaccggccatctggatgtgtacgtgcaggtcacaggggatatgatggcttagcttgtgctcagaggcctgacattcctgtcttcttatattaataagaaaaataaaatgaaataggggtaaagtgttgggacagcaaaaatttttgggggtggtatggagagataatgggtgatgtttctcaaggctgctttgaaccggcggtgcggcgtggggtaccgagn

SEQ ID NO: 584872 - DNA, 104 bp, Homo sapiens
gcctacagtgcagacagatcctgaatcatctgttgcgacagcagcacatgcgtatctcgcaaaagacctgtgcacagggtgcattaaagaatgcacctctaatc

SEQ ID NO: 584873 - DNA, 351 bp, Homo sapiens
taacttccttttttttttttaagaaaggaaaaaaaaaaaaaaaatcaaacttgaaactttttttttgatgttcctattgtgggggttttggatagggtgggacagggatgggggtgtgtttaaaattttttccttttcagcacaacctttggttttaatataggaagagccaagggagtcctgggttgaacttacgaaatttgccccaaacctttgtaaccccaattgaaatgaggagcttccttttttcctgtgaaggatatgccagtccagcatcaatgcctgtgccctttggaaaaatttcctcctagcccttccagggccttatcataaaattttggatttagagta

SEQ ID NO: 584874 - DNA, 1032 bp, Homo sapiens
gagtgatcgcaagtcagaagacaggagctgcagaacagaaacactttcgtcatgtccaggggtcagattacaatggtgaacctattgatttatgttgagtaatggtaatgcatcagattaatttggttgactttgttagcactgtattcttatcaatgtttattgtaaaggagtctgttgagtgtgtcggtcaacatgaatctgatttatagaatttcatagtgcagatggctatgtttgcaagtgtacacgtgccagtccaaggcatacgagttatctctaaatctatctaatgttagctattctgggttataatatttaagagtggatttcataaagttctattaaagagaatttagagatgtgttataatgtaattgtatggaactaagaaataagtacaaggttatgtggcagtgtaacttctggtgtactatataaggttaggtgagacagttagcaaataatcacgttagattacgttgaatacgattaataaccagtttaatgagtaatagatttgaatgtcactagatcataggatccattgaagcaatttgagctcataatacacggcttgatctcaaacgttactttacagttggcttgactaaattcatgtagtgcacgcttgtctcttgcagatcccccagggatgcatttgatacggtcagaggctaacgttccattgggtgaagacacccaagcatggtcgatgaactgttgtcgaattactccactaatgaacggaagcctattcattcgccattcttaaagctgaacacttggaaaagtacaccctttattgtataccttggagataatttctaggttcccaggggccccagcaaaatgtgtcaaattagccatcccacgctccaactccagcatgtgggcggaaagtcggccagtcagggatatatatacacaggtttttaccaagggctatcatgtttgcacaacacccatgcgtcactgggcatacgacatagctgggtaaggtgccatgtcaaacggtccgtgaagaaggcc

SEQ ID NO: 584875 - DNA, 427 bp, Homo sapiens
tgcttgcccaaaaaggtgctttccttcaaacggtgcagggcctgggccaaccttacaggtcagtaaactaaactcgactacttggggtcagtgatttttttgtaacgagtctttcatgatgtgacttttaggccccaacatgacaacccctgggcccccgggacccaaaaaaacagccccctgccccattttttggcacaggccattccgagggcatgtccctgttgccccctgcattattaatgaaacccccggcccctgccacgcatgttgcacctgtgccatcgtgctccctcctgatgggccccgtggtggaggaagtcacccaactgtttttcagtcccaaaggccggtggctggttttgaacttgtgttgactgttgaaacttatttactgtataaaaataatttatcatttgtcccatga

SEQ ID NO: 584876 - DNA, 1659 bp, Homo sapiens
gagtgtccagtacaatggataaaaataaatccattatcaacacatcactaacatttcaaaatcttcatggagaagattctgtaagtttctggggagagagagaaaaaatacatcacatacagaggatcacttaccaggactgctttgaacttaatagcaatggtaaaagcaaacagacaagcaactacttcaaaatgttgaaaagaaaattatttccagctttcaattctatactcagacaagctatcaaacaaatagagggagccagccatttttagacatccagggtctcatttaccttccatgtacccttttcaagaagttaggatgtgctccacagaaacaaaaataaaaccaggaaatggaacactttggaatgtagaaaatgggataatcaacatagaggataggcaagaggaatttctgggagcatggtcaagtaggattccagcaccacagttgtgcttcttgatgtagagagcagtcagtccagaatcaagcagcatgactcacattgatggctattatcactaagatccctgctgccattgtatcatctttttaatctgaggacattatgcccaggcaagcctggctcagattcttaccggtatttgccttgtcttgaccatgtggtgatgaaattcctgctctcttctgtgctgtgctgactggaccaactgaggacactcatttttacccttctttttcaacctattcctgaaagctgatgttgggcgttggtgagcttaaagcagaaaatagccttcctccttcccatttttgctatgtattggccagaaatcaggtatcaattctacactttgatctttccacatgcttcagttgtgaggagcccagtattcactcatgacattgcaaattaacttctctaggagggatccagaaagcctggagaaggtaaagccagactagggctgtttggctttaattaacagcagcattgttgcccttttccttgctagattcgtgcttgctgctcaaattgccaaaattaaatatttagggcaatgttcatgagtgctgggaaaactaaagagaataagcaggaagtcattagaggctatcttggtagagatggggaaggagaagcaattggagaggggcacatgggggcttctaagacttttgtttcataacttgaatgatgggtacccagatgtatattttactttaatttgtacattcatattttatgcagtttctatgtctaatacgtataaaaatttcagattaaatgaaatacatgaaggcactggcaccctgcctttcaaattgtaaaaggtgtaaattttgcaaaatgcctaaaggggcaggtgaggtcacaatgagaatctacactattgtacttcggggttcaacccaaacagaagttaacaggagaacttaaattatgtagcgcatgatttttaattgagtatggtactgtaattttaatccacattttctgctagttaactataaaataacccttaaaactgatctaaaagcctattttaaaaatataagttgcggccgggcacggtggctcacgcctgtaatcccagcactttgggaggccaaggtgggtggatcacaaggtgaggagatcaagaccatcccggccaacatggtgaaaccccgtctctactgaaatac

SEQ ID NO: 584877 - DNA, 397 bp, Homo sapiens
  misc_feature (25)..(25): n is a, c, g, or t
  misc_feature (93)..(93): n is a, c, g, or t
  misc_feature (96)..(97): n is a, c, g, or t
  misc_feature (122)..(122): n is a, c, g, or t
  misc_feature (135)..(135): n is a, c, g, or t
  misc_feature (302)..(302): n is a, c, g, or t
ttcgccgaagtccgcggctcgaagngcatcacgtcgcttcccgtcgccatgaagtggatgtttaaggaggaccactctctggaacacagatgngtnngaaatccgcgaagatcagagcgaantaccccgaccganttccggtgatcgtggaaaaagtctcgggctctcagattgttgacatagacaagaggaagtactttggtcccctcggacatcactgtggctcagttcatgtggatcatcaggaaaaggatccagcttccctccgagaaggccatctttcctgtttgtggacaagacangtcccacagtccagcctaactatgggacagctttacgagaaggaaaaaagatgaagatggattcttgtatgtggcctacagcggagagaacactt

SEQ ID NO: 584878 - DNA, 648 bp, Homo sapiens
tacgggacgtcgactcagagagaaccaccatggtgctgtctcctgccgacaagaccaactgtcgaggcggctggggtatggtcgttgcgcacgctggcgagtatggtgcggaggccctggagaggatgttcctgtccttccccatcaccaagacctacttcccgcaacttcgacctgagccacggcttctgcccaggttaagggcctacggtccagaatggtggcctgatcgcgctgtaccatacgcctgtggtcagcacgctggactgacatgcccaacgcgctgtccgaccctgagcgacctgctcgcgcacaagcttcggggtggacccggtcaatcttcaagctcctaagccagctgacctgactggttgaccctggtccgtccaacctccccgacgagttcaccccgtgcggtgcacgcctcacctggacaagttcctgggcttctgtgagacacctgttgcatgaccttccatacatactctggataagcgcttggaggacctctggtaggacagttgcttatctttgcgccgcttagttgcccatacccgttgggtgccgtgggcgcctcgcgtcaagcgtacatcagtagaagcgtagcgaagtgggtaagttcgccagcagttggcacaagctctcgcg

SEQ ID NO: 584879 - DNA, 211 bp, Homo sapiens
atccccccctgtgtgctccctgtgtgctcctgtgtgctccacctccccgtctcgcctgccgcgccgggcagtgtggagcaagagcgcacgtgttaggacccgaaagatggtgaactatgcccgggccagggagaagacaagagaaaacctctggtgcaggtccgtagctgatcctgacgtgccaaatcggtcgttccgaacctgagatata

SEQ ID NO: 584880 - DNA, 1975 bp, Homo sapiens
  misc_feature (281)..(281): n is a, c, g, or t
  misc_feature (326)..(326): n is a, c, g, or t
cttgtatattgttctacgagctacatatactgtcgtacatatctactagcaatggtacgtaattcatgatctgatggggactgcatagcatagttcgtagataggtgcctcaagtaggcaaagctctgcgtcgtagtggaccttcacttgttgcgttaattgtacaatactcaaggtccttatgtcgggacatggagtaagcaatcgcgtgctgtcctgttgggtctgcatcaaaacaggttggtgagttccataccagagcaaggctaattcagtgggcntagccagctgatcgggtgaacgtataataatgctaagaatattcnacttgatatccacgaaaatggcatgataatgcaactgagtgttcgtaccccaagatagggcagataatacatgataccttacccgacatgacacggatgatagctgatatcagtgacatactaacatctacacactgcagatgtgtgacagaatctgtaactcatcacacagcgacagccacagtggggggcctcttactctctgatttgtgggcacagcaatcacagtgcacagcgccctatcagttgacgtggtaggtaagaaaaaactgaccaattccagaggcagagcggaaatcttccatgagtttcttagaaggcaattggatattgcgctcggctaaaagcccgttaggttgttgctcagtggctcaggttagatcccataaagcggttcacactcagtgggaaacacctctggcaactcgtacacccttttaatactttactcccttaatggtcattaacgccgggatttgcattggggaacccatataattggcacggcacattccatggtggataattccataagacgtgggttccagagagtgcagcgggggctgtccatgcgcggacaatacttcacaggtaacaatcaggtctccgaaacaaataccaacaggttatgttatcacacgagcgaatcggacaacgtggtcatttgcacttccatacaggcgccaattcacagtctcatcagtgtcggcgtgaccatgttgcgtaacctccctgaaattggggtttcattaccatggtaaaatatctacacttgggtcaatgtctatggattttccacgagccaaggggggccattcgaagttgcaacatttatcagggttcccttccatataacgtccacagaataatataccccatttgcgttacttgcaacctacggttacacacggaaccggtgtatagtgtcccccatgacaaacgtgataagtgacgcttttaagatgatgaacctccatatcaccctgtatgacgtgataagtcgtttccgatgagccacaagctgtgggcatttgggacgaacgtgtctcatgtttatgccacgccccttaagttgtggcacttattgggcacataacgactaacgatgacattggagacataacaacagaggatagggggggcagcacgcgcttattcacacgtatacgaatatccgtggcggagagacgaggagcagctcccacagcgcgtcatccagaagagctaccgcccagaggggcgatatatttgagaaacacaacagtgggaggggtacgacacacaaggtggagccagtgcgcaaatgaacagacagactcaaggacacccggcgtgcaagaccgacgctaacactatcaccttcagcgcggcaaaaagtgtgatacaagacaaatgaaggcaagatcagtaggggacaaccacgaaagccacaacaaccgccagcccgagagataggacggcccacaaatggacgacggagaccaacccacaaatgaaagacaaccaccacgatagacggcgtaaaccccacaacgtatcgagtgggctgtcagacgatatgacacgcacgaacaaagcgaccgctgagacatacaagtcaatcagacataccaagcgagagacagatgaaacagaagctaacaaacaat

SEQ ID NO: 584881 - DNA, 107 bp, Homo sapiens
gaatttatatattttgggtaagggtcacgtgtcttatatctctttgctaatagtatcagactgtgtctcatccgaaggccgctgggaagcggcgtctggtttctcct

SEQ ID NO: 584882 - DNA, 100 bp, Homo sapiens
actgaccatagtctgagctcgcggtcgcacgggcgagcatcgtggttctgctcccccgatgagcggtgagcgcgagccatcgagaagctcgcggtggaag

SEQ ID NO: 584883 - DNA, 831 bp, Homo sapiens
  misc_feature (622)..(622): n is a, c, g, or t
  misc_feature (660)..(660): n is a, c, g, or t
cggggccagcccgccaaggccccccaagcgcgcgggcccccaacggcgcccagaatctgggggggttaccccgcgcttcctcgaagggccgtcctaggttcgcgcgaacccaagcgcccaaggggccatcaggggaagcggggaacatcgccaccacagggcgacgctttccccaaaaggggggcccccccgccggcgttaccgcgtttcgttgcgcctcctgcacgctggtggtaccgcgacccttgtccctcgtcctctaggctcggagcgggtttcccttcgagggggccctcggcttgaaagttggtctctcgtttccgcgagccccaaaccctttgaagaccgcgtaatcggatcccgtatttcaggtccaacgcgtgagaagcacgttttctcaaccgggcactatagatcttggcccttcggggggaaattcgttccccttgcggggcacaattgggggtcaccagcgactgttctacccactgcttagcgagcaagcctctatggtccgtgagccagcccaccaaaactgttaaacgcttgagttattaaaagcgaaccaggtgaatcctggtttactcttaaaattggcctgcacttcgtgaccctgagtganaaggctaactatccgtactattcttatagtgagcattncagacgaccgcagctaatgttaaaacacctttaaacggaactaaaaaaaaggacgccctcccgtccagtgtccacatgccagttcaaccccagagggtcgggcaggctgacatatttattttctgtctattctgtaggcatatacaccatgtccagatcctgcttaacggg

SEQ ID NO: 584884 - DNA, 408 bp, Homo sapiens
  misc_feature (120)..(120): n is a, c, g, or t
  misc_feature (127)..(127): n is a, c, g, or t
tcattccaaggtcagttgaacccatggacataggaggctgactgtgtgtgtgtgtgtgtgtgtgtgtgtgtgtgtgtgtgcatacagacacacatatttgctgcacacaactcgggcttnaccaacnaagttttcaaattctctttttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgt

SEQ ID NO: 584885 - DNA, 211 bp, Homo sapiens
tgctgggattacaagtgtgagccactgcacccagccctgtagtttaatacgtctggaaatcaggtgtcagggtcccaacttggttctactttatcaaaatggttggcacttttctaggtccttttcgtatgaatttcagaattagttggtccatttcagcaaacacacacacacacacacacacacacacacacacacacacacacatatc

SEQ ID NO: 584886 - DNA, 316 bp, Homo sapiens
aaaagacggcacctccttcagactttgtcctctgatgtgagtgagctgttaaaagacaaaactcatctccaggaaaagctgcagagtttggaaaaggctcacaggcactgtctttgacaaaatgtgagctgggaaaccaaattgcacaactgataaagagaaggattgcttgtcaaggaatctgaaagcctgcaggcagactgagtgaatcagatatgaaagctgaatgtctcaaggcctcgagcgcactgtgagaagtagtcgcatgagctgactcacacagaggagtcatcactgagagagcatcagaactaga

SEQ ID NO: 584887 - DNA, 374 bp, Homo sapiens
agtgctagaccagttcatgtaggatcttgcaggccttcgggatagccttgtattgcattgtgggtgtgcagagaacctactgggaggcttcaatgttgtccgcccctaacgccacgaaaatagcatgcacaaatgccaggagatgttgctaaggtctggtacttggcttttatcctgctgctactaccatgttaacctgttagtggtaccatggatcctggcaaaagacatgagattcctggctcaggagtgttgtaaagtgggcaagatctcactgctatgcgtgcacaaagcgctgagctccaagggaactcttctgagtgggaaggggaatgataactcagtccatacttacagaatctgagcctcagtca

SEQ ID NO: 584888 - DNA, 438 bp, Homo sapiens
gatatctcttttgtcatatcagacttgtgcatattcagatctaactactacatgtctatgtcaatctagctagcagtatatcaatcttttttttatcctttccaagaacaaacttctcattttgtatatcctttgtatagttgtcatgggtctcaatttcatttaattctgttctgattttagttatttctttttttttctgctatctctagtttagttttgttcttgtttttcttttttttttatttaaggtccaatttaagtttgtaatttccagatttattcttccttaatgtaaactttcagtgcctaaaaatcttcctctctaaacgctgccattgttgtattcaaaagtttagggtatgtggtatctcttttttggtttgttccaaataacagtttgatttctgcctaaattattggtcaatttaagagtct

SEQ ID NO: 584889 - DNA, 89 bp, Homo sapiens
ctttccagccttggaggtggaaagagattttcttccttttgtctatccagatgaataaagaagagaatcagacggacttaaataaccct

SEQ ID NO: 584890 - DNA, 262 bp, Homo sapiens
cttcttccttaacaattcggtctctcttcagtgttcccatgaatgctttcttctcctccatggtctggaagtggccatggccaaacttggaggtggtatcagtcctataccaccataccactataccaccctgataccactctgataccaccataccaccataccaccataccaccataccactctcaccaaccaatttatcccattttcttatataaggagatgatgatggatataggttctttacatcggtggtatagct

SEQ ID NO: 584891 - DNA, 598 bp, Homo sapiens
ttctaaatggctgttacctaaatcgctgtgctatgtagaaagcagggacatcaacaaacgtgatgagtggatattgaatgcatcacagaatctgacaaaacgagccctttcacagatgaactaatatccaagcatcctgaggccgccttaggttggttgccaacaataccaacagtcctcccattcattcttgcaaaaaccaacaatgatgttcttggcataatagggcatgatctcaaaaaaattcacgctcatcaccaacagagtgtctgatgtccacccatgttgtaggccttggttgattccaaagggacaatagtgtccaggctcaggaaccagagggtcactgggatcgtggcaactcacggaacggagccgggtcctgattgctcagggcaaaatagttgaagaaatcccggagattacacaaggcatcaacatcattctcacaagctctgtgagcaaacctgacattgtgatgtgggtcttggaaccaaccgagctcctcctggttacatcctcattgatgacagaacttcacaaatcagggccagcgataacaagtagtaggtgcctataacatgaacttgagtctgtt

SEQ ID NO: 584892 - DNA, 227 bp, Homo sapiens
tgcatgtcggaatagattgttttcctgttgtcatttttgctattttttacaaaggttttttttctcctttgagattatatgaacatggtcacagagcaagtaaagtcagaagtaggacagagaagcgctccgaaggctggtttggtcatccgatgatcattaaaaagtggctgacccctaacaaatatgtaccccgactctccctctttccggtctccagaatctaa

SEQ ID NO: 584893 - DNA, 163 bp, Homo sapiens
tataattgaagtcctcctgctttgggggctgcttcccagagtcccccgggtgctcccctgccgaggtcagtgagctgaccaagccctggccctggtgactctcatctgtcatcccagtgacatgtcaacttggtcacgtgtcgggtcacttggagcctccagt

SEQ ID NO: 584894 - DNA, 126 bp, Homo sapiens
tgcctgggcctctatcgccccaaactctgttgactgaagagagggctacatgttgactgaagggagggctacatgttgactgaagagagggctacatgttgactgaaggagtttggggcgttaaga

SEQ ID NO: 584895 - DNA, 199 bp, Homo sapiens
ggattttttttttttccccaaggggggggaaatccctttgaaccggttgggaaaaacctttggggggaagggggtggttttttttttggggggggaaatttgggatggcggggggggttggccccccttttccttcccctttaagggtttggggaaaaaacccctttttttaggccccccccttaaaatttcctttgga

SEQ ID NO: 584896 - DNA, 431 bp, Homo sapiens
gctgacttagaggatcccatcacatcggtactgcgatctttttaatgaggactgcgactcggagctgaaagagatcagggaatcatatgatgctgacgacattcaggagagcatttctcagagcttaaaactttggtgttgctgtgccccacaagcagacatgatctatgaccccagctgacaccatccgcctccactgataccctattattccaagatggtctttgaaacaggacagtttgacgatgctgaagattgagtgtggagcttttctgccttgtagggtgggcgggcctccacgtcaagatctcttttcctgtcttggaggtgaaaagtcatatctgagaaaaattgtttggcaggtgacccctagtctggggtacacagaccagtgttcctttattgacagtgttcaataaggccccgtcatt

SEQ ID NO: 584897 - DNA, 292 bp, Homo sapiens
aacatagtctgtatataccaaagtataggacgttgtatccatcctcatattaattagttagttggctcaaaattagtgctaatgacttagtaattcagtgatttctgttagctttaaaacctttatttcagaactatttcacctcttggttttcatttttgctgtgtgtcactgcctgccagctgctaatttattaactcccagtgaatcacgtgtcctgtgaagggactgaatattagtggcaaattatgttgatgatttatattttgaataaatagtttgaatacataga

SEQ ID NO: 584898 - DNA, 508 bp, Homo sapiens
cgagggtccgtgtgacataagaaatacacatttggtctatgccccaggttcctggcacagagcttgtaaaatgatagtaacttcttgagtgctaggggtgacgggaacatcttgtcttttacataagaaaccctcctcaaacagatgtgagtttatgttaatgatgtgactggcagaggatgggggctggttgccagagaatccatccatgtgattagaaggttgaaactttcaaccttatcttcataaccgggaggggacagggcatgaagactgagctcatcatcaatgatttagtcacttgtgcccatataatggagcccccacttccaaacgaaggttttcagagagcttataggttggtgaacacatccatgtaccaggaggtgtaccccactccacggggacagaaattcttgtgtaggggacccttttagatttcattatatatacctcttcagttggatgttccttttataaccaaccaataaatgttatgtcaagtgta

SEQ ID NO: 584899 - DNA, 186 bp, Homo sapiens
tgtggtgtcagagacccagtgtctgagcccggatgttgctccatgtgactaaagctggcctgtctcaggaccttttctttgcttttttccttcttttttcttttgacaccggagttccggctcttgttgtcccggctagacgtgccaatggcttgatcccaggatcaccgcaaacgtgtacctccc

SEQ ID NO: 584900 - DNA, 1414 bp, Homo sapiens
cccaccgctgactgcgccgcggagaaagccagtgggaagccagacccagtaggagacccgcgtgcccgtctcggtctggccagggcccgcgctatggatgttcctctgggcgccctctcttgggtctgtgcttgcagatctggccgctgctgacttcgccacacccgttctttctggaacagttcaaatcccagatgtgccggaatgaggactacaccattacatgtgctacgtctgaatgatctatcgtggacatcagtctgtccgaatctatgaagagtcactcttgtgtgtcgacgatcggcttcgccaattggcaagcaaggtataatacgtagtcacctctgtggtggatcaatgagcgagctcacccagcatggtgccaggaccgcaaggtccaacggacgctagaggtctctgctggctaggttgccatgctgggccgagtgcctacaagtcatttggccgcgagatcaaacgcatggtcctgcatcaacatgcttctcgcgagcagcgcttcatcgagcctttttcattcccatttgggtgacaatgggaaggttccaagaggacaggggtacgcattatggcggtacagtactgtatcgatcttgcctagaagccccaaggtcgctagggcagacgagtgcaagaggaaccccgacgtgaccattctggagcggggggtttttgaaaagcggtgttttgaacgttggctccatagggttgggggccataccattaattctagccgggtcgcaacggttgggttcaaatgcaatagcggctcccttggatgtggggagcacttcactcgatatatcgggcttctgcaaatatacgtcgtaaaggtataggccgtggcggagaatcgtcacgggggaccctacagtctaggaaatagccataacggcgagactttgggttcaccttagagggaaaaaggtttcgtattcggcagaggaggcccccagatgggcgctcaaattacataccataggttagcaatatttaatccagtgggtccccacatcctttgggcgccgctccattttttaggagtaaaccgcgggttacgctcctagagaagtgtccgtaaacattaaaccccaagcgtttccctcgaggggtaccgtgttcacaccagcgacctttccacacggatgagtgacccctccgttacaagaggggccagcatcagagtttgggaaacgggcaaagttcccccatacgatcggcggaactgacaaaaaggagaagcgaaagcgtttagcgcgagagagcgacggcagaatttggaagccgctcccaaagaacaatgggtttggcagagggattgtaccgatatacaggtaaagagtgcgcattctggagggtacccgcgacgaggtgggaccttttgacacgcccagag

SEQ ID NO: 584901 - DNA, 273 bp, Homo sapiens
ggatcccccgtacagatggacctctcatttattccttgtggaaaacagaaaaacaccaatcttaaaaaataaagaaagtcagagtaaacctggaaagatacccagatttgataacctgttagacaggacaatccaggctcaaggaatctcattttctcaactttgcatctggttgtccagatggagactggacttgaccaacgtgatggaccacagacaagggcaaatttcattgtttttctacctcatccttgtacctcttttttcattaaa

SEQ ID NO: 584902 - DNA, 811 bp, Homo sapiens
agcgggttctgcagccatttcaggccccggacaggaggcagtgccgcttcggccgaaggcccgagcgcccgaggcgtctgggatggtgtgggaccggcaaaccaacgactggagtatgagtggaaacctgacgagcaagggcttcagcaaatcctgcagctgttgaaggagtcccagtccccagacaccaccatccagagaaccgtgcaacaattctagaaactggaacaacttaactcagtatccagactttaacaactacttgacttttcgttcttacaacaattaaaatctgaacgcatgaacccacaagatcatcgacgctggtcttatcttgaagaataactgtgaacagcacactttcagaacttcccaaactggtgtaacagactttattaaacacgtgaatgtctaaactaactattggctgactcctctcctctgacttagagccactgtcggtactttcgatcacaactatagcctccaagggcagaactcgccgaacttggcctgacctcttaccaaaactctgtagcctgtcggattctgaagcactactactacctgtgagggaccatccggtgcccttcagcaacatttgtgacagattctgctgagattttagacagtgatgtttcagatcgtcctctcaccatcatgattcccaaatttttacagttcttcaagcatagtccgtccatacctaacgtctcacgcgctgcatggtgtcaatcagtttactatcagtagactcagctctaatgtggcactggattcttctattgcaattcttgcttagttgtgtgag

SEQ ID NO: 584903 - DNA, 708 bp, Homo sapiens
  misc_feature (502)..(502): n is a, c, g, or t
ctcgtcccgatttcgcacgaggttttggagacataattttaggacattaaatgtggcagacactacagggccactgggttcagcctataccatctttttgaactaagcgtttaggggtctgaaagataagtaaagtgtctgagcaagaaaaaatgtgaagctcattgaagatatacccaaagaacccaagtctgtagagcccctgtatgagggggccaccaaaatatactaaatctgtgctgagaaagggagatataaccaactttcccacaaagggagatgttgttcactgcttgtgtacaggagcactacacgatgggactgtgtttgtactaatattcaaacacgtgcacagaagaggaaaaatgccaagcctttaagttttaatgtcggagtaggcaaagttatcagaggatgggatgaaactctcttgactatgagtaaaggagaaaaggctcgactggagattgaaccccaatgggcttacggaaagaaagacagnctgatgccaaaattccaccaaatgcaaaactcactcttgaagtggaatagtggatattgattgaaatagcagggcttcagctctatggatattagcaacactgatataacttggccttgagaaatttacacaactagttagaacttgttactattgtaaaggaagagtcaactggttcaaggaggtaatggtcttactctctacct

SEQ ID NO: 584904 - DNA, 102 bp, Homo sapiens
agtcctcacggatgagtccacggtatacagcctctgtactttgtaaggtcaccctcacggtaggacagcagtgagtgctgacactagtagaagactgcaggt

SEQ ID NO: 584905 - DNA, 106 bp, Homo sapiens
  misc_feature (1)..(1): n is a, c, g, or t
nttactagctgtaattgcaaataacatcattaccattaacaaggaccaaaatgtctttgactccaagaagaaagtgaaattaaccaatgcggaaggagtagagttt

SEQ ID NO: 584906 - DNA, 249 bp, Homo sapiens
tggtcactctaaggttgggaaacgctgatatcatttatagttgggtgaacaagcagaagcacacgagtaagtactcccgtcatacaaacacctggtgttttcagaagtttgaattttttggggctttttttttttttttttttctaagaataggtctgcttacacccaggaggaggagggagatcgttcactgagctcaactccgggccagggatctccgagaagcgggtacaggttgtgtcaccacac

SEQ ID NO: 584907 - DNA, 257 bp, Homo sapiens
ttcctttctagaggccgggaagttaaacttgtagccaccacctccctcttcccgtcaacctcggccccacttcgggccgaaagcacggtacagaggctgttggttgctttgcacggcaccccacccaccccggatcgcggctgtcttaagggacccggagttcattaagggctctttcggggcctctgcgagtgtctgatctgctccgtttttgcaaaaagcgcctctgtctcgcagagctcgtgtgagacgagaca

SEQ ID NO: 584908 - DNA, 575 bp, Homo sapiens
cgtctcctagaggatccccgtactccccgttggcctggccaacaagtggtgtggtgctcctgagccctccaccatcgtcgcgctctctagcaaccactgtccctagagtcaccaaactaaccgcgaataccgaggacccctcgcactccccggacactcacagctcaaagactggagccagacatcagcggtgttacccagatgtgtgaaacgagggatcggatgactggattgccgaagatgccgtcgaataaagaaagacaagacacagttcaaacccacccttggagagccatgtgggctgggtgatggattcccgtgagcacagggcccgtactgcttccatcagctccagcccctcagaagggacgcctacagttggcagctatggcgtgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccg

SEQ ID NO: 584909 - DNA, 132 bp, Homo sapiens
tggatcccggttcatttgtctacaccaggcttggatgcgacagggatcctaggatagtcagtagaattagaatggtgaagatgataagggtaggagggaaggttaagggttggatattggctaggggtggcg

SEQ ID NO: 584910 - DNA, 225 bp, Homo sapiens
  misc_feature (60)..(60): n is a, c, g, or t
cccacttctttgagttctcaccaaggagctagccctggccaggaccggatacttatccgnttttccccttggagtcctggcagattggcaagatagggccgtcatgacttttttatgattggcacggagggatccagggcatctttgaactgctgctattacagagagatcttttggcagagtgagggctgagataaccagctttgattatcccgatgcacatcc

SEQ ID NO: 584911 - DNA, 492 bp, Homo sapiens
gcgaattcactagtaattagctgtgaggcagtgctgctggtgcatgacccacttaatggctagatgggtcagaaagtacccagttcatgatacgcagttcaggtcgcatcgtgacttgatgacccatggtcaaatgttcagtttccaccaaagcccagtaacaagccaagagctgtctctcaaaaggagagtagttacctgcagattatggcagggccttgctccaaaatcctagatgcctccactgtgattcacctataggggcctgccaaaaggctccaaaaagcatcccccgtctggcaatgacacctcaaataccattgaatctgctagggtcatatggaccaagtggcagagcagcttgtacagcagcctggacctatgtccgttctggaccccactcaaaactggggtcccagtggcctctagggacacttgataaatgtggccagaagtaacacacctatgaataaggcatgtgatgactcccaa

SEQ ID NO: 584912 - DNA, 166 bp, Homo sapiens
aggactatggtccgctagcggaatgctcatatgcctagggttctgaccaatggaatgtaagcggaagtgatgcaggctacttccattcaagctctagaaggaaacatatccttcctttctctccctctaggcctcatggagggggcgcgctgcggagcaccaaaca

SEQ ID NO: 584913 - DNA, 286 bp, Homo sapiens
gtagtgggtgatctagaggatcccagtttatggggaagggatgggggaaggtgcgctgctgtctcgtgtggcctgccgccgcctacgaggctgtgcggaactgggagcctggaggggttgcgtggaagagtcctggactgcgctcctacacgacgacgtgtacgtaggaagacgactatgccccctgacagtgaccctctgtgccctcactctccgtaccggtacttgtggacagaagcgacacgggccaagcaagctctcgccttcaacaccgacacccgcttaa

SEQ ID NO: 584914 - DNA, 263 bp, Homo sapiens
ggtggaagcacccatgtattgaggcccccagacatgaaggtgtcagcctccgctcttatgttctcacggcacttctatgtacattcctcacgtcccaatgggctgatgcttctgcttggcctgtgacatagtgcacaacttcacagatgctgtcatccaggagcggtgtcgcaccctcactagccagggtgtcgatgacttcctgcaggccaggggcaagtccacgactttggacttccttgacgtgctcttgctggcccagg

SEQ ID NO: 584915 - DNA, 830 bp, Homo sapiens
ggccctgggctcgcggggtgccggggatggcgggagccggagtggagccgagctcgcggcggagcggggggggtcgaggtcgagctcggaccaggcgccgcgcgcacggggcaatatcctcgcacaacactgggccttgcagggttcaggcctgcggccggaagcagggattgaggggatccgcgaggacctgggggttgtggggaacaaagtgcccggaaccaggtggagggctcttcgccggggcacggggcggcggcgtgacgggggctacaagcaactcccgtggatctagggtgaaaagcggttcatcaaggggggtacatgagcatgttgccgcacaactctggggacacaatgtgtgtctggggggagggagggccctcttattggcgggctttttcaggctacgcaagggactttcgtggaggtcggcggcaaagatagggttgtccggaggctgagtcccgggtgttgtcacaggcctctctatggtgactcgggggtaagctggaagaaggtttcccctcaaatgggtttgggcgggtcccacaaggttgatatgaagatttcctgaagaaggtgtgaaggaagctcttagaatgatgaggcggtgtggtccggtggtgggaccacccggatgtcattaaagggctgtggtccagttggtggaggaaggcaagtaccgggtgtctgcccatggaagcttacaaggagggcggagttcggggataccaaccggagggggttctggggtgaacggggcatcacagcacggggagagtcaccgcgccggataaaatctggggcggatgaaccctgagggcctg

SEQ ID NO: 584916 - DNA, 170 bp, Homo sapiens
gaaaaatttttttgggggggtttaaaacaccccgggttgggggttttttccccccttttccccccaggggggggggggggggtttttggggtttttttttttgggtttccccggccggggcccgggggggaacccccccccggttttcctttaggtttttttttttttta

SEQ ID NO: 584917 - DNA, 189 bp, Homo sapiens
gtggtctgaacctcctgacctcacatgatctacccaccttgcctccaaagtgctgggattataggcacccccgtcccctctccctcatttctatgtgctctctattctcctattagatttggggacctatgatgctctgtatctccgtcattctctctcctgtttcatctcttgcctttgtcttttgtg

SEQ ID NO: 584918 - DNA, 346 bp, Homo sapiens
  misc_feature (25)..(25): n is a, c, g, or t
  misc_feature (55)..(55): n is a, c, g, or t
  misc_feature (100)..(100): n is a, c, g, or t
  misc_feature (205)..(206): n is a, c, g, or t
  misc_feature (250)..(250): n is a, c, g, or t
acttagtggggaaaagctaaaagtntttcctttaagaactggaacaggataaggntgcccactttcatcactcttattcaacgtagtactattaatagangtgctagccagagcagtcaggcaagagaaagaaataaaagacgtccaaattggaaaagaagaagtcaaactgtccctctttgcagaagccatgatcttatatttnngaaattcctaaagactctaccaaaaaactcttagaactgatgantgacttcagtaaagttgtggggtaaaaaaaaattcagcatacaaaaatccagtagccaattcttttacacccattaattggacctcattgggaagg

SEQ ID NO: 584919 - DNA, 213 bp, Homo sapiens
gtagggaacccgatttctgaaatgggaggaaaggaggtaagaatggttgtgaacacagataaccttttaagaaaaaaatgcagaacgtattcacagaaaggaaatcatacctttttggcttcacttatgttgagtaagtacgaggcatggtaattctgctaagagtaagcagcaggtggcattcacaacagggagctttggaggagaggggat

SEQ ID NO: 584920 - DNA, 256 bp, Homo sapiens
  misc_feature (65)..(65): n is a, c, g, or t
tcgaggatcccgccacggtagattccacggtagatatatctgttgtgtttaagtcaccagatatntgttcccatcggtttagcccagagatagacagtagaatgcaatacctccctcccctaactgacgggaggctgcaaggaggcccaaaaccagggcccaatgcaaggcacgtggtttccttttctcctctctctgcatctgcgctttccagataagcccaaagacagcaacttctccactcatgacaaattta

SEQ ID NO: 584921 - DNA, 559 bp, Homo sapiens
  misc_feature (466)..(466): n is a, c, g, or t
tttgagacttagattcactctgtcacccaagctggagtgcagtggcaccatttcagctcactggaacctttgcctcccaagttcaagcaattctcctgcctcagcctcctgagtagctgggattacaggtgcatgccaccacacctagctaatttttgtgtttttagtagagatgaggtttcaccatgtttcccaagcaggtctcaaattcccgggctcacgcaatccatctggctcaacctcccaaagggctgggattacaggcgtgagccaccgtgctcggccaagaaataacagcttttctaaagtaccaagaaggaagctgcagatggtctacaacgtctgccctttcttgtaacaagaaaactctttcatattaagagtatttttgaaaagcatcgcattttctcaattcctcaatagtagggataatatttagtaagtctttcgctttgagaattgtaangtctagatttaaaaacacaaatgtccctctcctgccttatataacttgtgtaatggttcaattttataaaattaaattatcaatacgtcctcc

SEQ ID NO: 584922 - DNA, 876 bp, Homo sapiens
ggcatttacttgcactcaactaatgcggtgtcgctggcgtgctgagcgagcgcgcggagagtctctgttggtgaaatagtgggaagagatacatgtaggcatcgggaacgagcctgaagtccaccattatcacaataggacagttcgatgctggcggtacagtctactcccgtgacctggctggccgtgcaacagtctggatcatcatcgttgaactagttaggctattcgaagcttctcaagtccaagtgggagaacgactcaaggaaacgagtccaaagcaattcttctagaaaccctatagaagtacttacttcagttaccaggtcaaacacagtgagaaccaaactttcacaggcatttgaactccaatgggcctgaagggttccagaggaccaagtctacagatactcacttgaagtgacagaaagtgctgcataactgccagtttactcatcgatgatattgaaggacaaggtcaaaactccgacgtggctgtcccagttggccacaggcatctatggaatcccatctgtcatcaattctgacaattaccgtgtatttccttggcttggagaaagtcttaacccttgatcacccagatgcagtgaaagcttcatacccggcagctttggaactcatcagggacaaggcgtagatatttactggagggattattacacttgtccactgacgaagactataaagctatggtgcatgcagaaacacctggtggacctggtttgcattacgcaagtaggcctcaatgcagactgtactctgcttacacagcagactctcaacactcccacctcactccacttgggctcattactcaaattacgcatgattatggcactctacacctcccacagc

SEQ ID NO: 584923 - DNA, 598 bp, Homo sapiens
gagaatgcgtcatataaagctagttaacgcatttactaaacgcagacgacaaatggcaagattaattgggagtggtacggactgaaacaatttggagaagatagaagtttgaagtggcaaactggaagacacgaagtacgggaaggcgaagaaaagactcgagaagatagggaaattagaagatcacaaacatacttttagacgaaaaaagataaatttaaacctgacaagtaggcagcagaagtactagagacaagctaggaaacaaaaagctaagggcaaaatgtacaaccttagaagaaaattggaagatagaaacaagatagcaaatgcaagatatcgtcaagagtttcagatagcaactgaaacaacaagctaagacaagtctcggagaagtatagaagatagacaaatatcacgccaaacatcggatacaatagcactgacaaaatgaggaaattattggtaaccaatttattttaaacgcccatcaatttaatatctggtggtgccgaagttagaaggtagagcttgagaagatgagggtgtatacgtagaccagaaccaattagaagaatacttgagctctggccagggg

SEQ ID NO: 584924 - DNA, 221 bp, Homo sapiens
atgaccgtggctatcctgctggtgatggagggactttcagccttcctgcacgccctgcggctgcactgggtggaattccagaacaagttttactcaggcccggggtacaagctgagtcccttccccttcgctgccccagatgactagggccccctgcaggtcctgccagacctccttcctgaccttaggcaggagaggaataaagacggtccgccctggca

SEQ ID NO: 584925 - DNA, 258 bp, Homo sapiens
gtagaagtgaatagatgagtagtagcctacaatcaggctctagcttctcccggaacactacaggatcaatttagttaaaatatgcatgaaactaacaggcattctctcaaatgagtttaaatgcattttcattttcagacaacctacatgacatgttttacttaaaaacacaggcctccactccaaataaatcacagtcaaaataaatgcaagagctcaagatgcacatcagtcccattggtcttaagtcctggtgtt

SEQ ID NO: 584926 - DNA, 234 bp, Homo sapiens
gattagaaaatcacaccagccatacatgatgtttcacttctgtaatccccgcactttgagaggccaaggcgagagaatcacttgaggccaggggtttgagaccggcctgggcaacatagtaagacctcatctctatgaaaagttttttaaaaaattggctggatgttgtggtacacacctgtaatcccagttcttcaggggcctgaggtgggaggatcacttgagtccaggagt

SEQ ID NO: 584927 - DNA, 677 bp, Homo sapiens
  misc_feature (327)..(327): n is a, c, g, or t
catgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtattttagtagagatggggtttcaccatgttgcccaggctggtcttgaactcctaacctcaggtgatccgcccgcctctgccttccaaaggtgctgggattacaggcgtgagccactctgcccggcttatttnctttatggttaggccttcgaaagaggttctgtggagcagtgattgtgcaactcttgctgacgttgctggggaagctttaaaaaaaaaaagagttgccccacagagattcggattctaaatggtgcggatcaaatggcctgggagtagaattcaggcatggatatcttgaaaaatctccccagttgtttgagaaacaattttagagagttgcagaagtaggtatatcaaattcacagaatcttactgagttgggaagacggttaatacaatgggcttgggtttctacattggctttgagcatgggatcggacgcatatggtgcccttgtgactgtcgaagttgcttggtca

SEQ ID NO: 584928 - DNA, 1227 bp, Homo sapiens
  misc_feature (48)..(48): n is a, c, g, or t
  misc_feature (57)..(57): n is a, c, g, or t
  misc_feature (64)..(64): n is a, c, g, or t
  misc_feature (175)..(175): n is a, c, g, or t
  misc_feature (209)..(209): n is a, c, g, or t
tgacgtcctgcacagcgacaagaagctgactttggttttgtgaattcntgtgaccanggacctngcagaagtattttggaccagttgcaacatgagtgaaacctcgaatccctgagaacttgtaaaacgctcaagttcccgttcttcccaaggctacactaaaaacacggggggncatgggggaactttccattgatacaacgtaaagncccccgacaaaaagttggtttggcccttaaccctaaccccaaagggtggaggaaagccgcctgttggtaacaacaggcctccgccacacaaaaaggaaaaaatcacccgtttgggccgtttaaacaacgcgttaaaaagagagcccaacaaggggggcaacaaacacttggtcggcggcaggaaccacagggcccagtttgggaacaaaaactcgtttctttcgggaggggtcccctttgctgacaccttcctttgttccttcgggcaggcggccccccctgtgggtggggtccctcttttaccccgcggaaaaatgggggcccagcccgatttctttacattagagagggaggggaaaaaaaccttttcttttatccccgaccaatcccgaagggggaagtatttaccaaacccctagaggggccccgtatttgtggcggttttgcgtttataaaacgccgcctatattccccccaagaaagaaggggagccccttctattggggggaaaaacaagggaacggggcgatttttggacgcgagaggattattaccacgagaagacccgataaagaagaccccatttttttgtggaggagattattgtgggaggggcagactttttaaaaaaagcaccgacccccataggggagggaccaccgaccccggacgccgtgaaaaataaaagccgcacacccctgagtgggtgatggtggctagaaaaacaaacttatttttttgagcgcaggtgtttttttactcgacacgccagcagtaattttttttaccacccacgcagctgtttgtttgttagcatctttatacatagttgtggggtagagacgaacgtagtctacgcgagagaacatagagggggtgaacaacgcagaccacccgcgtaaaaaagaaagaaaaaagaaacagacgggaggaggataccaacacaagtatatttttttggggtggggagcgcgtttttttagaaagagtcaccccaacacgatgtttttttacaccg

SEQ ID NO: 584929 - DNA, 939 bp, Homo sapiens
tttctttccttctccttacaccattactatctgaatcaaatctggacgatctcgctccttgaacttgtttgtgatgagtgtactcaactaacagagttgaacctttctttttacagagcagttttgaaacactctttttgtagaatcttcgaggggatatttggatacatttcaggatttcgttggaaacgggaatatcttcatatacaatctcgacagatgcattctgagttagacttcttatccttggggactgtgagccatataaacttgtgttcatcataaactaatactcactaacatcaaaaaatataatatctacaaaactaacgattataaaaaatatagcatgttatgttagatagtcacaagctctacacctctcgccttctcttcccccaccccctctggaaagaagtagtagacgccacagagacacccttcgctccagcgtacacgcgcggataagttcctgtcctctctttctcatgtccgtctcttaatgtccagacaccaagacgcacgtttattaccgagttttgtatatttttacctcgtccgagcttgtgatcgcgcacaccatctctaatactatataaattcatccatattgacagtgcgtatctatacataatcgtaatgtcttacgaatcgtctcgtcatccccttttaacatgtctttcctgccctcctcttccgccacatctcctctcttcttcaattcagagtagtagtccaccgctagtatttgtagttgctgcccaccctacacctctttacactacgtcgcgtgattacttgactattgtgcttgcaaatctccctacgccttgtctccgaatatcggtcgtagcgcgactatcacaatatcaccacactctactccctaatcatacgtcctctacttccgatatactttttacccactggccgccgccg

SEQ ID NO: 584930 - DNA, 249 bp, Homo sapiens
gcctgctgtacggggtcgtcgtgggtcctcccctgttttgcaggaccgatagcccctccttttttttgggtgcagttagttcgtcgtggcggtcccccagctgtagtcccgcctgtgtctctcttctgtgtaggcggcactcctcctctggggggcggtgtcccgcacagctgtttgcttcgttattgttcggagcaaagaagcgcgggtattttattctcccgcggccgaacaatagcaagacaagct

SEQ ID NO: 584931 - DNA, 232 bp, Homo sapiens
caacgcatgtgccgctcccgtgccaaggcgggttggtcggctatatcagctatgacgccgctcgttatatcgaacggcttccaccgctggctgtagatgatttgcagctgccgtctatgcagttttttgtatttgacgatgtggcgatttacgatcatcaaaccgatcgccttcatttgctcgcttatgcagatgaaggggaagtaggagaagcggagcggcacatccgttg

SEQ ID NO: 584932 - DNA, 139 bp, Homo sapiens
  misc_feature (7)..(7): n is a, c, g, or t
  misc_feature (9)..(9): n is a, c, g, or t
  misc_feature (34)..(34): n is a, c, g, or t
  misc_feature (109)..(109): n is a, c, g, or t
tttaaanangaaaataaggatgtttattaagganatttctagcccacagctagggctcatactcgctctatgagccactgtccgacctcatccccattcaatgtgaatnacattagggaggccgggccacaggtagatc

SEQ ID NO: 584933 - DNA, 242 bp, Homo sapiens
tcccccccccccccccctagggcttatttcccctggcttagttttttagggggttccaggaaaaggccccccaccctaaccaaaatgcaaaattgggagtgaaaggctgggaatggaggggcaaaacccagaaaatccccccaaaaaaaaaagtaccaaaaaaaatgggggtcctccaggggggcagccacaataaataaacacgcccggcacccccagcttgggggggtgtttttccctta

SEQ ID NO: 584934 - DNA, 145 bp, Homo sapiens
  misc_feature (16)..(17): n is a, c, g, or t
  misc_feature (106)..(106): n is a, c, g, or t
ggtatgatggtgtganncctctagtcccagctacttgggaggctgaggtcagaggatggcttgagcccaagaggcagaggttgcagggtcaagatcgcaccacttncactgcagcctgagagagagagagccagaccttgtctca

SEQ ID NO: 584935 - DNA, 1623 bp, Homo sapiens
cctggtacctgtgtcctggttattccctggtgatatatgtctgacccactgctgtctgaataaaaaaaaaaaaaaaaaaaaaaaaaaaaaaaaaaaagaaaaataatatatgtgtggtggtcctctctgttagtgttactactatcatggttggttcctcattgtaagtcactttttgtgtgaggaacaagtgaacgcatggaaaggctgtgtaaggggagaaggatgcctcttcagacagtggagtgaacagcgtgtgtggtgcgcttattaggagtgtaccagaaaatagtgttatctctatgtacccaggttgtagtctccgtctgtagagccccagcactcccctgtcgtaggccccttcccatccattagtaacgccgcgccacgtagtgtgttcacacccaccggcgtgggcctctccccgcgtgtgctccactaggtgtgggatatctctcctctctgtgagagaagccccgcctctgcgtgtgcgggccacaatactatactcggtgcgcggcgagatatatgttcggcccccgtgagtacattatggcgaattatacaacccacccaccacagatgttgcatcctacccactctctcgcgtcgcaccatagccaacaaaaataattaagtagacataaacatcttagcagagcggctactgcaccaccaatctgctatatttcgtaatcacctgtcattactattcaatgaagtaacaacaaacaacaacgtgcttccagtacaacaaacaatagtaagacccgccacaaacaactacctcattgagaaaccactctctttacacaaatatgctccccccaataattaattaaactacctaataaagagatccacagagtcgaaaataccccccaaatataaattatccattatgaaaacaacttctctctcccaagcatctaacactccaccactttataagatcactcccacctatttttggaatcatatcacgagaaaaattctactgcccactcacaacaactctcttccggtgtgcgacccttttccccccccccaaatctcgccgtcttaccaaaaaacacaaacctcctctaattaacaacactatttactaccacatctccacaaacacaattttattccccctaaaacttctctcccacgactgttcactacacactccacatattaaactatccccctcctatcaataaattctacaccaccgcccccacaccttttttatcaacacgatccttgttatgcaccacaaacacatgcgcttttttcacacacaaccctttatagtattttcacacacctaatgtgccgcaccttaatacacgattcttctagtgccgccgctcgcgccgccgtgggtccctcgctggagactgcacgcgggcggtggtttcggaccccctcctcctcgtcacaggcgtagctgggcaccatatttttgttgggcgccccccatgttggtgtccccttacgtgtggtggggtgggcccgccttgttgcgcgtcacttgctcgtgttgcgcaacctgtcgccgcccacttctatgtcgtgacgccccacatttgctccccccagacattgtgtttccgccacttctatcctgccgcc

SEQ ID NO: 584936 - DNA, 264 bp, Homo sapiens
gactaaggatccctcataggtcgcaggaaagcatattatctgtgctggaatcaccgttcctcatggcatgttctcttgttctcttatggcttctcttggctatgggaaagagttccctgaccccttgtgcttccaagtgaggcgatgccccaccctgctttggtctgccctccgtgggctgcacccactgtgtaaccaatcccagtgagatgagccaggtacctcagttggaaatgcagaaatcacctgccctgcgaacctatg

SEQ ID NO: 584937 - DNA, 388 bp, Homo sapiens
aaagatcaaggtgtcttctaagcctagatgcagaacagtgctgagaacaaggtctagagttaggcagatccaggtgtgagtcccactcccatgactatatctagctggtgtagcttctgagatgtcccagatacctctctaagccttggtgttctcatctgtaaaatggaagtgtcagagcaggtatcagattagaagaaacttgagaagtactaggacgtagtggaggctgctctgatcacatcataaacaccaccacaatcaacagcagaatcaatgtcactgtcatcatcaccaacacatattagcatcaccaccatcatccccataaacactacataataatcactatcaccatcactaccatcataattatcacctacatcac

SEQ ID NO: 584938 - DNA, 303 bp, Homo sapiens
cgggcacgtgggcgatcacctgagcctaggagtttcagaccagacttgggctacagtggcaaatacccgcgtctccacaaaaaatattctcattcgttgggtctggtggcatgtgcttgtagtccccactaccccggtggttgagacgggagaattgcttgagcccaggaggtggaggttgcagtgagcaaagatggtaccactgcactccagcctgggtgacagagtgagatactgtttcagaatcaaaacaactacgacaaaaagagaatttcagttactctattatcacgtccgtactgg

SEQ ID NO: 584939 - DNA, 427 bp, Homo sapiens
tttccaaagcagccaggaacatcaggtgcttatcctcttgacttcaccccctacatcttatcatagcacagtcaatcagtctcccgtcaatgatgcacacacaggtctccaggaaatcgtgcatgcatgccagactcccccagtggggcttctgagagccccgatcaccagacgtcatttggttccaaggtcgctccacccaatcctcgcagtggaaatctcaactcaggaccacgcgggccagatattatgctacgtccacactggaaactccttgaccccctaggttccaccaatacaactactggctgatcacccacagatggagccagagacacgggcaaccatgggaccagagactcatccatgcaaggtggtactgggcacccatcaacccacgccagacaccgccatggcactgggcaac

SEQ ID NO: 584940 - DNA, 590 bp, Homo sapiens
gacgccggagggtgtatgtgctctgaggcaatttatccttcactgcatatgactagtcatttgtgtagaggtgttggcagtattctctgatggtagttggtatttctgtgggatcggtggtgatatccacaatatcattttttattgcatatatttgattcttgtctcttttcttctttattagtctagctagtggtctgtctatttggttaatgtttttaaaaaaccggctcctggattcattgatttttttcttgaagggtttttcatgtctctatctccttcagtcttgctctgatcttagttatttctggtcttctgctagcttttgaatgtgttggctcttgcttctctagttcttttattttggatattagggtactgattttagatcttccccactttctgatgtgggcacttggtgctataaatttccctcaaaacatgctttagctggctcccagagattctggtacattgtcacttcgttcttatgggtttcacgtaacttacttatttctgccttaagttggtaatttaaccagtagtcattaggagcaggtttcacttccatgtgttgtgcctttgag

SEQ ID NO: 584941 - DNA, 487 bp, Homo sapiens
  misc_feature (74)..(74): n is a, c, g, or t
  misc_feature (121)..(121): n is a, c, g, or t
  misc_feature (229)..(229): n is a, c, g, or t
  misc_feature (233)..(233): n is a, c, g, or t
ctctgctgtctgcctcgctctgctgtctgcctcgggctctagtgaccctcagcctcagcctcggctcccgaatngttgggattacaagcatgagccatgtgcctcttttcacttctgattntggatttttacttaacttgtttgtcccactccaccccctttttaaagttagactctttttcctggtcttttttccccggtggactatgctcaggatcgacatagtctngttngttccttggttgtacaaatagtcattgtgcttcatgtgctcacgttgccatttgttccgggccaaatggaaatcaagcattcagcctatccagtggtatgttggtaaatgtttaacaacgggctttctggggaggaaaaaaacctcctggtttgtaacacttgctgatttccatggcgttaatactcccaccacgttggagttgagctgccagggtgatgtcctgaaggtggaagagggaagagaggtatgagg

SEQ ID NO: 584942 - DNA, 186 bp, Homo sapiens
ggttgttagatgaccggcctcaccaactaccagcagaaagcagaagagcttggaggcaacttaaggcgtctggatccactgtctgcgctcctacccactatgctacactgcctctaactatgaggaagcaagggcatttttttttttttctggtgactaaaaagataagagttcaagtatgcggct

SEQ ID NO: 584943 - DNA, 473 bp, Homo sapiens
catcctggaaatgagctaatgcagacattgccatttgctcactacaaatccattttcttttttgttgtggcagaaacttgccaactgtaaacaatatctgtgttatctttctccatatacccatttagactgtatgatctaatcctctttattaagtggggctatgtttctgagtgtaggtagcagaacatacatagatgtgatatgtgccatttccatgcctagtccttaaagcccgacttacttctccacactccctttctttcctggaagccagatgtgaacaatacaatatctgcaggccagatgtgaactatacaatggaggacgctgagcctctgagggatgatagagccatgagatcacaggcatttggatccctaaatgattacatgaagcagctcccccaccctcaatttccattgtactgtgatgtaaacaagaatgatgtcttgtgtgtgtatgtgataatc

SEQ ID NO: 584944 - DNA, 894 bp, Homo sapiens
ccgtgtcccgttgccctgctgcacttggagggctccccaaacccctcggtggcccgccccccggaatataacctcgggcccccgtccgcagccagtctatcatcgggggaacatctccgatgggcgtacggcctgaataaggcgaaaaccagcgcgcgcccaaaggcgccccccccaagtgggggcagcccccgaggggcaacaaacgcccccccaagcgggggaaaaggggtcacccccccaccaaaccccgtcgtgcggccacccaccagaaacggcgccggtccacacatctgcgctgtcccaaccatctggagacaagagtgcctcttcgcgtgattaatccccttccgcgccgcctcaccaacatgggtgcttctctccactcattccccggggggagcaccccttcgataggtctgctacccctagttcattcctccggcgcgcccccccgttcattgtgtatacagggagatacgccccgccgttttcttcccccgcccgggcgagggattgatcgggcctctccgagcctatgttgccgccccccgcggtgttcatagctctgggcgcaccgccaccaccttggtcgcgcacacaggccactgaccagagaaggacaaaaagacaacacaacagcagggcgtaaacgtcagagagacccgacccagcaagccccggcagacgtgaaagagcctaccgactgacccggggtcccctcccctttaccaagaccaccctctcgatgacagcaggtgcccagaactcccccacggggcgccaggttgagcggcactcactcacgcacctccgctggagcagacggtcatgcctccgcccccgcatgagcgggcgggcccagacccttcacaattacccccaacaatgaca

SEQ ID NO: 584945 - DNA, 481 bp, Homo sapiens
ggcccgtgtccccttcccctttagggccgaaaagaagggctgaagagagacctggcttcctccgacatcaaattggttcacccctgccccatccccgggaacacaaaggagtttcggcagatggcggccaaccgcgaggtgccccggcccctttcccccctgcccatgttcaatgtgcacacaggtgagcggctgcctccccgggtgggcagcgcccaggtgcccctcattttgggccagcactgacagcccagccagtggttccaggtccagccctgactttatcctcccttttctgtcccccccccgagtggcccatcccccctgctgattccagctcctggccctcctgggaccccggcttttaacaagcagggagagggggtggggtggggtgagagtgtgtggagtaaggaccttcagaattaatatttgctgctttgctcccccattggtgctggcagcctttcccgtccaacca

SEQ ID NO: 584946 - DNA, 174 bp, Homo sapiens
gttggggtgatttaaactgagttctgctggggataagctgaatctacgcttgggctgaactgagccagagctgacccttgggctggcctaaactgggctaacctgagtgggctgacctgggctcctgggctggactggcctccacacagagcccatccgtcttccccttgaccc

SEQ ID NO: 584947 - DNA, 348 bp, Homo sapiens
  misc_feature (24)..(24): n is a, c, g, or t
  misc_feature (179)..(180): n is a, c, g, or t
  misc_feature (285)..(285): n is a, c, g, or t
  misc_feature (307)..(307): n is a, c, g, or t
  misc_feature (312)..(313): n is a, c, g, or t
  misc_feature (344)..(344): n is a, c, g, or t
caggcatgtgccaccatgcctggntaatttttgtatttttaatagcgacagggtttcactgtattgtgcaggctggtctcaaactcctgacctcaagtgatccacccacctcggcctcccaaagtgctgggattacaggcatgagctaccacgccgtgccaactacatcttattcttgnntatttttcactttctctatctaactcagagcaggatacctagtaaaattggttcttcatcagagcggttgagaattcagagatgcttttttttatgtgaaccganttagacatttagagacattgtncactnngaaaatgactcagaaaatagaacatctatantggg

SEQ ID NO: 584948 - DNA, 528 bp, Homo sapiens
  misc_feature (489)..(489): n is a, c, g, or t
aattctgaaatttgtgattttttttttaaaagcaccagtgatgaagaatagaaattaacttagaattccaaaaagaatgagtattaaaaggtgtgttttagagactgttaaaaataaaaatcccttctgtaccaacctcccaggcaatcattaagagtcttttgactacacgatacaacacacattaagagtggatattgcacacttcattttagagggagttttatttgaattctgacccaacttcattttaaaatgatattttgtttggaaaagacttaaggctgttttctacagataacttccgagtagcagtaccaccagtctttaacttcccaaaacttgccaagtgcagcgataaaggtataaactgtgtttaattaaaaccacttgctttaagtaaatggagtaagagtttatcattcacatcacctcccaacttctcttatcatgccagctcagctcttctctgaaggaggctactgctgntatccttagtgatggaaaacgggtacaaggtcaacatca

SEQ ID NO: 584949 - DNA, 228 bp, Homo sapiens
cataaattcatgtcaaggaacagctattaagaatcaccctttatataaaaccagaattagtagaagaaaagataataaaaatcagagcagaattaaagattttgaaataaagtagcacaaaagatcaatgaaacaaaaagttggtctatgaaaagataaacaaatttgacaaatctttagacagaataagaaaaaaaagagagaggagccaaataagattagaaatga

SEQ ID NO: 584950 - DNA, 916 bp, Homo sapiens
agaccgcaacctcaacaccaccttcttcgacccctgacggaggagtgagaccccattactataccaacacctattctgatttttcggtcaccctgaagtctatattcttatcactaccaggctatcggactaatctcccatatcgtacacttactactccggaaacaacgaaacacaaggacacataggtatggtctgacgctatgatatcaatcggctctcctagggatcatcgtgtgggcacaccatatattcacacgcccgaatagacgtcgacacaacgagccatacacacacctccgctaccataatcatcgcctatcagcaaccggacgtccaagtataccagctgactcgccacacctccacggaagcaccatatgacctgactccgactgcagatagctcactgagccccacaaggcatccaatcctttccctacatccacacgatcacagatggacccagacaatggcacatcgcactacagcaacacccccaaccaacctaacaaccatcgtacctaccacagacacaagaatcagtaaccgattggcaagacacagctatccacaaccacttgcccactaattcacataaggtaagcagacacctacggcacacacaaatcatgacgggaccttccacatcaccacatgacagaacaccaccaacaaccccaagggcatatcaaaccattagccacactcaacaaccactacagaaaccacatacttacatacactacaacttaacctcactatatcccaatcacgaccatacacaatccatacaccattaattatccccactaacactacataataaactgctctaactccccttacacttaccccacataccgtctaacatacaataacactacacctcaacatatcatacacaccctaattt

SEQ ID NO: 584951 - DNA, 354 bp, Homo sapiens
  misc_feature (23)..(23): n is a, c, g, or t
  misc_feature (49)..(49): n is a, c, g, or t
ttttgagacagggtcttgatctntcacccagactggtgtgcagtaagtngcacgactgcagttcactgcagccagcctcgaactccctcagcttcaggtgatcctcccaccccagcctctagggtagctagaactacaggcatgtgccaccacaccgggctaattttttgtatttttttgtagagacagggttttgccatgatgtcaaggttgggtctcaaattcctgggcctccagtgatcctcccacttcagcctcccaaagtgttggggattataaggtgtgagccaccggaacctgaccaaattctagatttggtgtgtgtgtcttttggtaacatctctatgcatttct

SEQ ID NO: 584952 - DNA, 338 bp, Homo sapiens
ttttggggggttttgggggggggggaaaacaaattggggtttggggggggggggaaacatttttggattcccccggctggggttgggggcgggggggggtggcccccctttttttccaaggtttcccggggggttttttttgggggttggggctggggggttttttagggtttttttggaggggggggggggggttgggtttttttgggtcccctttttcccccagggggtttggaccccccccccccactttttttttttttttagggggttttggttttttttattttgtgcgggaaggggaattttttttttttaattaaaattgggaatgggga

SEQ ID NO: 584953 - DNA, 225 bp, Homo sapiens
cacgaggatcgtcttattgacaggtaatcctgtttctgtgttcacagtgtaaccacatctccctcaatgttcactgtgacaaagttgaatcaaacaggaacttctgtctcgaaatctttcataagatctgtcagtcccttgctgtccatgtgctgacttcctgaccagatacgatcccaaaacattccgtggagtcacgagcgctgccgtttggtcctgccccca

SEQ ID NO: 584954 - DNA, 175 bp, Homo sapiens
ggagtaggatatgtcgaccacgcgtcgctttatattcctataaatcattaatggcccagataaagttatacaacaagaacaggatgtaccaaaagagttatggtggagcgggagaggcaaggtgtaaggcgtagtgcgatataggacgtcagataaggagtgtaagcagtggata

SEQ ID NO: 584955 - DNA, 1068 bp, Homo sapiens
  misc_feature (18)..(18): n is a, c, g, or t
  misc_feature (250)..(250): n is a, c, g, or t
  misc_feature (287)..(288): n is a, c, g, or t
  misc_feature (306)..(306): n is a, c, g, or t
  misc_feature (545)..(545): n is a, c, g, or t
  misc_feature (835)..(835): n is a, c, g, or t
tgtttaggtattttcgcnataaaattctccgtttcccagggcgtctataaagcactctctacctcttcatgggatatacttttgctgcacgaacatacaatgctttctctttatctcttcatggcagacctaagtgtgagaagaaggttgctggtgatctaccacaccacagcctgagtacacccaagcacgcacctttaaaacatgcccaaacatatgtctgtgagaagaaagcaccaccgaattccantattcacagacttggttggcgcggggggcgtgtgttnngtttgtgcttgctggtantattaagtaatcacagttcatatccttgggaaaattctcccctgaaggccaattcattcgtaataaaaaccacattttgagcagtgagtgaatccagctggttgcactagtaagccattttcattttttatagcacatttcagctttccaagtattgcatatttgtatgggagaaatgttttctgaagtcaagcttaatgaaacatgaagtcaatgatatatgcaaacatctatttatntctctgctgtctgggaagttttgatcaagaaaacacttctgctcattagagaattgaccagatgcagtgctattaacatttctgtgatcaaataaagctcacccagatgaaagaagaatgcaacactaacagcctggaagcactcaaccggtggagatattacccccatcagttgaattatgctacgataccacccttctgtcttcccgcgcctcttacgtacctgtgccttgttacctttccgattctggcgcgccttttacccgctcatgcttctcttcctattatgngttctagaacctcctttcattcacgtacctctttagccctgttttttgcttatccgattgcactccatatcttcttcctctctatcttgctctcccctctccttgtcccttttactttcacacacctattcattctgtccacgttgcctcctagtctcttttatcccgttctttctctttcctcctcctcctccgtccccgtttctttcgcgccgttactttttgtcacttct

SEQ ID NO: 584956 - DNA, 117 bp, Homo sapiens
ccccacgcgctgagtatcgaggaggcataaccactcttgtgtgtggctatagggctggaaaatgctgaagatgactgctttcactggaggtcaaggattgtagtattgtgcagcgct

SEQ ID NO: 584957 - DNA, 303 bp, Homo sapiens
  misc_feature (46)..(46): n is a, c, g, or t
  misc_feature (75)..(75): n is a, c, g, or t
  misc_feature (123)..(123): n is a, c, g, or t
tgaaacatcagtaaaatccacattattccgcaatgcttctggagtnctgtattctggagatgtaaagaggcagtnaggcttaactcgaagttggttgtggggtgacaacataggctacccaangggtgcagtcgatttggggtatgacttcattcctgcacagtgtcacaaagatgtctctccaatctggttgtggtcatgctcatcttgaataaggctttttttgtttaataatgcatacctttatttcaagcacaaagctccaaagacaaggggtagttgcagcaaatcatcaaaatgaga

SEQ ID NO: 584958 - DNA, 1152 bp, Homo sapiens
  misc_feature (1152)..(1152): n is a, c, g, or t
gcgctgtcctgggtgcgcctcgggccgctgcgctcctggaccagctccccccagcgcctgggaggcgacccccagtgcgccctgggttcaaatgtgccctgtgcgatggcatgttccatgcccactctgtggggtggcgtgggatggctgacgtgggagtgtgttgcacgaatgccatgaaaatgccctgagaccacagcctgtgccagctcctgcgcagggatgggcagctgcgctctgacaagtttattgacctgcctgcgagccaacttcctgtgcctggagcttgggagactgcatgctgatgctgaatctggcctggccatcgaagccccacacgagcctggatggggcgacggccagacttgtaccacgtgacaccatgttgcccgtttcgcgtgccaccaatgctggccggatccctcctgtgtcctgtgtgcctccgtgcggccgtgatcttagggtttcgatggaggccgggtggctttgttgtgctccgttttatcaggggtgcttcacgatggttggaaccgttcctgagcctggcaaggggattatcagtgttggccacttttggacttcccccaaaggatcactgagagagcagttgccctggagccaaggttgcatgacatgtgcccggtttggttcccccaagagacagccacaccagactttagtgtaaatggatccaagaggaaatttccttaggaacggcggaggagggagaaacccttggggtagggaaacaatgggacaggacaactagtggtgatggggggcactttgtgtgggcgcacgcatttgggggacatggacagcgacggcaatagaaaccctttgggtttgtgagtgttttggtgagacaccccatttgtgggcagccggcaacagcgtgaggatgaacacccttgggtgtggtgtcgcacccgcacacagggaaaaccacacgaagcacacaaaccttgatgacgcaaaggcaggggtgaattaaccgccgacaaaaatgtagacccacaccgtttggtccgcagcaacacgagtggtgcccccgcattgggggtgtcagccacagtgggagacaacggcaccaaagaggtggccagggtgacacccgacaaacatgagtggtacgtcgaacaccaccgcgcn

SEQ ID NO: 584959 - DNA, 352 bp, Homo sapiens
acagccattaccccatcctctcctctcagattcaccgaggacagttccggtggtaaccttctcttagggtcgggaactcagcagagggagcagctgagagaggttccggccatagttgtttgtaatcttagggctctgggcttggctgaaaccatgcaggtcattgcttggtttcaggcttgcacactgccaggcgcctattgcttgcactctgtttcaaatgagggcacttccagcatcagcacagcatggctcttttcagatttcattgccatgaaggagttacatcatccaagttaaacagcggacccaacatggttacattctacaagctgtgaggttcttcaacctg

SEQ ID NO: 584960 - DNA, 88 bp, Homo sapiens
gcggccgcctactactactactgctcgaattcaagcttctaacgatgtacggggacatggagcaagttgctgtcataaaagctgcctt

SEQ ID NO: 584961 - DNA, 352 bp, Homo sapiens
agtccatctgggagtaatgggagatagtgacagactatcaggcattagattctcataaggagcctgcaacctagatctctcgcatgtacagttcacaatagggtacgcactcctataagaatctaatgccaccactgacctgacaggaggcggagctcaggccataatgcaagtgatggagagtggctgtaaatacaaatgaagctttgcacactagccttgccactcactcctgctgtgcagcccacctcctaacaggccatggacaggaaccggtctgtggcctgggtgtaggggatccctagtttaagggccttaacataaatgtaggctaacataagaactgagatct

SEQ ID NO: 584962 - DNA, 197 bp, Homo sapiens
gatctacaggatccccgtttgggccacgcaccgtgtgctttaggggtgcccagccattttaggtatgagaaggacactgttgtggtccaggattcgggctacatcttcactcgcctgtccactctatagcggatgtggcatcagtgcactgctgacgctcaggggtataaagtgctgcatggatccccaccctgtca

SEQ ID NO: 584963 - DNA, 100 bp, Homo sapiens
atgactgcatggcctccctggatatagaaagctccgaggctgtctttgcttccgccttctcacattgtatttcctgaatggagctcttccacctccttgt

SEQ ID NO: 584964 - DNA, 402 bp, Homo sapiens
gtctctattttcctgtctcgatcacattatatcgactccagtgtaatgcctctactgcgagaatcccaggaccgactactaccaagagctgcagagagacatctctgaaatgtttatgtcagatttatcaacaaggggtgttgtctgggcctctccaattattaagttcaggccaggatctgtggtggtacaattgactctggctttccgagaaggtaccatcaatgtccacgacgtggagacacagttcaatcagtataaaacggatgcagcctctcgatataacctgacgatctcagacgtcagcgtgagtgatgtgccatttcctttctctgcccagtctggggctggtgtgccaggctggggcatcgggctgttgtcgctggtcatagctggtgctgg

SEQ ID NO: 584965 - DNA, 149 bp, Homo sapiens
ggagggtcagacgagttcttcttaatgcgactccaggatttccatgcgttccaaccgggaagcctcgtcagcgtcttcttccgcggtgactttgccttcttcctcgagcatctgcacgacgccttcgaggtccatcgagagcatggtca

SEQ ID NO: 584966 - DNA, 557 bp, Homo sapiens
agaggagtcgtttctctgatcgctcatggagatccaatgccctgcctaatggaagacactcccaattctgtttgggtgctgcgaaggaaaaatatgtctttagagatgtggtgcagataacctgtctgcatgggtttgaagttgtggagggacgtgtagatgcaaaatctttctattcgacttgtcaaaagcaatggaaagtggagtacttccaaattgaaatgtcaacctgtggactgtggcattcctgaatccattgagaatggtaaagtggaagacccagagagcacttagttgggttctgtcatccgctacacttgtcaggagccatattactacatggaaaatggaggaggtggggagtatcactgtgctggtaacggggagctgggtgaataaggtgctggggccgaagcttgccgaaatgtgtaccagtctgtggagtccccagagaacgctttgaagaaaaacagaggataatgggaggatccgatgcagatattaaaaacttcccttgacaagtctactatgacaacccatggactggtgaagcgatc

SEQ ID NO: 584967 - DNA, 245 bp, Homo sapiens
tggcatatcaacctgctgcaggtgactctgacttctgaggaagaggcccgtatagaagaagagtgcagatacactttggaggatccaaaaggagctgcaatattaaagtcttctagatgtcatatcattatcactagtctacggctacacacaggattctagagtggaggttgtagcatgttagtcctattttatcatgatcgtgtgcattcacagcacgtaatattttacagatggcactggga

SEQ ID NO: 584968 - DNA, 154 bp, Homo sapiens
ggtcagcatcggcccccgccacgacactgctggaggcggcagcaagttccagttccacaccttctgcaacgtctgcgtgtcctttctcggtgcgcccgggggccacatatgtcgcttggggggccgcgtgccgctgggcggcgttggctgcagt

SEQ ID NO: 584969 - DNA, 1459 bp, Homo sapiens
  misc_feature (514)..(514): n is a, c, g, or t
tattatttgcttgtgcggtgaggtgtccgggggttcgcagtgttgggggttggttgcgtcagtgtttcgtttggtgagcgttctgttcttgctgcgagggctcatgttgggtgtggtgcgtctgtgtggtgccgtggagggccgtgttgtccacgcccgtgtgggggccacgttggtcgcccgtgctggcgttttcctgggggggttataattgcggtggaggcccctcctacgaagccttttgtaagaagtctttttctcccggggggaacaaatatgggggcgtttgaaaaaggtcaagagaaaaggggtttcttccacgaggatgtgtttcctgtcgggggacaaagggttgtcgttgtggggtgtcccgcccatgaaagtgtggggctcctcgctccccattgggagcgccgatgcttggggcttttcaattggttatacacgggtgggagttatttttcggctggggaccagttgccaacggtcccgcaattatatggggcctcccggngtatatgtgcccccccttgtaattttggaggtttgcacacccaccgggggtctacccaaattgcgcaaatcgcaaaggttttggctctgaggccttgataggggaaaaagagatttgtattctcccccccgctctctctggggtacaaaaaaaagccgcttggggagaaagagttgggccccccctataaatattctctgtgagaaagttctctcgggtgagaattgctgtggccgccccatgtgggttgagatatatggggtgtctctctgggcgacaagccgcacacattggtgggtgtcgtttgagagagagccgtgtctctctaggaggcgtagtatctcacccgctctcttgtggtggggtcctgcgtgtttgccttggtgtctcggtagatatatatggagagagcgcgaggctacgttttgtcgcggcttgtggggtggtctatctctacagaacggccactgttggggagccaccaagagagtgggcgttggctttgggagagctttgtgtcaaaaggggtcaccgcacaaggtcttgcgcccaagagagatgcgtctaagagaaggcgtttaaatgagaaatttatatctccctataatatccctgcgcacgccccacacttcttaaatacacgtgggtggagaagagatcggtttctagaaactgtgttgtttcacaattggccacatttaaggtttaagtatagttaaagagtctggttataatgagataaccacaatgcacttcgttaaacaccttcagagaggaaaggagaatgttttgtggagccacctttggttttcttttttgcgtgtggcacgttttaagttacttagtttcttaaaaatcacgtacgtttttaactggagaaacacaacttgagcccaaaaatttgtcacagaattttgagaccccattataaaaagttaaatgaga

SEQ ID NO: 584970 - DNA, 366 bp, Homo sapiens
actaaaaaacaaaaattaggtgggcgtggtggcacgcacctgcaatctcagcctactcaggaggctgaggcaggagaattgcttgaacctgggaggcagaagtcgcagtgagctgagatcgcgtcactgcattccagcctgggtgacagagcaaaagcccatctctaaaaataaataaataaataaagagaaagaaagaacagaaaggaactaaggaaccaccatgggaaggtttttaaaaatgggtcactgccacacagttaagcaagagtcccacagccctagggggccacccatcttggtgttaaattgacaactggaagaaacaacaaagacactagatcagctgccagaactagagaaatg

SEQ ID NO: 584971 - DNA, 406 bp, Homo sapiens
ctagaggatccccgtcgacggtaccaacaaacaaatatataacaaaataaaacggttattctgtacactacgattactggaatatcattaactatgtatacttggacatacccggctggtgaaaaccaggtaacggatctatattaccattaaagctcaaatattagagtcccatgcagagctgatcagatcgttaagctgaacctctgtttcaaagggccttgcaggcaaaggagatgagaactacctatggagagacatttagattcctactcataagcctaatggagatgactatacccaaagatgctgaagaatacatgtaatttactgatgagcttgtaaccactaaggataagatggattgatatggagccttagatgagtggctagagaagttggtaaa

SEQ ID NO: 584972 - DNA, 102 bp, Homo sapiens
atccctggaagctagccacgttgtcttcgtttccttcaccacgcaccaggagctcagagatcaaagcggctttccatcttttctcccagcttgagacaccga

SEQ ID NO: 584973 - DNA, 116 bp, Homo sapiens
agcgttgagacaccctcaaggccagtgctcccgtgcatccaggccttacctgtgctctgagctggcctggctggcaaggggtggaaacagctgtgcccaccagctcccaggagagc

SEQ ID NO: 584974 - DNA, 274 bp, Homo sapiens
ggtggtgaatgaactagaacatccagaactccaacaggagacatgtcagaaggattaacaaatctgaccttgaccctgggcaacatagtgagaccctgtctttacaaacagttttttaaaacttagctggatgtggtggtgtgcgcttgtggttccagctattccggaggctaaagtgggaggttcgcttgagcccaggagttagaggatgcagtgagccatgatcacaccactgcactccagccctggcaacagagcgagaccctgtctcttt

SEQ ID NO: 584975 - DNA, 248 bp, Homo sapiens
  misc_feature (79)..(79): n is a, c, g, or t
  misc_feature (89)..(89): n is a, c, g, or t
  misc_feature (102)..(102): n is a, c, g, or t
  misc_feature (133)..(133): n is a, c, g, or t
  misc_feature (149)..(149): n is a, c, g, or t
  misc_feature (183)..(183): n is a, c, g, or t
aaacttttttttaacaaaatgtatcattcgataaagtgaattttaaaaaagttacctaactcttcattttttatttccnaatcggaggnttttttaagctgnagaactggtatctggaataacttgctgtagnaatatcaaatcatttngttgcccattttgggccaaacttaatttacccgnaatcagtctcgtcaggattattaatttaccctttaagtttggattggtgggaaagtccccatctt

SEQ ID NO: 584976 - DNA, 260 bp, Homo sapiens
gacagtggtatggcatgatttttatcatcataaagaataaaaatggctaaagaagggcggcaaactcagctaattaagtattgtaaacactcagcatcatgtaagacatccagccaaatacagatcaagggtgttagttacagttacccaagatgctgtaacaggcaaaccgcaagtaccagtggacagacacccaggaggtacacagctcacgttaaggctaaaatgcgtgtttctgatcagtggatgaccttccgcat

SEQ ID NO: 584977 - DNA, 347 bp, Homo sapiens
  misc_feature (22)..(22): n is a, c, g, or t
  misc_feature (322)..(322): n is a, c, g, or t
  misc_feature (340)..(340): n is a, c, g, or t
ttgagacagagtttcgcacttnttgcccaggctggtgtgcagtggcgcgatcttggctcactgcaacctctgcctcccaggctcaggcaattctcctgcctcagcctccagagtagctgggattacaggtacccaccaccatgcccagctaatttttgtagttttagtagagaagtctttcaccatattggccaggcttgaactcctgacctcaagtgatctgcccaccttgtactcccaaagtgttgggattataggcgtgacacctggtggcctggctgacaagtggtagctttctttaaaaattaagttgcaaggtggnatctgaaaacatgtcatnaaacttt

SEQ ID NO: 584978 - DNA, 855 bp, Homo sapiens
gggaagcggcgcggctggcagctgctgggccagagccccggcgccctgcgtcagccgccgggtgtgtgcgcccgcgtagcccagctgtcgcgcctcgtggcccccacgcgcccacgcagcgcgcgcggggacccgggcggggggcagagggagggccctggtccagtgcaggagaatggggccggtcctcccgtgcgcaggcatgcagacgcggcagcccaggaggcggaggcagcggacaacgtgcagagacagcaaacagttgcccgacacgaaagttcaagccccgtggcctcagtacagagacccctgacacactgggacctgcacctggacacggcgccagaggaacacgaagtccgatgaggcagcacactcatcaccgacattggcaacacagcattaacaacgggaaaacattgggttagcaacccaacacgggaatcatccaagccccagagcctccacccaggatccgaaccaaggaggaaccctggtgcctggcccgtcacaccgcctgcacaagcttgtcacacccggccggcctaggaaccacacctaacacatgccggcatggacaccaacctggacagcctcgcacccaagacccctactggaccaccttccctagcccgacaaacctgcaggccaccacactcccacacattcgacaacacacggcgcactcccaccaagtagacgtacaattatcacttaccaacgccaactcactattgcccccgaaaacacgtactcgaacccatctacccaccaccactgaagcacaacaacaacattaaaccaacacacaaagcccacacaatgctagcccaaagaaccaaatagacacaatga

SEQ ID NO: 584979 - DNA, 332 bp, Homo sapiens
tctgcttgcaggctgcctccgagccaaagatttagctgacttgctggcctctatctggtattccgtggctccctggtccatgtgatcactcatcatgtaacgccatggactcagttacatattgcagtcgataaccatccgtgccagcttctcctggatcagcccagagtggtgaattttctccccaaactgggtacaattagtggcatgatctaccgacttagcaatgatgcctctcatggtacctgccgagtccgcagacatgccaaaccttccattgtcgaggatgtgcatggcaaacttgaaggtaccatgagagtctccgtcgaact

SEQ ID NO: 584980 - DNA, 144 bp, Homo sapiens
ttttttttttcccaaaaaaaaaaacccgggggctttttttttttatttggttttcccccaaaaaaacccccggggtttggtggggcccctttttaaaccccccttttttaaatttttttttttaaaaaaaagggggggggggga

SEQ ID NO: 584981 - DNA, 616 bp, Homo sapiens
tatgtacaacacgagacagttctctccctagctgcaactactaatctaacttactgtctctatggacttgcctattctggtcctttcttataaatggaacgacgcaacatgcagcccattgttttctggctgctttcactgagcataatattttcaagattcacccatgttgtaacacatatcagtgcttcattcctttttatggctgaataatactccattgcatggacagaccatatttgtcttatctgttcatcactgacagacatttgggtttgttccattttttggctgtcatgaataatgctgtcagcatgtatgtatgtacgcggtttccttagtttttatctaatgtcattttcctgttccaggatccccttcaagataccacattatgtttagctgtcatgtttctaggctcccttggctgtgacatttctcaggttttcattgtttttactgaccttgacagttttgagttctggtcaagtatttcatgaaaactccctcaattatggtttatctgatgttttcctcatgattaagctgggttatgtatttctgggaggaagaccagagaggtaaagtgccaccgtcatcacatcatgtcaggagt

SEQ ID NO: 584982 - DNA, 351 bp, Homo sapiens
tgtgtagatgaaacatttgttcttaatataattagtcctttggttcttcttttcacttgggatagagagtgatatgtacgtatcttagtttcttttttgttttggtccttttgggtcctatttaattttaagggttaaaaaaattttctccccttaagtttaacggatgggttaaccatatggatggtctccagtgcatggtaatgggctaaataaggtggaaaatgatagtgaccatgtatggagagctcatggtatgggaggcataactctgggctctttttacctttccttttatttaaatttaggggggaaccctctaagagtcacccgggcgggcttgtcaagctg

SEQ ID NO: 584983 - DNA, 255 bp, Homo sapiens
caagagagaggagccttctctaccaagtcatccacgagatagctgatgaaataatatctatctcatttctcgattccatttcagcacaggagctgttttccacactgatacacatgtggcgagcagtatctcttctgggaactgagatgccatttcaagaagaatttcactttctttagtttgcatgtaacttacgagagtgtctctcaggctccactgagggcggaagcgctcctcggtttgggtctggggcac

SEQ ID NO: 584984 - DNA, 123 bp, Homo sapiens
tgctgagattacaggcgtgagccaatgcacccagccggtcttttgttttttcttggagctttttttatctgtcaagttgtatcttcatagtaaattcctagaagttgccattgggccagcggg

SEQ ID NO: 584985 - DNA, 230 bp, Homo sapiens
ccgtctggtgtggtgactcgcgcttacgaactggtattccacaccagttacctatgacaacctgagtgctgctgtgaaagaaaccggattgtgaggtgcggcttgtggacagcgagtgtaccgcagcctgaaaaagggcaagaacatgcagcaagcacaagcaaatcccccgcaaccagtcaggtttacttcacgctaggatgttttgcagtgtgacttcgtggccgggg

SEQ ID NO: 584986 - DNA, 1026 bp, Homo sapiens
tttagcacaattataaaacctgggtcggatacacgggactgttatgtaaaccactcccagcaattcacaggtggggcgttctcttagtgtgcaccggtttcacaccaaaactttcgtggatcaagacgtttgttgtaaaatgacactcttttcttatactcgcaatccaagagccctgtccctctagaagaaatttgaacccctggacaacacacctctgagtggcataaaagcaaacacccattctgttttcccttgcgagatgtgctttttcttaggagagaaaagttgtagcacgccacccaattaccgtgggggtctaagccacaagattctgtgtagaataaggtctcacccttcacccagcggttttttcctcaagtagggaaaccctcctttgagaaagaacttaataatgttcgaaaacgcctcgtattgttaccttggtttaacaaggaaggtgcgcactagacattaccccccacagattgttaatggtaaactattgggaaccacccgtttgtaggccagcacagcccttttttcttaaacgcacagaattctcgtggcgttaaatcagattaattggtcccttgaggccccgtactctggctttccactaccccacgttaaatatggagataaattttaactttgcaccacttaccacggcccacagctattaaagttaacttggccttttggagaaatttgtaacttgaggtataaactgtaccaccccgcgttttgtaatttgtgaaactcatctctgtggaggatattatagcgaatccccaagccactttaaagttttgtttttgttccataaagatatgtcaaagtattcttatattattttaacttatttggaatttaccacgagcaccaccctaaggcccacttaggatattaccccaactgcctttaacccctctttttgccacccttttgttttttaagacccttttatttttataaaagatgaaacttataaataaatttttaaattgtaaatacttttaaata

SEQ ID NO: 584987 - DNA, 107 bp, Homo sapiens
aataaagtaaataaaacaaccactaaaagagataatttgatcaggaagggtttaaaacaatagacttttagatcaaatatagtacttgtcctcatttgatgttgtca

SEQ ID NO: 584988 - DNA, 962 bp, Homo sapiens
ggcaacgatgaaagatacacctagtcttgccagtctcatcgcggggtccgtcttcttcctgctgctgccgggaccttctgcggccgatgagaagaagaaggggcccacagtcaccgccacggtgtctatgacctacgaatcgcagatgacgatgtaggccgggtgatctttggtctcttcggaaagactgttcctaaaacagtggataatttaagacggccttagctacaggagagaaaggatgtggctacaaataactagcaaattccgatcgtgtacctcacatggacttcactgaatccaggggggatacttcatcagggcgacgatggccacaggaggaaagagcatctacggtgagcgctctccccgatgagaacttcataactgaagcacatacgcggcctggcatgttgtgagcaatgggcggagacagcaggcaaagacaccaacggcgtcccagttcttcatcacgacagtcaacacagcctggctagatggcaaagcatgtggtgtggggcaaagttctagagcggccatggaggtggtgcggaaggtggtggagcacccaacggaagacagccgggataaaacgcctgaaggatgtgatcgctcgcagacctgcggaagatcgaaggtgaagaagcctcctgcgcatcgccaggagtcggcaccacgggacggccgtttcctctagaagtgacagacttgggccgggccatggtacccaggccaaggggtattcatgctgactggcccggtgctggcatctggtgaagcggaccaccccccatccaccttcggaattgcctttggactactttatgtagaaacgacaaccggcctggccaataacgagaatggggtagcctgaaaagcgacacacccattacaaacacaccgacaagctttgcaaactgcaccgaaacagcccgtctgcgaaaacatgttcgctcaacaaa

SEQ ID NO: 584989 - DNA, 113 bp, Homo sapiens
gcttctccccttgttaggtagttatgagtaaatctgcaaaaggaaatgaaaatgccttaaattttatcaataccagaattattgtctttaaaaaaaaactaatacttatcttt

SEQ ID NO: 584990 - DNA, 1355 bp, Homo sapiens
tggaccaacaaggcggttaatttcaccggggtgcaggtgggctgagtccaaaaagtagtccgtgaagtggaaataggggtgtggggccgtttatataggattggggtaggctaggtgggaaattacagtcaaaggggatgggtcctcgtgtataggcaggaagttgggggtctcacaagggtgctcagggggggagctttgggacccaggaatgagccaggagaagaggaattttcacaggggtaagtgtcatcagcttaaggcaggcacgcgccatttccacttctttggggaattctccagcttacttcaggccatcggggatgccattactgtgccgggttcaccgaggggcatactgagtggcctataagctggggcctcagaagaaccggattatttcgcgtggtcttccttcccaggggtacaagagtttactccaaaagcgtggggcactcgtggggacgcggtccccagggggcgtttcccacaagggtcaactctgggaaggactcagagttttcagcgcggtttaaaccttgaagaaagatccgggatttcaaacatcggggcggaaacttgtccccttgggggcgtgggttaggcgccctgacggaacgcacacagaattcgcaaggcggggcacctttcctccatgggaggccaaagcagcccaggacggacccgggggcatttggatctcccccaaggggaagggccccccgtgaatccggagctgattggggcccccaaaacttccattccgccgttggctctgtcacaagaagaacaccagaaacagggggttcggggggtgggggccaacaaagggctgggcctacttaccaccgggtgggggcaggcggatggggacaatgttcgcggaaagaaccgtggtccgatgactttaggcccagttggtgtctccaggggcaccggaatcagccagaagcacactttccccgtgaagcaggacgtggtaactacaatcaacagagcgccttccacgcacaggggccccacgtgagtaaaccctctgtggaccgcagacttcaacggggcaccacagggcgcgcacctcacagaaaagcgggctgcggataaacgcggcaacacacgcggtctcaaaaacggttcccccgagaaatcaggcggaacatatatcgagaccgcacactcattcgaacagatcacccccacgacacgaagactgtacaatacagcccgtacatcgctacttatgccctgttgtacgaatgtagttagaagcagcactcgaagaaatgcatcacatcaatctagctacaactccgcatctaccactgcagcaaccatacgtctatagtagcagtatg

SEQ ID NO: 584991 - DNA, 399 bp, Homo sapiens
ggtagcacttatttctagacagttgccttatcaaataccatatatgttgtgccatttaatctcacagttacctgtgcattagagattagcatcaccacttgatatatcctaatattggtacaggataaacactttaagtaatcagcccacaattactcaccaagaccttaagcctcccaaagtataaaccattcttatgttcctcagtgtacatccatagagtctaagggatgtaaggccttgttgaagccagttttgaccagaagcagcaatgagcctattcctgtttgttctccatgttaatggggcattgaaaattcactgattaatcaatccctagtctgaccccagtgttatctatgcaggttcacaaaacttttagattactttacaccccct

SEQ ID NO: 584992 - DNA, 199 bp, Homo sapiens
ggtccatgcagctgggcgacagagcagactccgtctcaaaaaaaaacaagaaaaagaaaaagaaaaaaaaagttaaagaagggcaagaggaagagaactagagttggtggggtgcttttgatggatttgggagaggcttctccccatacttttcaattaaacttattcttcaacaatgtaagcaacccaagcttgcttg

SEQ ID NO: 584993 - DNA, 954 bp, Homo sapiens
atcattatcgtagcatctttgctgatgcgtcgtatctgctaacgtaactggtaattgttgatggcagcggtgacacgtccaggcaatgcccgacactggccattgggttcggggtttcttctttctttgagtggtacgtattggctgtgtgaccgtcctgttgtgagtaaaacatccacatggtacagggcatcctccatgcttaattagaatataggtttatacgtggttttaaatgtgttggcatcttatcacttgggattaacacacgtgacaagggacgtgcgtagagaccaatcgtgtacggcgtttgctatgttcggggactcgtcttgaataccatgttgctccgttttaatggtacaagatactgctatctgggtcgccctgtatctcctgtagcttctgaagtagtaggcaatagtgtattgcaggtaggtgactgggagtggacgattagagggggcacactcactgtggtctcttactcttgattgtttgttcttaccaggtacatatagctcataaggctccattgtttagcccggccaatccctgcgcccagtctttctaccccttggtcctgtgccccatgttggcacacagggaagtgtggctcttgtaataccgccaccccaggctcactcatgcaccacagagctgggggccacctcgagaagtgtcatctctcgccgtgagcacagctattcccctcgctagcagtccgaggatcatgagcaagattgacgtgtatgcctggcggcagagatggcctagtggatggaataggtgttctagaccagtcgtttgtaaggcgctctgtcggcactctgctgatacgcccccacctgacagccccatcctcaaagactctctataattactcatggcaggttctagagacttaaggggaaaagctgctttcaaggccaccacatgtctgtgcttccccaa

SEQ ID NO: 584994 - DNA, 189 bp, Homo sapiens
acccccccccccccccccctttttaaaacccctggggggttttttgggggttttaatgggggccccccccccccccccctgggggccaaagggggggggggttccggggacccttttaaggggtttttggggggggttttttggttttccctttttttttttatccggggttttttttggcccccccca

SEQ ID NO: 584995 - DNA, 237 bp, Homo sapiens
  misc_feature (84)..(84): n is a, c, g, or t
tatatgctgtctcaatgtagtacaaatgctgttatcaacatttttcccagttcttagtgtggtgccttagccatacctaagcangacgtgagaatgagatgtgcaatcatttactcctaagtatctgttgagctcccacaatgtcccagacacactgtatttaagcacccagggattgcaggagtgaaggattagacccccattccctgttccccatgaaaaagcttcactccttct

SEQ ID NO: 584996 - DNA, 201 bp, Homo sapiens
gggcttgacgtacaggaactcggggtctttatcgatgtatcggctgatcagccacggacaggcgatacggtcgatcttcggatgttccctcgtaatccatttcatggcaccacctcacagggtgagtttcaagacgaggcctatgacggcgcaggccgctatgacctcgatcacaccgcgtttgaacttgaacagcgcaat

SEQ ID NO: 584997 - DNA, 765 bp, Homo sapiens
gacaatattacacagctcgtcctcgtttaattcattcctgggccttgttcttcgtttaacttactgtgcctggttcgacacatacagaaatcgtgcactatgcaggccggcagtgcggcaaccaaatcggcgccaagtattagggaggtgatcagcgatgagcacggcatcgaccccacgggcacctaccacggggacagcgacctagcagctaggaacgcatacaacgtagtaactacaatagaggccaccggcggcaagtacgtagccccgcgccgtgctcgtaggatactaggagcccggcaccataggactaccgtgcgctacggggcccttcgggcagatctatccggccggacaactatacgtatttcggtcagagtaggtagctgggaacaactagggtccaaggggcactaacacagaaaggcgcggagctaggtaggactcggtgctaggatgttgtgacgcaacaggcaggctgagagctgtgactagcctgcagggtttccagctgacccacgaccctgggtggggggactgggtctgggatgggtaccctcctcatcagcaagatccgggaggagtacccagacaaggatcatgaacacgtaaagtgtggtgccttcgcccaaagtgtcagacacagtggtggagcctaacaagccacctctcagtccaccagctcgtaaacacacagacgagacctactgcattgataacgaagctcctaagaatttgttcagaacctaaagtgacatgcca

SEQ ID NO: 584998 - DNA, 95 bp, Homo sapiens
tgggggggggttttttttttcccccattttttttttggttccaaaaaaaaggggggggggcccccttgggggtcaaaaaaacccaaaattttttc

SEQ ID NO: 584999 - DNA, 443 bp, Homo sapiens
atagatgcaatgatgtcgggttagtgaagactcggagatagagtgactaggaagatgtactaaggatggcctatgaggagagtgagatggagagagggctggagagttacagaagttccatttctggtggctcctgtgtctgaggatatgaaaattgcttcttttcctatagcgcgaagaataacatgatgtttaccttccacaataagctgtttactggcttccacaacgtatgccttccataatatgaccatatatcaaatctacctcacagcatttttgaatcaatctcacagcatcctctgtggactgttatacggtatgcgcagtcactttctgcttgagggatactccaatctcagaagataaactcctggtgactcacgtcttgcgcctggggttgctgtacatattatctgtgcgtttccatagaaagatatctg

SEQ ID NO: 585000 - DNA, 772 bp, Homo sapiens
  misc_feature (11)..(11): n is a, c, g, or t
  misc_feature (104)..(104): n is a, c, g, or t
  misc_feature (130)..(131): n is a, c, g, or t
  misc_feature (133)..(134): n is a, c, g, or t
  misc_feature (146)..(149): n is a, c, g, or t
  misc_feature (174)..(174): n is a, c, g, or t
  misc_feature (216)..(216): n is a, c, g, or t
  misc_feature (286)..(286): n is a, c, g, or t
  misc_feature (346)..(346): n is a, c, g, or t
  misc_feature (406)..(406): n is a, c, g, or t
  misc_feature (423)..(423): n is a, c, g, or t
  misc_feature (436)..(436): n is a, c, g, or t
  misc_feature (484)..(485): n is a, c, g, or t
  misc_feature (501)..(501): n is a, c, g, or t
  misc_feature (503)..(503): n is a, c, g, or t
  misc_feature (531)..(531): n is a, c, g, or t
gagggccaggnactgctgactgtgaccactggacagttattcgtgtctcttacaattaccaaacagaatggacaagcttaataaaataaccgtccccgccagtnagaagttgaggcagcttcaaaagatnntnntttttttttttnnnnttttttgtgtgtaataatgaataanatcaaaaagctaaaagtcaaagcacctccaagtgttcctcgnagggactacgcttcagagagccccgctgacgaagaggagcagtggtccgatgacttttacagcgactatnaaaatccagatgagcactcggactcagagatgtacgtgatgcccgccgaggagaacgctnatgacagctacgagccgcctccagtagagcaggaaaccaggccggttcacccagccctgnccttcgccagagggagntatatagacaatngatcaagccagaggctttccccacccttcagcaagacacttcccagtnntttttttttttttttntntaaattaatgcttacctccatcctgtcnggctcttattgtttttcataaacctcaagtcccacccaaacccaaaggcctccttgaggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaca

SEQ ID NO: 585001 - DNA, 709 bp, Homo sapiens
  misc_feature (338)..(339): n is a, c, g, or t
  misc_feature (348)..(348): n is a, c, g, or t
  misc_feature (350)..(350): n is a, c, g, or t
  misc_feature (361)..(361): n is a, c, g, or t
cgagtttttttctcccttgacgccataaagtcaatttctcggtctaaatcctggttctcaaccctagagaggatcaatgtccccatatcaacaggaagtagagccagtgacatttctacctcacccagagtgaggaccaggttggttgtgtgaggtgaagcagagctcttgcggggggctagtgtcatacccctaaccccgccttccattaaggccaaagctgggccctgcggggctttgtcccatggccagacgttttcatcagaattaggtgctgttttcttcattgtgtggagagtggatttgatggaagaaggtcatgtaattgggggaggtgnncagcctgtntntgaactgactnggaaacctggtggtgaattgagcattggagccattattagggcagcacggtatctatacgaataagagccatggcagattatgacagatgtttgcagaccctagcctgaacgctgtatacgctttgtaacgcttgcatctgcccatgttctaggttcatacgcccaggtcaagctattccatactgtccactgaagctcatgcacatggattctacgttaatcttcatgttaacaggatgttttaactggattgtactaccccctttttcaaataatgatcgtctcacaggcctccggtttctctggatttttctacctgccccgtactatttgatagcttggtgcct

SEQ ID NO: 585002 - DNA, 839 bp, Homo sapiens
  misc_feature (38)..(38): n is a, c, g, or t
  misc_feature (95)..(95): n is a, c, g, or t
  misc_feature (114)..(115): n is a, c, g, or t
  misc_feature (136)..(136): n is a, c, g, or t
  misc_feature (161)..(161): n is a, c, g, or t
  misc_feature (176)..(176): n is a, c, g, or t
  misc_feature (202)..(202): n is a, c, g, or t
  misc_feature (219)..(219): n is a, c, g, or t
  misc_feature (231)..(231): n is a, c, g, or t
  misc_feature (315)..(315): n is a, c, g, or t
  misc_feature (327)..(327): n is a, c, g, or t
cccgcgggtatctgaatttgcctcattccggcggcggnccaaaggaatgacgggttgggcccgcggcggccactgtctccgcgctcactcacgcnggccttcgctcgcgcccgnnaggtctcttcgcgcacggccnggctcacgttcgcgcttctttggcngctctgcgttccggnccgcgcacccctacgctaccacggcngactgggcaccgccgcngctgtcactggncagccgccgccgccgcggggacgacggggcaggcgagctggacgggcggggcaggcgtcctggttgtgacgcacgccaccgcgngcgtgcgcgtcnccgcttagcaccggccctcagtgcgcttgcgccactagatgacccgccccctcgggctgtcggggggtcgagacagtggagtgttcctgatgccagctcacggagggaatccagggaattagctgatgccaagagcctctttttggccagcacttactaagcaccagagacacagcgagaagcagaagcatacgagcacatcagtgtgattctgctgtgatgaagggcaagagagggctcactttccggcgtgacattcaagctagccccgaggcctgagcaggacccgcccaggggaagatctggaggaaagccatctgaacatacaacaagagcaaaggcctggtggagtcaagaccaccttggctgccaggtggaatggtggaataactcaggagtctgtcaggtctctgagatgtcaaacgggtaaggccttgtaggaagtaggcgtttgaatgagatcataatttgagagccacagacagaaaaataaatttgaaagagttcactca

SEQ ID NO: 585003 - DNA, 229 bp, Homo sapiens
gcctagagcagaaaaaaacaaacacacaaaccaaaaccacaaacaaggaccaaccagacagacaacagaaaacagaacgaaggagggacaggagacaacacggaccaacaaaccaaaccaaagagcagtgaagagggcaaagcggggagaagagggcgctgcgagagcaaagggcatggagcggagggggggcccgcgccccgaggagggcaggcccggggcgccgggc

SEQ ID NO: 585004 - DNA, 430 bp, Homo sapiens
gaaccaacacggaaagctgaagggctttggaatccaatggcctcaacctcatcatttcccctttaagtgagtctatccagagaaatgacagaaatgtgaacccagatttctgttcaaagaatgttcacacagtggtagatctaacaggggaaaaccctttagttgggctgtgtacttgtgatatgtttgcttgtttgcatctgtatcttattgtcaagaatgttgagccaaaacaacaaatgccatggacaagcaccctacaaggaccatgttaaaaggcactgtccacttggcactagcaaaacactttttgaattcatttgctcaggatgttaaatatttgccacactggcttgatggacatagacctaatggagcccagtgaaagtaagtgtaggcttccagaatggtaatcgaattcctgcagccc

SEQ ID NO: 585005 - DNA, 598 bp, Homo sapiens
acacctggcgcaatagatatgtaccgcacgggaaagatgaaaaattataaccaagcatatatagcaaggactcacccctatccttctgcataatgaattaactagaactcactttgcaaggagaaccaaagctaagccccaaacccactccagcttacaaccagacaaccttagaccaaaccatttacccacatagcgtataggcgatagaaattgaaacctggcgcgatagatatagtaccgcaagggaaagatgacaatttctaaccaagcataatatagacaaggactagcccctataccttctgcatcatgaatcacctagacaatcacctatgcaaggagagccaaagctaagtaccccgagaacaggacgagctcacctaagaacagctaaaagagcacaacccgtatatgctaccaaactagtgggaagatttataggtagaggcgacaaaacatacgagacacaacttagccaagacattataccccgatcacgtataggcgctagaaatagaacctggcgcaaaaatataataccgaagggaaagatgacaattataaccagcaatatatagcagactaacctatactc

SEQ ID NO: 585006 - DNA, 157 bp, Homo sapiens
tcagcgtcgttacggctgggagtacggaatcagatgttacagaggatggtgagagcctgaagatccctcaggaccagagggtcagctgtccgaggagagagaaagcagatcagcagcccctgagcgggaagaggagctagagcctgaggccagatga

SEQ ID NO: 585007 - DNA, 1027 bp, Homo sapiens
atgaggcggcggttgatcccagtgctggctgagctggctggctgacctgaggcggcgagcggggcccggcgccgaccctgagtgcagcctgaccctgccctctgcgcgctgcgccctcccctggcctgggcccactcgcctgcgctgcccagccatgaacctggcgagccagagctggggaggcctggctgccggccagctgctcttcgccaacttcaaccaggacaacacagaacgtgaacaggggcatcaagagcagctggtcttggccgctcgcgctgttgctctggtcccatagctgtctggtacgctaagtccggttataacatttctctccctttcttcctgtggataacgctgcgaacagactcctatgcaatgcaccgactaccggaagcactgtgtgcactcgctagcagacgcacttgtctctccacgcagccatagctggccatcgctgagccctctacagcaccacaggcaacgctaacaggctcatgccaccttcacagcaaggcgaactgacgactcctgcaaacctaccacgctacatccaaacaaccgcacttctgggcctagtgaacgcttcaacccaggcacgcaggccctggactacgctattgccatgggcagcgacgtccccatgctaccactccaagcaaccacttccgcgggaccatgcaacgcgtgccttgccgactaccgcactcagggccagaacggccataccaaagacccctgacaggggcctgccgctgccggcttggtcaaattcaaccaaccggatcgcaactggccttaccttggggctggtaccccccgcgggcaagccgccgaacccaactccggcgccacgcagagcgacaccagcggtcctcaccggagctacccgaatttcaacattcctggaacgaagccttggccaacacccacttggactatccccggcgcccttccacgcaaccaggtcccatttacacccgccgccacttgggccgttttgcaagcccaagtgtgggcacacttg

SEQ ID NO: 585008 - DNA, 190 bp, Homo sapiens
tgggggggggggggggcttcttttggggaggggggaaagggggggggtttttttttggggggcccgccccaaataaattttttgggttggggcccccccggggggggcccccgggcctttttggggccttttttttttttttgggcccccccccccccggccccattcccattaagggggcttttcccca

SEQ ID NO: 585009 - DNA, 309 bp, Homo sapiens
taatcattccattaaactctcttcttcttggccgagtcactctaaatagcaacgagtcagacttcaccatgtggccgttactaggttcaaattcattactcggaaactgcaagggacgggaaatttccaggttttgtttagcattgaggtcaggattcaaaggcacctgctttttacctcctgggaacttgcccttattggacaacatcacatcctttcttctttttgtggcaaacgtttcacaagccaggacttccagggctaaccagcacattttgttccattttctcgcagtttggtgcatggcct

SEQ ID NO: 585010 - DNA, 812 bp, Homo sapiens
ctggctcctggacgcgtctgggtcctggcacccgcctctccctggctcgaatgccccctccactcccgagccgggtggatttctccctggcttggggcactcaatgctggcttcaaggagacccgggccagtgagcgggcagagatgatggagctcaatgaccgcttggcctagctacatcggagaaggttctgctttcctggaaacagtcaaaacaagggacgctggctgtctgagctgaagccagactgctgtggccaaggatgccctaccaatgctggcaagacgtctaccatggctgagcgtgcgagatgcatgcgagtctgcggtgtcgactcaactcagcgcgccaaacagcccggcgcccgagactggaagtgtatgacgtaagggaacaagtcttgagcaccaagtggagccctggtcctagcttgtgaagggccatgacacgcatcccgaggcattgaaacctcaaacactaggaagggcttgggagaaaggcacgtaggcaagcgaagcgcgtgtggcttgcccctaatacgaagcgagggaaatggcatggactgcaatgtcctacccctgtgcccggtcttggatccttgggatggctgcgacacgatccgaggtcgctcgcgagcgcatggaagatcccgcgtgtcctggcacggacacgagtcctagcgacggggaggcagggttcggagcgaaactcccaaggcagcaatgctggccccagaacagcgagggtccagtgttggggaagcatttgactgtgggccaaaggcacaaggaccggtcaccgggaaggacca

SEQ ID NO: 585011 - DNA, 857 bp, Homo sapiens
agcggggggcggggcgcggcggttccggcccagccatggcggacgaggccccgcggaagggcagcttctcggcgctcgtgggccgcaccaacggcctcagcaagcccgcgtgcctggccggcgtgcccggcaagccggggggcgcgtggcggctccaagaagctggtcatcaagaacttcctgagacagaccgtctggcatgaccgacgactacacgcaggacacgtggcggaagctgcgacgaggcggtgcagggccgtgcagagcagacacctaccatcaggtacaagctcgacggagctctaccaggctgtggaaaatctcgtgttctcacaaagtgtccccaatgttctacaagcaactgcgtcaggcctgtgacgaccactgtccaggcacatgatccgttccgttgagagaagactcactagatagttgtacgagtttcttaagagaagatgaacacgtgctggcaggaccactgcagagcaagagtgatcatgatcagaagcggtcttccgtgttctttggatcagacctatgtgcgtgcagaactccgacgcctgcctccatctgggatatgggcttaggaactgtttgagaacccatattgttagtgataacacatggttcagagtacagaccattgcatggcatcctacgtgtgatcgagcgcgagaggagcggactgaaggcgtggtagcggagcctgtgtgcaggagcctcctggggatgctgtctgagctgcagggggtataaagattcatgttgactgtaaattttggagagactaattggtaaaattgtgggcaaggccaaggttaatggagcgaaagaaaggttcggatatttttaccagg

SEQ ID NO: 585012 - DNA, 257 bp, Homo sapiens
agttgaagtgctccgagaggtaacctcttttaccagggcaactccccaggacagtgagaagagttggttcaagcgtggcgatcacccggaccctgcagcagggcgaggagagccttttatgagctgacgaaacatgatctgctctttcctgcagacagctccagagcagttcccctcggaagagttcccaatttccgaatccaaagtctacatggacgtgaatttccccggcagcagttccactatagggcgtaccg

SEQ ID NO: 585013 - DNA, 353 bp, Homo sapiens
  misc_feature (154)..(154): n is a, c, g, or t
  misc_feature (172)..(172): n is a, c, g, or t
  misc_feature (205)..(205): n is a, c, g, or t
  misc_feature (223)..(223): n is a, c, g, or t
  misc_feature (250)..(250): n is a, c, g, or t
  misc_feature (256)..(256): n is a, c, g, or t
  misc_feature (299)..(299): n is a, c, g, or t
  misc_feature (301)..(302): n is a, c, g, or t
ctttcatttgatactgcatttcccagagttcagtaagcgaaataacttttcttgttcttgcttcttcactttgtacccataagaaagggtagaacgtgaaggcttccgttgccgataattttattacgtcttctcgccattgctgccatcgtanattttcatagaaggtatntaaatcaccggataatgcccactgaagaaactnagaatatccaacttccanactttcccaattcagcgtatctggcgnaaaatnataaaagcagccagtatcttccccaagatcgccaccattaagngnnaaaattacccctgcgacatcgtcagcgatgggtaaagcccgcacgcctgcg

SEQ ID NO: 585014 - DNA, 984 bp, Homo sapiens
gaactctacaggctcaagattagattatcgtcgctatgcagacactctcttcgatatcctggtggctggcactatgcttgcccctgctaggaacgctgcatcagatgatgcgtgactaagaccatatgatgacgcaaccagctgtgtgttatatcaacccaagtgagcgatcatgaaatcatccgagactatgtcgcagggtctccacattcaaactcactcaggagatatcacgctattcggagcaacggcagtttgcaagatgacacggaagagaagcttgctcctcttcctgtaaagccttgttccgaagcagatgcaagatgaacgtttggcgagtgcctgtcggggatcctgcgtggagcaatgcgcacccgggctctcgcccaggctatcctcaccagtctcttccagcgacaggttagtctaaagaaggcatctgcggcctcatatgctgtcaggcttcctcagaagcgtggatgggtagacgaatggatgccgaaactcgcgttgaactcgtcgtttgatgcacatcgccactcggtagacgatgaggctgcttgaactctttgccgagtgaaaccagacagacgtgtggatcattccgctgaatacttcactgacgcccggtccttaagtgagctgtccgagtcctccgattcctgcagtccctggcgtcgccaggacgaactggagaactgggtccaggcaccgtcggtcccaagaaatgcccgacaagaggggtgggtatgtgcacacaagaatgaggggattgtcttccgaacagacggatggcttctggggcatgatatgaggccgtggggggccaccagagccattttcgcccacgggcgtgtgcctagaaaaatgacctggggggtatcaagagaggagacaccccagggaggaatgtacacatttaccacaaagtggttaaaaagtagagacaacaagcatacacacaacaactggaacacgcatcgt

SEQ ID NO: 585015 - DNA, 107 bp, Homo sapiens
agcgtcatcttcgattaccgcctgagagcccccgagatatctcatcaacaaccgactaatcaccacccaacaatagactaatcaagctaatcctcaaaacaaataga

SEQ ID NO: 585016 - DNA, 202 bp, Homo sapiens
ccgccgcttcttcactaagtagcacactcttcatctgcttcacccgttcactcttccatctgggactctctctatatatagctctcacagggttgagaggagagtaagaacttgtatatattgtgctcggctcgctttgtactgtcggcccctcatgtggacacagtgccctgtgctgctctgctctgtgaactccctgtcg

SEQ ID NO: 585017 - DNA, 373 bp, Homo sapiens
  misc_feature (55)..(55): n is a, c, g, or t
  misc_feature (154)..(154): n is a, c, g, or t
  misc_feature (182)..(182): n is a, c, g, or t
  misc_feature (286)..(286): n is a, c, g, or t
  misc_feature (326)..(326): n is a, c, g, or t
  misc_feature (369)..(369): n is a, c, g, or t
tcaagaacaatttggaaattcacatgtcctattctaagctgtttctttcccccanaccctcgaatgggagcagattgagttttagaactaattgggctgggcatggtagctcatacctgtaatcccagcactttggaaggctgaggtggatggntcctttgaccccaggagttcaagaccancctgggcaacatggtgaaaccatgtctctacaacaaatacaaaaattggcagggcatggcacacgcctctagtcccagctacttgggaggctgaggcgggaggntcacttgagcccaggaggttgaagctacagtgagctgagnccacgccactgcactccagcctgggtgacagagcaagacactntctc

SEQ ID NO: 585018 - DNA, 900 bp, Homo sapiens
aggctgcaagtcccggaacaacaggcacaacatcatggagcaggagcggcagcggcgacggggcaggagctcccccaccccgatccgcacagtcaccgccccgtccctgggggcgggcggagggggctggcggagcgaagtggtgggtggggggttggatgtaaagtaggtcagcgtgcaggtattgttatgcatggggatggtccggaaggagacaagtgtcgtactcgcatgacctctctgacagtccgtatagtgtagtgtgcaagtatttcagcgagggtactgtattatggagaccgtgcgagatatgaacatagcaaaccattgaaacaggaagaagcaaggtgtacagagctaactacaaagtcatcccttgcctgttcctcaagtctctcatcgatagtttggacgcacgttgtgaaattgaatacaggcgaagctgagtcacgaaattcaatgttttgcaactgtaggagcaggttcagagcactgggtgactgctattgagttgttcctgggcaacccttatgtgggcgtacgtgggccttcctggagtgagcacccctggggctcagtggcccggaagactccgagacagaagccaccgccgtgggcaccaaggaagcaggttgtgccctatgctgccgtgggaagagtgccgataccgggggcactgtggtgtttccccgcggcatccttgtgccttgtgtggccgcgagtccggcatcccggggggtgcccgggatgccggtattcaatggtgcttggccccgttgaaggctgtgccctttgcggccgccgccgacttttttggactctggggggtgttttaaccccgcttggtggtgctccccggggccaccgtctgttctgggggctctgtggcacactcgtcgg

SEQ ID NO: 585019 - DNA, 859 bp, Homo sapiens
  misc_feature (351)..(351): n is a, c, g, or t
gcaaaataggttaaggtatacttgttggaaatggagcttttcctaaagctattggagagtttctttcgcgaccttcttgcgggacccaactcttgggaaggaagaggcccactggtattctgcacgaggcaccttagcttgttcagaatcttctcgcacttgttaataaaaggcttctttaccccacgaaagcacttttttaggtcaattgcgtttgtacccacggtataatttttcgccccgggggaatgggttaaagaggtttgggtttttctctggttgggaaattggggttgtgtgggttatatttttttgttagaatagcgctttatagtcgcaaggcgcctgttntcttgagggcacaataaacacacggttgtcctgttgagaaaccacgcacatggtgcctgtcctgcgcctttggtaaacctgcacatggagaaacctgtgttcacacacatggggttttttctcgtccacacggttataatacaacgagaatatatatgtgtataaactgtaggagaaaatgcacaagatgttagaataatgtgtgttagaccacgcttgcactgagagggttggttatattataaaatatactataacactaataaacttataattatactttataataatgtagataataaattaatagtatggtgggcccttgttttacacaacctttataattacacttttagagaatcacaagttgatagtcttagttatcttttgagtaagagaaagctttcctaaagtcccacaaacaatttggagccactggcacgctaaattttgtaaacttaagcattcatatggactacctatggacatttatttaagtgattgacca

SEQ ID NO: 585020 - DNA, 861 bp, Homo sapiens
gggagaccggggtatcttgctcttggtgtacccgtctttttgaaatatagacatggatttataatggcattttatatttggcaggccatcatagattatttacaacctaaaagctttgtgtatcaaaaaatcacattttattaatgtaacatttctaatcgtatacttgctcactgttctgatttcctgtttctgaaccaagtaaaatcagtcctagaggctatggttcttaatctatggagctgtgttttaagaagccagttgtcaatctgtggtacccccacagttgtggccctgctgtcctactgtttacatagaacaactgtttttacatttggttcaatggtattagagtaattttttctctctgcctccttgtgtgtcttgttttaacggagactaacctccaggagtaggaacatggattcatcatcctccaaagcaagaggcttaggagagaaacaccgaaattcagatagctcagggactgtaaccagagaactacatttttcttatggccttgaatgttaacacacaggacagcagatttcttcagtgactttgtggtcctactaaactacaaccagttgtgggtgacaggcctggtaaagtcccagtgttagatgagtgacctaaaatatactaagatttctaaggtaatgggctctcaggtccaagttcactattctaagcagtgcaatcttcccagttatttgcgatgaagatcctgtatgagatgtctttaaaatttctaaaggctgatgttaccaagggcgggaataatacccatggcatttcaaacccgaagaagagaatttcgggacaattaaaagtcctaaaggtgggctgaacatgctcaaa

SEQ ID NO: 585021 - DNA, 180 bp, Homo sapiens
cgaacagctcttacgactaagaaaataaaagaactcacagaaatgaatgatacctgagcttggcccaggcagcacagctcagtggttaacggtacctgttgtgaatcccaagtactaggcactgtgacccaggcggctaatccattcagcctatgcgtgttcccccccaagaattcttcc

SEQ ID NO: 585022 - DNA, 459 bp, Homo sapiens
  misc_feature (37)..(37): n is a, c, g, or t
  misc_feature (47)..(47): n is a, c, g, or t
  misc_feature (75)..(75): n is a, c, g, or t
  misc_feature (94)..(94): n is a, c, g, or t
  misc_feature (111)..(111): n is a, c, g, or t
tggaactcctcctaaaactcaaggaaaagctgctgtntgcaccccangcccccaaacttcaaatctttgcccttnaagctaacctaaccttgantgattgaattgattgantgaattgaacagaatctcgcctcggtcacccccaggctggaatgcagtggcacgaatctcggcctcattgcaagcctccgcctcccgggttcaagtgattctccctgcctcagcctcccgggtagctgggattgcaggcacgtgcccaccacgcccggttaatttttgtatttttagtagagatggggtttcgccatgttggccagactggtctcaaactcccaacctcgagtgatctgccatcttcagcctcccaaagggctgggattacaggcatgagccactgtacctggcctagctagctttaaagtacagtgagttatggtgttggtgagaagtaaaaaaaaa

SEQ ID NO: 585023 - DNA, 215 bp, Homo sapiens
  misc_feature (2)..(2): n is a, c, g, or t
  misc_feature (19)..(19): n is a, c, g, or t
  misc_feature (91)..(91): n is a, c, g, or t
  misc_feature (106)..(106): n is a, c, g, or t
  misc_feature (112)..(113): n is a, c, g, or t
  misc_feature (117)..(118): n is a, c, g, or t
  misc_feature (156)..(156): n is a, c, g, or t
  misc_feature (199)..(199): n is a, c, g, or t
gngagagagagagagaganagagagagagagagagagagagagagagagagagagagagagagagagagagaggagagagagagggggctntcagcctctgacagntcaggnngtgnngccccatgccactccacactgctgggacatggcagggncttcacagtgggggtttttagctggctcacagggctccctcancctggggaacattaaa

SEQ ID NO: 585024 - DNA, 1054 bp, Homo sapiens
gcctagaaggggagtcaccaagtaacctctcccaggtttcagagatcttgcgtgtcttatttactgcttttgatctccagggcctagaacacagtgcgtggaactgatgaagttttattgtaggttgttggtaggtgaggtatttcattcagtttaatgaggggacatgaggagccaggggcaggaaggactatggtaaggcggtgtcctcacccaaatcgtcatcttgaatggtagttcccatagatccccacatgtgcgtgggaagggacctaatgggacggtaatttaatcatatgagcagtttcccccatgctatgctgtgtgactagtgagcaacttctcacaagatctgatgggctttataaggggttcccccttcactggggtctcatcttctggctgtgcatgtgaagaaggacgtgttgcttccccttctgccatgaatatgctttctgaggcctccaagccctggggaactggtgaatcaattaagcctctttctttataaattaccctagtctgtgggcatttccccaatagggcggggtgggcgcacaccggtaattaaacctttattttaagaaattggccagggaacaccaaacttttggaccacaacgctgtggcacattagacgggcgctcaaaattcagcgaaggaccccttggtccgacacaaaggtttcacctgtgctgagagcgacggataccatagcctttgcacagcggacgtcaccacaggggacgcggcgggagagcacgcgctacaacccactggttcgacatttcgggcacactactcggtggcgaacactcagcaggggcgcaaccaaactagtgtttttctggtgtgattgttatcgtgtctaaattattatatcgttcttttgtgttttcgccacagatagagagcgacgagcacagagagagcaaagacagaggcacacacgacgcacagtagcagcgacagacaaagtaaagaaggacggcagagcgacaacaggagcacacagacagcacggcgacagagaatggaaacagagaaaacactt

SEQ ID NO: 585025 - DNA, 175 bp, Homo sapiens
tggatcccttcacattatatgcccagaggcttgcagtcatactatcatggtctcaaataagatacgttttacacaccttatcaagcatctctagtgtggtcctattggacacaggaaacagcatctaagttttgaacgggctaagttgaaaacaagtgatttattttcgaaccaa

SEQ ID NO: 585026 - DNA, 221 bp, Homo sapiens
acatttttaatttttcttatttttgggccaaatgtttggaccgtttgtctttttagttaactagtttgtgaaagcattttgtatgttggacaaaaaatgttcagatttttttattttggaagcaaacatttttttccaactcttgtaagttgtttgttggccccattcaaaaggactttttccaaataaaactttgccttttgaatttcaaaaaaaaaaaa

SEQ ID NO: 585027 - DNA, 613 bp, Homo sapiens
  misc_feature (49)..(49): n is a, c, g, or t
  misc_feature (80)..(80): n is a, c, g, or t
  misc_feature (83)..(83): n is a, c, g, or t
  misc_feature (132)..(132): n is a, c, g, or t
  misc_feature (175)..(175): n is a, c, g, or t
ggtttacatccgccgggtgcgcggttcgccgcccgaggtcgttcggctngggtaccatcctccgcgccatggacaccagnganctgttcgccagctgcaggaagggggatgtgggccgagtgcggtacctgntggagcagcgagacgtggaggtgaatgtgcggacaagtggganagtacccccttgtactatgcctgcttgtgtgggcacgaggagctggtactctaccttcgtggccaatggagcccgctgcgaggccaacacgcttcgatggtgagcgctgcctctatggggcactgagtgaccccatccgccgggctctacgcgagttacaagcaggtcacggcttccttgcaggaaggcggcgattcactatgactgactttcgttgcagtcggcttcgtagaagcaggggcattcctacgagtgacggatggtcctttgtacgtacagcgggatagtccatgtccgggatgcactcgctgcggtcctgtggtgcacgatagttgcctacttgtgccaagcatgctggacagccaaatggcaagggcaagagtgtcgctggttctcaggcgacccactgatcaagccccgtggccctttggaggccgc

SEQ ID NO: 585028 - DNA, 331 bp, Homo sapiens
ctaagatccgtgaatgatggtggatggaccacgttctctgggcactagttctctctgggcagcgagcagcctttacagtgcactggtggctgctgaatggacttggcagcttctaatatctgctcctcaaagttaaggactcatctgcctccttgggtttggcccggggcttcagctgctctagctttttggctgcagcctcaatggcggctgcaagctcccaggagctcattctcagcaatgactgtggggtcctctgggtctacccattctgttcccttcatggcttcagcagcctggatgagctcagtgacggaaccagccacacgct

SEQ ID NO: 585029 - DNA, 1623 bp, Homo sapiens
  misc_feature (371)..(371): n is a, c, g, or t
  misc_feature (573)..(573): n is a, c, g, or t
  misc_feature (1529)..(1529): n is a, c, g, or t
gacagggtcgtgcatcaacgaatcatgatccgctggttatggacgcgcgatggtgggtagaaaatagcacgcactgtgcacttggaaggagagtagagcctcggttggttccatagtatctgcactacaagcataaaacggactaataagcaattgttggtaagcaactacaatatgcaattccctgtgtagtggttggcatctcggaggcacagattcgcggctacacataactgctatgtcactgatcctgacaaacgtaaatgaacacgagagctagtatctaactgatatagatgaagcaggattatgagtgctaggcgggacaacactatattgtcaggagaactatagcatggatgctaaagctngcggaggagcccgtggtctatttgtgaagaaaaagtatgcgatgtaattcattccaagcgacatggtatatcagtggataagctaacgattcatcgaggcatacgtaggaactattgcacgtgtgaacatcgcgtataattgtactgagggatagtcaaaagaggtggggatagaaaggccttcgggttgtgccgaaagcanagtgtggcgattatatccgggtgtcattatgagtgaaaaatctccatttgatagtgttggaaactaatccgggtggttctgttggcgctttcggggagaataacaaacctggaatatgtattaatctttacctttcaatgttcctccgctatgagtgacttgttaaagggagggccgttagtcttcctctaaattgtgaccattgaaaccaattctctctggtaagagtgctcacagaggagaggcggttgggactaattacgaaaaagtactttatcgtccaaggggaaacatcggcggttgacaacaaatgttagggatcggactcaaattgggggtgaattagtgggggtcaatttgtcgatatcttcaacctaggaacaagattgggtgatgaaacttagttgatcgtccggcgcactagaggtgtaggtaactgcttgaagcatttgaattatttttgaacatgggtcggatatccagaaaggaggagagccgaatcgtgggatagggacttgtgtggacaaacggggtcgcagtagcgactctgtggcataagacctttagcgttgacgcagggattgtttgagaaaccttcgcaccacgcaagtaccccatgttttctggtcccattgtaccggtcacaaaacccattttcccttgttaacgcttctgtttcacttgggggcacatttccctataacatattacaagggtaacgcccgtacatgaatcatccgctggcaaagaaggcgaaggcactggcccttccacgattaacaattagacgaagcaaactggggtcaaaacgacagggtgacgactgctacaggaaaacgcgtacaaggtgaaacgccaggagcccacacagtaaccgcgccgcaagacagttcggcaaccccacacggcgacctcctgggcccgcgagaacaaacaccgggtcacaagaagcccgnagcgacagaccacagacgagacgacgcacacaaatcgctatacgcagacagccgacgagacacaacaccgacgagtcaaccaccagcaacgcgg

SEQ ID NO: 585030 - DNA, 148 bp, Homo sapiens
ttgagaaagtggagcaggagtggcagagagaagggtggttacggagaatgaagaaagcctgaatataaggaatctcagaccatttctcattgcgatggcaaaagttgtctaagtctctaagtatattgaaatcgaaagtgccattata

SEQ ID NO: 585031 - DNA, 374 bp, Homo sapiens
cctcatgcttatacttcaccaacaagataaaaggtacagctgggcacagtgtctcacgcctgtatccccgcactttgctgaggccaatgacgggttggtatcccttgaggtcacggagttcgagaccagcctggcctacatttgtgaaaccccgtctctgcttgaaaatacaaaaattatccgggtgtggtagcaggggcctgtaatctcagtctacttgggaggctgaggcagtgacaatcgcttgaaccttgaggttgaggttccagttgagccattattgcaccactatactccagcctgtgccacaaagtcagagtctgtctcaaaaaataaaacttttttccattgactctttctaatttttttcgttt

SEQ ID NO: 585032 - DNA, 433 bp, Homo sapiens
  misc_feature (86)..(86): n is a, c, g, or t
  misc_feature (118)..(118): n is a, c, g, or t
  misc_feature (166)..(166): n is a, c, g, or t
  misc_feature (175)..(177): n is a, c, g, or t
  misc_feature (194)..(194): n is a, c, g, or t
  misc_feature (206)..(207): n is a, c, g, or t
  misc_feature (273)..(273): n is a, c, g, or t
  misc_feature (282)..(282): n is a, c, g, or t
atggccacgccgtactgtagagcctgtgggatcacctctagtagcaggcgccgcctaccttatctactacaattactgcggcgccngcgtcgacgtggtggggtgtataacctggtcntagcaaaaagcgaataagtaatgaatgtatacagtgtcagccagtggnctgattatnnngtgctggcatacctgangcttaggataanntacagataatatgaggcaaccagattagcattggcctcagtctctacacacattagggcattacancatggaagnttggtttgcatggatttcaaatattgctttttagttggttcattatacttaggaatagacatgcacctagggtaaatgataatgaatactgtgtttggaataaaatgctgggtttccttatttaaaaaaaagtcttaataggcatttagtt

SEQ ID NO: 585033 - DNA, 130 bp, Homo sapiens
cctgctgacgtcttgctgggtcgtctgggttcatggtccattgtccggcagcagtatgtgttgcacagcaggcatcagctcatcagcacaggcattcatggcatgcgagttgcattgcagtgcacatcca

SEQ ID NO: 585034 - DNA, 639 bp, Homo sapiens
gggcacgagtgggacccccatggtgggggctgccctcaggatgacggccactcagggacctttgggagcgtcctggtggggaaccgcattcagatccccaatgactctcgtgcctgagaaccccggaccactggtgccccatctcgggtggtgggtggcgtggggcctgtggcagctggtgagcgacgacaacgccctgtaagcagtgatgctgcctgcggatgcgtgcactgtggctgagcgtgaaacttggctgtgctgtactgtgcatgtacgatgatcgtgctgtgagccagcaggatgcccactttcacttccaccagatcctgcctgcagagcttccctgggccactcgggggcctgtcaatgtgctgtggcacccctgagcagcgaggacttcttcctgagcggcagcaaggatcgtacctgtgctgcctctggcctgctgtacaactacggcgacgggaccagcgagacggccccacgcctcgtctacacccagcaccgcaagagcgtcttcttcgtgggccagcttgagtgccccacagcacgtggtgagctgtgacggggctgtgcacgtctgggaccccttcacagggaagacccttcgcacagtggagccgctgacagccgggtgcc

SEQ ID NO: 585035 - DNA, 378 bp, Homo sapiens
gctacggagtcagagtatacatacagctcccaagatcctagacctggcactggtcgtttccggagacgggagcagcgggaccccaaggctgcatgatgatgtgctggagctggagatggacgagctcaatctggcatgagtgcatggcgccccgtgacggccctgatcaagcacatgcacagaatcctgggcccgcctccatggagaagaggattcatgtggcaattgaggatcttccttcttgagatgaaattcctccaatggcaaatctgggaaactccaataagtaccacttaaactatcctgtctccttcttcgcccaagcttttgttatctaatacaagaagacggtcttaccaccccctcctgcgcacagca

SEQ ID NO: 585036 - DNA, 1545 bp, Homo sapiens
  misc_feature (5)..(5): n is a, c, g, or t
agcgnagaggctgggcgggcgggcccgggagcggcgcagcatctgcgggcggcggggtttcgagctcgccgggccgtgtcgcgccatgcccgctggctgagcgccgcagggcctcgtcccgccaggcgtgggggccgcgcgcgcccaggccggggcccggcggccgaccatggtgctgccgcccccggaccggcgccacgtgtgcctgaccacgctggtgatcatgggcagcatggccgtcatggacgcgtacctggtggagcagaaccagggcccgcgcaagatcggcgtgtgcatcatcgtgctggtgggcgacgtgtgcttcctgctggtgctgcgctacgtggccgtgtgggtgggcgccgaggtgcgcacggccaagcgcggctacgccatgatcctgtggttcctttacatcttcgtgctggagatcaagctctacttcatcttccagaactacaaggcggcgcggcgcggcgcggcggaccccgtggcgcgcaaggcgctgacgctgctgctgtctgtgtgtgtgcccggcctgttcctgctgctcgtggcgctggaccgcatggagtacgtgcgcaccttccgcaagcgcgaggacctgcgcggccgcctgttttgggtggcgctggacctgctggacctgctggacatgcaggccagcctgtgggagccgccgcgctccgggctgccgctgtgggccgagggcctcaccttcttctactgctacatgctgctgctggtgctgccgtgcgtggggctcagcgaggtcagcatgcagggcgagcacatagcgccgcagaagatgatgctgtacccggtgctcagcctcgccaccgtcaatgtggtggccgtgctggcgcgcgccgccaacatggcgctgttccgggacagccgtgtctcggccatcttcgtcggcaaaaacgtggtggcgctcgccaccaaggcctgcaccttcctggagtaccgccgccaggtgcgcgacttcccgccgcctgcgctatcactggagctgcagccgccacccccgcagcgcaactcggtgccgccgccgccgccgccgctgcacggcccgcctgggcgcccccacatgtcctcgcccacgcgtgaccccctggacacgtgacagggcccgcgcggcccccgacacgcccctggggcgcagagacaccgggttggcttggggcgcgcggtttgcatgggatggggtgggggcgggctcccctagggacaggtgcctcgagtgcccgtgcctggggtcccgcggccgcttcttcatctcaggaatctctcggaccgcggatcctcagcccccgctccaccagcccgccccagcgcgtgggtctgtttgggaggcctgggccggagcagagcagaggtgatccggcccctgcctgctgggccgcccgggttggaagggagggcagtgtgggcggagatctgctccttcggtgggggcctctggctcagatttggggccaaggaggcctctgtcattttaaagactcgtgtttacagttttgtaaaaaaaaactcgtgccg

SEQ ID NO: 585037 - DNA, 171 bp, Homo sapiens
tacccaggcaggacaagagacaaggattaacaaacgggctcaaaaacttttaggggttacaggattgttctaactcctggggtcaagcaatcctcctgccttagcctcccaagtagctggggctacaggcacacatcaccacacccggccaatttttttttaagagacggg

SEQ ID NO: 585038 - DNA, 792 bp, Homo sapiens
  misc_feature (5)..(5): n is a, c, g, or t
agcgnagaggctgggcgggcgggcccgggagcggcgcagcatctgcgggcggcggggtttcgagctcgccgggccgtgtcgcgccatgcccgctggctgagcgccgcagggcctcgtcccgccaggcgtgggggccgcgcgcgcccaggccggggcccggcggccgaccatggtgctgccgcccccggaccggcgccacgtgtgcctgaccacgctggtgatcatgggcagcatggccgtcatggacgcgtacctggtggagcagaaccagggcccgcgcaagatcggcgtgtgcatcatcgtgctggtgggcgacgtgtgcttcctgctggtgctgcgctacgtggccgtgtgggtgggcgccgaggtgcgcacggccaagcgcggctacgccatgatcctgtggttcctttacatcttcgtgctggagatcaagctctacttcatcttccagaactacaaggcggcgcggcgcggcgcggcggaccccgtggcgcgcaaggcgctgacgctgctgctgtctgtgtgtgtgcccggcctgttcctgctgctcgtggcgctggaccgcatggagtacgtgcgcaccttccgcaagcgcgaggacctgcgcggccgcctgttttgggtggcgctggacctgctggacctgctggacatgcaggccagcctgtgggagccgccgcgctccgggctgccgctgtgggcccgaggggccctcaacctttctttcctactgcttaccattgcttgcttgcctgggtgcttgcccggtgcggtttggcggcttccaag

SEQ ID NO: 585039 - DNA, 334 bp, Homo sapiens
tgtaacagtgcagagcgtaggaatagaccctggcgtccagtgtgcgatgtgcttcatcctaccagagcatcaagtctctgcagcaggccatgcttgggtaaagaaatgcctaccacaaactctccatccccgggcttcggtttcggacgttgcttcgccggaatcatctccgtcactggtgactgccacgatgtgtatagtacagttggacatgcctgggtccatacagaccgctggagaacattcggcaatgtcccctttgtagccagtttcttcttcaagctcccggagagcagctgcttctgggagtacaccatcatctatgagacccgca

SEQ ID NO: 585040 - DNA, 128 bp, Homo sapiens
aggaggtctggtacatcatttcagaccccaactgcgagatcgcccagagcacagtctgcaggcctgtggatgtggatgagatgtgtctgctgactgtgagaagaaccttcaatgggtctgggacgtac

SEQ ID NO: 585041 - DNA, 223 bp, Homo sapiens
attaactgtcaaacttcaactattcaaatgagtggagtcatttttgtaaggcttgatatattaattgtttatatcatgagaatgactctcagttaaatctcaagagctttcataaaccctagggtgacactggcatttaataagatgttggatatactccctacctttaacattctttatataccttcttgtttgattcctccaccacagttatcatctaacc

SEQ ID NO: 585042 - DNA, 303 bp, Homo sapiens
tcagctcggtaccacgattctttgcgatggtgcgtgagatccagtcggcggtgtcggcaggcgtgatgggcattgacaaattctccgaggaggtgcgccgcggcatgtctgaggtgcagcaagtgggcgagcaactgtcgcagatcatccatcaggtacaggccctggcgccgcgggtgttgatggtcgacgaaggtatgcaggcccaggccaccggtgccgagcagatcaaccacgcgctggtgcaattgggcgatgccagcagccagaccgtcgaacccctgcgccaggccagctttgcca

SEQ ID NO: 585043 - DNA, 542 bp, Homo sapiens
  misc_feature (526)..(526): n is a, c, g, or t
cgcccctactgggaagtgaggagccgaggtgcccggccacgaccccgtctgggaggggggtccagcgactcattggggatgagccatgatgacaaaggcggtatagcggaatagaaaggcgggaagggcggggaaaaaatagagaaaccggatgggagccggactgtgaggatagaagcagacatgggagacaggtcagagtgggctgaactaagaaaaaatctggagccttgggagcctgtagatcagagacctgagaccgaaccctgggctctctgaaacatgtgctgtggccacacagggctaaatggattaagggcggtgcaagacgggcctccggaaacagaagcttgaaggcagcatgctcgataagagtcatcaccactccctagactcaagacccagggagacaaacactgaggaaggccgcagggtcctcagcctaggaaaaccagagaccgaaggtcacttgtgtatcaagggaccgagcagccactagtggcctaggaccgagacaagcccccgntgggaagaaacacaca

SEQ ID NO: 585044 - DNA, 3847 bp, Homo sapiens
ggcacgagggagagaactagtctcggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactggaactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaacctttttttttaaaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattccctaat

SEQ ID NO: 585045 - DNA, 323 bp, Homo sapiens
cagattaacataaaagaaaagagggaatcacagggcatttaagtgcacctttcccattactttccttaaatcacctcatagttaggctgggcgcggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatct

SEQ ID NO: 585046 - DNA, 2396 bp, Homo sapiens
  misc_feature (2352)..(2352): n is a, c, g, or t
ggcacgagggagagaactagtctcggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtggggtactcttgngtcagcagggccacatggtaaaggtatcgtggcggcccgcctgt

SEQ ID NO: 585047 - DNA, 188 bp, Homo sapiens
ttattatttcttaaacatttagtgagacagagtctcattctgtcccccaggctacattgaagaatttgtcaacagctaattgagccccaaccctcctgggctaaagtgatcttctcactttagcctcttctgagtagctagacccaccacactttgtccactactttataataaacattgatttggtc

SEQ ID NO: 585048 - DNA, 4181 bp, Homo sapiens
  misc_feature (3252)..(3252): n is a, c, g, or t
  misc_feature (3652)..(3652): n is a, c, g, or t
ggcacgagggagagaactagtctcggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactggaactacaggtgtgcactcctcgcctggctaattttttattttttgtacaggcaggatcttgccaccttgcccaggctggtcttgaactctccgtggagctctcaagtgccaantctgtgcctgtgcctttagttctctccccaaaatgtgcgtgggatttcacgggagttgagccacccagtgcccggctgtggcagttgtgcattggaaggagaacaccttcttttagtgcgcttttacccttcatagaaattttcccttcaatatttaatgcgtgtgttcctgggtttgggacatatttcttgtggtgttttttacaactctcttttatttggacacaccagacccaaaagaatgtcccactgatatttggacaacctatttatttctttcccctgtgtttttccctggtgtgtgtcccacactatgcgactgcgaataatatgtgtggcgccatgaagtgttttacacatatatatctatctccatttctcaggagaacaacacgttttnttacattttttttatacatatacaccattttcctatttataacccatttctacttttttgggctttttgccccggctgtgggacatatttgtccctgtgagaggacaacgtgactactgtggggcgcttgggattttaaccaacactatagagtcttttgtggcggctcatatcacactctttgggggatctccctatttttaaaaaaaaacctctttttttctctttttataacaccaacaacataaacaacacacaggggagaaaaattttcctcctctttatgagggggagacctcttttccttctttggcgccccggtctgaggagtgatcttctttatagagctcctctttctgtccaaaaacagagtattccccctctttggggggttttggtgctcccactcttttttggcctttgggccccccaagtttttgtgccttgtggtatcaacttttgtgctcgtgtacataatccccgtctttgggatttcctccaatattgggggtgggcgaatcttgggagc

SEQ ID NO: 585049 - DNA, 449 bp, Homo sapiens
  misc_feature (5)..(5): n is a, c, g, or t
  misc_feature (84)..(84): n is a, c, g, or t
  misc_feature (87)..(87): n is a, c, g, or t
  misc_feature (96)..(97): n is a, c, g, or t
  misc_feature (448)..(449): n is a, c, g, or t
catantattgactgtacccctccaccctacattgtactgcctatttagtcaaaccctttacagtagtcccacagaattaaaaanccntcctcctanncccagaggacatcctaaaagagaccctaaactttatatcaagagcacaatattgggcccaggtgtggtggctcatgcctgtaatccccagcactttggaaggttgaaagcaggtggattgcttgagctcaggagttcaaacagaccagcctgggcaacatggtgaaacactgtctccacaaaaaatacaaaaattagcagggtgtagtggtacacacctgtattcctagctactcgggaagctggggtggggaagatcactcgagcctagcaggtcaaagctgcagtgagctatggttgcaccactgcactccagcctgggcaatagagtgagatcctctctcaactacann

SEQ ID NO: 585050 - DNA, 183 bp, Homo sapiens
gggcactaaaagttaggaagtggtaactttttgggttaatgtccttactacatccaaaatggtaacgtgtgagtccaaaaagtgtcttaaatcacacaaaaaaaaacccatattaaaattttaaaaataagccccaaataccccagaagaaaagtgcagtccagaaactataaaacgaggcgt

SEQ ID NO: 585051 - DNA, 797 bp, Homo sapiens
  misc_feature (35)..(35): n is a, c, g, or t
  misc_feature (97)..(97): n is a, c, g, or t
  misc_feature (112)..(114): n is a, c, g, or t
  misc_feature (116)..(116): n is a, c, g, or t
  misc_feature (119)..(121): n is a, c, g, or t
  misc_feature (124)..(124): n is a, c, g, or t
  misc_feature (126)..(130): n is a, c, g, or t
  misc_feature (164)..(164): n is a, c, g, or t
  misc_feature (173)..(173): n is a, c, g, or t
  misc_feature (194)..(194): n is a, c, g, or t
  misc_feature (205)..(206): n is a, c, g, or t
  misc_feature (215)..(215): n is a, c, g, or t
  misc_feature (217)..(217): n is a, c, g, or t
  misc_feature (224)..(224): n is a, c, g, or t
  misc_feature (234)..(234): n is a, c, g, or t
  misc_feature (251)..(251): n is a, c, g, or t
  misc_feature (267)..(267): n is a, c, g, or t
  misc_feature (290)..(290): n is a, c, g, or t
  misc_feature (311)..(311): n is a, c, g, or t
  misc_feature (322)..(322): n is a, c, g, or t
  misc_feature (354)..(354): n is a, c, g, or t
  misc_feature (358)..(358): n is a, c, g, or t
  misc_feature (365)..(366): n is a, c, g, or t
  misc_feature (390)..(390): n is a, c, g, or t
  misc_feature (450)..(450): n is a, c, g, or t
  misc_feature (476)..(476): n is a, c, g, or t
  misc_feature (482)..(482): n is a, c, g, or t
  misc_feature (499)..(501): n is a, c, g, or t
  misc_feature (516)..(516): n is a, c, g, or t
  misc_feature (530)..(530): n is a, c, g, or t
  misc_feature (624)..(624): n is a, c, g, or t
  misc_feature (644)..(644): n is a, c, g, or t
  misc_feature (656)..(656): n is a, c, g, or t
  misc_feature (660)..(660): n is a, c, g, or t
  misc_feature (677)..(677): n is a, c, g, or t
  misc_feature (689)..(689): n is a, c, g, or t
  misc_feature (698)..(698): n is a, c, g, or t
  misc_feature (730)..(730): n is a, c, g, or t
  misc_feature (797)..(797): n is a, c, g, or t
tcaacagtgtgaatttctaacaggggcaaaactgngcaccatagtttacaagtagaaagaccatgcttggggacaacagaagttcactaagggtgcncgattgatctgagannncnccnnnccncnnnnncgccctcctcctcctcggggtccccttgttcgtnggccgtggngtcctggtactgctggtactngggcaccaggnngttcatgtngntctgggnctcggtgaantccatctcgtccatgcncttgcccgtgtaccantgcaggaaggccttgcgccgggncatggccgtgaactgctcggnggtgggcttgngcagctcctggatggccgtgctgttgcggatntttntgggggnnatcttcaggtcgcggggtgggatnttgcacacgggcgttttcacgttgttggggatccaatccacgaagtagctgctgtttttnttctgcacgttgagcattttttcgtncacctncttcatggtcatgcggnnncggaggatggggggnggtcgagtgggggncgtggcgcgggtcgcaggcggccatcatgttcttggagtcgcacatctgctgggtgagctcgggcacgtgagcgcccggtactgctggctgccncggctggtcaggggcgcgancgggcatgaagnagtncaggcgagggaagggcncatgttcaccgncagcttgcncaggtctgcgttcagctggcccgggaagcgcngcaggtggtgacccgctcatggtggccgacaccaggtggttgaggtcccgtagtggggggtggtcan

SEQ ID NO: 585052 - DNA, 219 bp, Homo sapiens
  misc_feature (8)..(8): n is a, c, g, or t
  misc_feature (12)..(12): n is a, c, g, or t
  misc_feature (93)..(93): n is a, c, g, or t
  misc_feature (103)..(103): n is a, c, g, or t
  misc_feature (172)..(172): n is a, c, g, or t
caactgtntgcnattctctcctgatgggaacagatttcccacagccagtcctgacggccagatatacatctatgacgggaagactggggaganggtgtgcccnctgggcggaagcaaggcccacgacggtgggatttacgcaattagttggagtcccgacagcacccatttncttctgcttctggggacaaaacttccaagatttgggacgtcagcgtg

SEQ ID NO: 585053 - DNA, 960 bp, Homo sapiens
gcattgacttttcgacgaaatggtgacacccagtgtcttgaatggtaacctcatcctgtacaatgcttctgctaactaattctagctccataggcacagcgtgatattagagacaagtacgaatgtgtcccgcaatctcatgcacatcagcagtcctccttggcaaaaggcataagtggaacaaataggcttctagatgtagtagatggggtgtatctggtcacttttcccattatgagaattcatgtgtgatttgtatgcaattggtcataagcttggagtctatcactcgacctgtgtagaataggcctcttactaggagaatattaacctttgcctgtttttcccagaccgtaatacgtggatctctcttcggtgctttaatctagctcttcattcctccgtactactacccacaatgccagaggatcaactgaaggagtagcgtaaggttgtaataacaaagaagagaagagcttcggggagcaagctaatagagtcctaataacatttttgggatacgtcaccaccaagaaagttttcactaattcctgaaagggttaattcgtagaaagtttgtccccagggcctgtctcagctgacacaatcatgctgatgtagcatgtggtagctccctcagttctaggtatgggctggacatttggggggaagttcaaatagcggtacacccttgtgcggggtgagaaaataggcgctctggcctgaacaaagggatctacgtatagttgggaaaaagctccacgacctcaaggaattcgttcgcttgggggcaacggtagagcagagaatgtacctgaattgaggggagccaaaaattctcgaaatagggagaccatggtcctttatgctcgggaggaatatgcggggactttgtaacgctcgtggggactccgtgtgcttgtcctgcagtaaaatcctgtcttgcctatatagggtacc

SEQ ID NO: 585054 - DNA, 461 bp, Homo sapiens
accaagtactactaagagaggaaaaagtgtgttactttttaaaatatcccctgtaaatgtccccctccataattttaatgtccttgtgaggaaaaaagtaaaaacatgtttaattttatttgactttcgcattggttttcaacaaggcaaatgttcaatgtgttaagacttgtactagtgttgtaactttccaagtaaaagtatcccctaaaaggcacttcctatctgatttttccccagcaaatgaggcaggccattctaagatcttccacaaaacatctagccatctaaaatggagagatgaatcattctacctattcaaacaagctagctattaagaggggggttggggtaatctactccttaggatttcagggggtcttccaactgagatctcactgtgctcagtacgagaaaaactgtgaataacatatgctatgttagggaaggcgctttacccc

SEQ ID NO: 585055 - DNA, 336 bp, Homo sapiens
gaggttacttatcgtgttgcaccccggagcgagctcacactccctgcctgcagatactgtccacaacctgtacctgtttgaccggaatgcagtgtgtctgcactacagcgaatggcacgcaagaagcaagcagggattcccaagggaaggaaggaagttataggctgatggtacgggatgctcttctctatccgctcgtttgtcaagcaagatgtccccgctagacatgaaggatggcttccttggccttccaaactagccgttacaaactccattactacgagacgcccactgggatccaacgttgtcatgactactgacttgggcgttggggac

SEQ ID NO: 585056 - DNA, 641 bp, Homo sapiens
gctgcagaacgcagggaagctcagcctgatccacagattagggtaaaatatcccggggggccgaagtggaaaccggagttgcgtcattgctcccacccgatatcaccttggcagcgaccgcggctgaccacgttcccggcctgtcgcgaatctcacccaagggagctgagtctcagcttccctggtccctggtcccgagttccgccttccccccccgccccgtggcatcggcgtgaggggaaaagataaagactacctcctgagacctggaaatgtggatggctgcggaaaactcaccacaggaaattttggcttaaagttattctctgcttcccttgactgtgtgataggcaccgctctatctgctagaggacaggtgaaaaagatggggttccctcttcttagaactcactgtgcagtgggagaatgtataaataaatagtaattacaacataatcttctggaatagaaatgctcacaaaatcatccagcagtcgatgacctcctttagccagggaagatattgctattcgcctcttacagaggaggaaaccatggctcagagggacaaggtgaaagggtgggaaattgaggcatggaaagtttaagtgatatgcccaacacgaatctggcaatcaatg

SEQ ID NO: 585057 - DNA, 274 bp, Homo sapiens
cgaccggaagtgatgaattctgacttgaattttaaaagatcactttgacgccatgcgtggagtagataatgaggattcttgtgcgagaggcaaatgaatatccttgtgcatgaggcattgctgtaactggagtaacctggagttaaacagtaatcttcaccttttaggaacttgccatctgtgcccaacaactatgatttttgaagtgttgagcaattgctggcattctttgagcattgacatggcaggcactttaccgagcattttacaggtg

SEQ ID NO: 585058 - DNA, 647 bp, Homo sapiens
  misc_feature (31)..(31): n is a, c, g, or t
  misc_feature (78)..(78): n is a, c, g, or t
  misc_feature (110)..(110): n is a, c, g, or t
  misc_feature (140)..(140): n is a, c, g, or t
  misc_feature (151)..(151): n is a, c, g, or t
  misc_feature (158)..(158): n is a, c, g, or t
  misc_feature (193)..(193): n is a, c, g, or t
  misc_feature (213)..(213): n is a, c, g, or t
  misc_feature (218)..(218): n is a, c, g, or t
  misc_feature (221)..(221): n is a, c, g, or t
  misc_feature (227)..(227): n is a, c, g, or t
  misc_feature (241)..(241): n is a, c, g, or t
  misc_feature (272)..(272): n is a, c, g, or t
  misc_feature (303)..(303): n is a, c, g, or t
  misc_feature (306)..(306): n is a, c, g, or t
  misc_feature (325)..(325): n is a, c, g, or t
  misc_feature (328)..(328): n is a, c, g, or t
  misc_feature (333)..(333): n is a, c, g, or t
  misc_feature (335)..(335): n is a, c, g, or t
  misc_feature (349)..(349): n is a, c, g, or t
  misc_feature (462)..(462): n is a, c, g, or t
  misc_feature (466)..(466): n is a, c, g, or t
  misc_feature (481)..(481): n is a, c, g, or t
  misc_feature (530)..(530): n is a, c, g, or t
  misc_feature (544)..(544): n is a, c, g, or t
  misc_feature (567)..(567): n is a, c, g, or t
  misc_feature (573)..(573): n is a, c, g, or t
  misc_feature (621)..(621): n is a, c, g, or t
agttttattatttcatctttctttgaaagtnttttttttcatcttttctttatggttcttcagtagaagcaagaatantgagtagcccagtaaggagcatataaactgcnatactgattaagtatcttctaaatattaanggccaaaaacnggattcnaaaggaaaggcttttggtcttttcaataaattgcngaaagggtaaaaatacattntaacncanaaacanataaacaaattaanaataaatcttggaatcaagtattgcattacnaatcaaatttacaatccacctttaagcttcnacnggagtaatgtacaattaanctncaaanangtaaatgcagaaanactggtggatgcaaaaaaaagtttaaaatataaagaaaagggcataaacaatgaaaaactaaagaaaagcaaacaagaagaagtaattaaaaagcactaaataaaattacctnaacnttttctgaacaccanaaaagtaaaagtaaaaaaaaaaacattaaacaaatactgtaattgggtntttatatgtataanaatacagtagaataaatataacnagaacnattagaacctgccgacgttttcgaacatccttgtctgttatgacttcngtggttaaatagcgaagaatgtttgg

SEQ ID NO: 585059 - DNA, 321 bp, Homo sapiens
attcggcacgaggctctgttgcccaggctggagtgcagtggaacaatctcagctcactgtaacctctggcattagctgggcatggtagcctgtacctgtagtcccagctacttgggaggctgagatgggaggatggcttgagccagtgaggcagaggttgcaataaactgagattgcaccactgcctcctgggttcaagcgattcttataccttagcctcctgagtagctgggagtacaggtcctttaaagaagtcctttaaggctgggcacggtggctcacacctgtaatcccagcactttgggaagctgagatggacgg

SEQ ID NO: 585060 - DNA, 132 bp, Homo sapiens
aaaaattaaagaaaaaaggagaaagaaaaggtgggaataaaagattcccaaggaaaagccgagggggaggaaaaggaggagggaggggggaggagggggggggaaaagaaaaaaaaagggaaaataagaggg

SEQ ID NO: 585061 - DNA, 310 bp, Homo sapiens
tggcaggctctctacctcatcaatcggacggatggtcttatagaaggggaaaatatggacacagagagagacaccagagggtcgtgcacataaagacttggaggacacttcataagggcgaccatcggcaggccaaggagaaaacagcaagccggccttcacctcaatctggaacttccagtctccacaacactaagaaaattaatatctgtggtgggtgctacctagtcaagggcatttggtaatggcagccggagcagataaacacacaagggcaagaatctgccttttctttctttctttctttctt

SEQ ID NO: 585062 - DNA, 867 bp, Homo sapiens
gaggttggggaagttcagcctcgaggacactaggggacgaaaaacttcaaaaagaagactctttttattaatatttggcgttcttttggagaggaactttgggatgtagcctttacctgtttcctgaatttgacatccaaaaagcctttggaaaacaccattctaaatttatcctgttctgaatcaccatcgcttctgatagatgcagttgcttgctgacatcgtgatctttgatttgtacaacgctattgggctaactttgggattttacttgtgcttagaatttgaaagtagtattcatggaaagagactccaagaaaatactcgaagacatcaaaagctggattcgagggtataacgtgtttggttcgtctttaaaatttcgcgcaacattacggattggccgcgtgattctctttcccccctttaacttagaggaacgaggattatacagaactctgaacgtaagtgacaaatcttcctataaatctaaatgcagtaggtcttcgggcagtacggctttttacgtgccatctgtctgagcatgtttcctgaggatcgtcggactccagtcatgtggaaatttcctgcagggttgcagttactgcgcattccgggtgatacctgggatattctggttgagacgatgggactttctctttaacgggatcactttttgggcacgaacggttatactacactgggtaatcatattccactcctgtacatgttccctagttgggaatattattccaagggagcttacatgcccagtggggggcctcacgggattatccggcctacaccggaagaaacggctggctacgggagagcgagcactcggactcgtgcaatggacacgtatgc

SEQ ID NO: 585063 - DNA, 2086 bp, Homo sapiens
cccaacgcgtcgactagttctagatcgcgagcggcgcccttttttattttttttcttaaaatataatatatatttataattaccgggccctcaaaagcaatcatggtagttaagaaccaagtttggaggtcattaggatagaggccaacttaaaacatctccagtgcagatggcacattaggcaaactgggctttcagacacccccacacagtctacttgcacaatcacctttaaacacgttcaagtagcttgtcggcacacgcaggaatcaaggctagatcaatccctcgaggctctgtaggcagtggctgggccaccaccctgcgcgtgctgcggcgaaggcggcatggcggggagcaggcccgaccctaccctcgacaggcctagacaacaaagaacatgccacacctggcacacgcgggaaccggcacactcgccctatgctcccatgggactccacccgccgtggctatcccgcctgacagctagactagaacttccatccgtagagaaacacttgacacgtacctgagcacaggaaatccatgccgatatgggttaacgcgccagtttcttctagaacctgatactatcaggctaccactcattgaagctcatttgtcacacagaacatttgactccctcgtactcaactacttcatgtgcacgaaacacgcgccttgttccccatgggctcacaactgctcttgcaaccagtgagggcagcagcaagtacccggtactaacaccggggaaaagccatgacgagcaatcagtcaaggcatcagtaactctgatcccccggtgcgaccgccgcaccggccaccacccagctgcgtcaggccctcctcgcgacaccacacatagaatcaccacacaccaacgcggacgcagccacacacagcaccaccacagcgccgccaacacacacagagcaccatgcgagcagcaactaatactgacttgacaagtatactgccagcagaaccacgacgacaggacacagcagcacaccagaagacgacaacagggcaagagacgcagaccaaagaagcaccgcgaagcaacgcgccactagagccggtaatacagcaagaactgagcgcctacagccgcagccacatgaacaacagcaccagcaagacacagaccaccgacgccgcggcacagcagactaaaaggacaagccaactaacaagaagacgaaccgacacaggaattccgaactaccgaacacgagacataacagagcacagtgcaaccacagatacacacatgaacagcgcaaccacagcacaacgacccagaggagaaacaagagcacgaagcgaacgggcagcagaaagcacgacgaccgacacacggacagcgaacgagccagacaatggcagaacaggacgaagaggcagagacgaacaccctaggagagaccgacacacggcgagaggcaacaccgagccacagaggagcacacgacgagcgcggggacaccggaaagaccagacagcagacagcagacgacaggaagccagcgaacgaacagcagaggacagaaagaaggacaggccgaccgacgaggacacaggacgaaggacaagcgagcgcgaggaggggcggagagagctgaagcgcgaggagagcagcggtcggaaagaggaggacgagagagggggacgcgcacgagaacgccgcgacgcgagcggcgaggagcggacccatgcggccgagagcaagggagagactagagggaggacgagccgagagacacggagaaagacggcgggaggggacgcaggagcggcaacaaggcagacgatgagaggacgacgcgacgacaagaacacagcagagcaacgagcaaggacgaaagaacgataagcgagaggaggagcagcagcgacgcgccagaacgaaggcatgagacgacaacagaacgaagagaagcacgagcatagcaacgcagccacgcgagcgcacaagccctcagcgagccagcgcagaccagcaacgagacggacgagcacccaacgcaaggagcagcgagacgacgcagagagaacgacaagacgagcaaggaggtgcagg

SEQ ID NO: 585064 - DNA, 1332 bp, Homo sapiens
ggttgtccctgagacttgtctgggttccagaatcctgacgacccgggcgacggtcgacgtctcttgtcgacgtaaaagagcagctgtccaggtggctccagacctaggagtctaacgcgggaccggcctcccgtcgcacgtgcaccattgcgccaaggttctctggacaacttggtaaatatcatccgagtctgcgaagagactttcgatgcgaacttgcgtcaaatgctgcgtgtggtggtgcaatcgttgcttgcttggacgcgacatggattcgcgtggctgtggctgacacgacagtcactaggacctagccagatgggaggtatctacatgccagagagtggacgaccacgtttctgagcatcaagatagccgtcctattcgatcgctgcacgcacgcgacaagagatttgaccttcttcaaggggcttcgcgtggaggagcaggtaacagcacgtgcacgcagtacctgggtggagtattgcgaggcagcgccgctccgtgttcacaagcatcccaccctagtgagtccacacacttggcggggaggacgctggtaacaccctaagatgaaactggcggtcccttcgatgggcaaggttcagcgcacacatggcctgctccgtcgtaccattgaggagaaacagactgctggggacacccgcacgtataggaaccctctcatggaggagattcatccagtgagcggaatcaactcagacggccaatttcagaacattctgaagtaggacaactttgaaattccccgttgggaagtcgcttgcaaccccgagacgtctcaaactctgcagcggatcaccgcagtagggtagccagacacccaacgggcggactcaatacacggaatcatcaggaagaccggatggaacgggtcggcgatccccggaccgggtccaacaagcgccaggaagagagacggaaagaagaagccaacttcactccaaggcccgccactgcacttcactcgcggaacgcgtgagaacaaagacaagcactggaacacgccacgggccaagcggagacaaccccatgcgagctcacaagccaggagcagcagacaagggaacagaaatgccaccaagagcaacacactcgcagaacccacaacccaccggcagaaaatgaggcaacggcgaaagaaacaactagcacgaggacagcaccagaaacgcgaattcaccacgaacggagagccagccaagagacaaacgaacaaaacgaaacgcaccccacgtccacacaaggatcaagcggcgacgctccacacagccaggcacagcgagatcaacaacccaagtccccagcaga

SEQ ID NO: 585065 - DNA, 824 bp, Homo sapiens
ggtcacatatgccatgtggaggaggtggatgcagtatgaatgcaggccacacaaggtggatggaagagttgtggaacaaagagagctgtctgagagaagattctcaaagaccaggtgccattaactgtgaaagagatattgtggtggattaaagaagaactgaatgaaatcactaagagattatttggaacagtatggaacaatcgcagtgattgaaatccatgacgtgacacgatggccagtggcaagaatagaggggctttgcctttgtaagctttgatgaccagtgactccgtggagtaagattgtcattcagaaataccatactgtgaatggtcacaaacgtgtgaagttagaaagagccctgtcaatagcgagagatgggtagtggttcactccacgccaaacgaggatcgaagtgtgttcgtggcaaagctttaggtgagtggttcgtggcaggtgggtaaccgggggagaaatgacaattcgggtcgtggagtgcaaacttcagtggatctggtggatggtttagggtggagccgttgggtggtggttggatatggttggcgtggggatgggtatacatggatacggtgactgatgggagcaaatgtttggaggtggtggaagttactgatgagtttgggaagttacaaaaatcagtcttctcaatgtggactccatgaagggaggaaactctgggggcgaagctcctggccccaatgaggtggtggcaatctttgccataacagaaaccagggggtatgggggtccgacaacggggttttgggtggcaaaatttcttggaaccacgtacgaaatgg

SEQ ID NO: 585066 - DNA, 200 bp, Homo sapiens
agtacatctgtctcaattattcgtgagattttagtgcattgtatcatttgtgcaagttttgtgatattttgggtggataaacccgggggacccaggagtgaaatagcaagcacaccgagaatggactctaaaagcttgggcacatagagcgagtccatgggttgagagaggagtaaggttctaagggggatagggagaag

SEQ ID NO: 585067 - DNA, 468 bp, Homo sapiens
cacacatgcacaaatatgtgattgagacgaaaggacatcagaagactgtctaaaggatgcctgtattcctcgttatatcaggactctaaatactctaacagctgaccagtgttggtgattccagtggactgtatatctgtgaaaaacacaatcatgcctttatgtcattctatctgagcacgttggaagttcaattagctcatccaaccaaccaaatttctgcattcgagtcttaaccatatttaagtggtactgtggcttcaaagaagctattgagctctgaagtagtgggttctgattgagttgactggttttaaaaaactgccaggattttaattgtgatgcacaagctatagtaacatacattcggttttgcacagacattaattgcactctggtggataagttcaataaaggtgatatcccaaagctgccagaatgatctttctgactctagggagagcctcg

SEQ ID NO: 585068 - DNA, 315 bp, Homo sapiens
gggggttttttccccctgggggccccgttgggtttgggggagggcccggggcccccggggtgggggttgggggaccccccagggtttttttgggttttttacccttcccccggggggtttttggggggcccaaaggcccggggggggaaaaaggggggttttttttttggggcccctttcccccttttttggggggggacgggagcccccctcctttttttttgggggggccccgtttttcccccccaaagggtttgggggggttttttccccccccccccccttcggggcccaaaaaattttttttccccccca

SEQ ID NO: 585069 - DNA, 218 bp, Homo sapiens
tcgagataccctattatgtgctttaaatgaaggtgggcagcgatggagcaccttgtttctctagtaggctcccatgctgtaggcaggggaactcgagaatgtagtcctgacctcaggattgagcattgtctttctagtctcatccggcttaatttaaaaaagaatatgggtactgatctcgaatgcgtgttcatggttcgtagcgggtaccaagctcg

SEQ ID NO: 585070 - DNA, 143 bp, Homo sapiens
  misc_feature (28)..(28): n is a, c, g, or t
  misc_feature (44)..(44): n is a, c, g, or t
  misc_feature (82)..(82): n is a, c, g, or t
  misc_feature (123)..(123): n is a, c, g, or t
  misc_feature (129)..(130): n is a, c, g, or t
  misc_feature (140)..(140): n is a, c, g, or t
ctatgtgaaaaagacattactattctcnggaaggataaacgcgnaatttgagaatggtggatatctggggtgagaggtaccntttcactgttcgttaaaagtttgatattttggtgtttgccnattcgnnaaaatggttnaaa

SEQ ID NO: 585071 - DNA, 102 bp, Homo sapiens
tatgttctagcactgcaggggggtgaggtcattaaaagcgaggaaaacactagctaaaaacctttcctaaaagtgccctgtgaggagtgagcagctgactga

SEQ ID NO: 585072 - DNA, 874 bp, Homo sapiens
ggaagacggaggcgggttctacagagacgtaggctgtcagggagtgttatttcgcgtccgcttctgtttctccgcgcccagtgctgcccgatcaatactcgtccagaaccggctcagcctctccgcgcagaagtttcccggagccatggccgagtactcctacgtgacagtctaccaagctcgtgctcaagggaaccaggacgaagagtaagaagaaaaaagagcaaagataacgaacacgaacagcgacgaccgaagatgaagaaacccagtttgatatgggtggggaactctggtggacagtaacaaacttgtggtgaaatttcaggaaccatagccatgtgaacatggactaagggaacctatatacattgcactcgaacaatggtctttttaccctgggagctccaccacaaagacagtgggatgagggcctagtccctcccagagcagttacgggtgtccaaattatctgattccagaattcgccctgaagttctgctatggacaactatcttggtttaactcagatgggcttgtggtgggcgtcagatgcattggccagagaccatgggaaccagtctttccaaaatgggaacatggctggttgggctcaaataggtggttttttacgattgcagggacgcgggacttgaagcaccgtccacacgcggggagaggcaggtcagattagtctggctgaaggaaccgcaaggtggtgtccgagagccggctgtccccggactcttgtacgaatcgagtcgacccattacaacgaggcggattaaggcgaagctggacgtctgaggcctgcgcgccagggtgccgtcggggaagaaaaaaagggcagacagggagattcatgacacaaggc

SEQ ID NO: 585073 - DNA, 1334 bp, Homo sapiens
  misc_feature (676)..(676): n is a, c, g, or t
tcgtcgggagtctggcgccacaaaggcacaccacgaaagatgtgcagatatcttatcgggggttttccacagagagcagcctttcaagagaagcttctttgcgccccatgatggacatcagcctcgtctgagaaacacctcttcgggggagatttttctgcggagaacacgctggctgggtttttgccagcctctgtcataaagggggggtgccaccccaaatcttctggaagagacccttttgtggggttgtagaaaattgtacaaagacccttgcgtcgcggagcttgcagtaatgtccccccggggcgcccctttgtttcactaaagtcccacggtgggtcaaaaggggagcaataggggggggaaacaccgaaccggtggtaaacaggggtgtcccaaataacgcacacccccgtttggcccccccccaggaagcttgtatccccccaaaagttttccgccaagaagtggttttccaggagatattactcccccaaggttaccagtgataagccaatggacacatggtgcacacaaagattctctgggagcactcgggaggttgaaaaaaggggaccacttttgagagaaattggccctctcccacgcctattttcctgtgaaagttgccgccacaccacaggccatatctcacagctctgtgcttttttgncacgagagagaagcgtttcactccacacgccccactctgagaaagaggtgtttggagaacctccccacatatagggcacttgaatcacggaattatatgggtttctccgcgttcttgagaagattgacacacatgagaatgagatatatctcacagccacgttcttatatcacgaaagaatggtattgggattctctccccctttgccacaagccacatccctgtgagatgaaaacccacaaggagagagatgttatgagagagaaaatctcctgggtggcctctctttgttggagaggagaaaccttagcacattctcccttgatggtcctccaagactataggatctcagaagaacctttgaatatataataatatttctcatccctataaagacgcttaaatataggaaaagattttttccacacacagggattaccacggtgtagcgtcaccctcacacatagctgtaaaaatatagccctttaaatccatttttatattataactctggtataatagaagaataagatcccattttttaaaaatggttttctccccacaacaccattaaacccctataccagattgtttttagataaccaaacatgagaaagaagtttatgtagctgtgaaattaaatgacgtcaccagacca

SEQ ID NO: 585074 - DNA, 933 bp, Homo sapiens
cgctctcttttgtgccttctctcgtgctgttcgtttgtggtctgttgttctgtcgcgtttgccctttcgtttgttttgttttttgtcgttgcctcgttcgcgcgtgcctctcctcgtgccttggttgtccgttcgctctggtggtcttgcgtctcctgggcgtgtcgtgccgtctgctgcggtgggtggctcggttcgtgtgtcggctctcttgtgtctgttctctgtggtgtggttcgctgctgtgtttgcgggccgtcgcttgtcgcgcgctgcgttcgactgtccgctcttgtcgctgctcgcggctttctctgtgtgctgtcgctcgtcttcttttttcttgttcttgtttcgttctttcgttttttgtctggttccttccttggtgtgggtttcttgttccctgtacttgtttgtgctgttatttcatctttgctcgggtgtgtgcctgtggagctgtcgtattgccatgcttgtctggttcaatctacccatccggacggtgctggccatcagatgtacgttgggcgggactggccggcaccagtcggatctgtaacctcggcatgctgacgggagtctgggtcctcccgaggctcttgctatgccacgctggcgctctgtagccttggccgccatcgcggacgcagtgctccggggttcggcgctgctcggtatgactgttctggatgctgagcatctgagcctggtcggggtgtctccacagaagctgtgcctgggcttgggtcccttcggccatgtccctctcccggccaggggagacggagcccatccacagtgtcagctatgaccatgtggcccgcctgccagctcatgggccatcacatcgctggcccttagagggcgtgggagagagacctagctacctcgtgcagagccctcaggcggaggtactaactgcgccggcca

SEQ ID NO: 585075 - DNA, 633 bp, Homo sapiens
ggcatgggtggttcagtggtagaattctcgcctgccacgcgggaggcctggaactttccctgagtccttcccacccaccagcccatgacccaacccttgcgtgagtgcacccccgggaccacgcacacccatctcctaccagttctagacattcccagcgagcctcctgacttcagagaagggcttgaccgcctggcctccccaagccagatggctcccacgcatggtccacctgggaggcgccgagcgtcaccaaattgcgcgtggggacaccaggagctacgcattctacccaaacttggggggcccctccagggtccccagctgcaaccattcaaagaccctccgcggcagagtcccggcaagtaccatagggccaaagcgagcttaggacctacggggtgaactggccttccagttgcgtgccacaggcgtgatggggccccccagcaatgtggcgtggagccggggaggccccagaagcagctgcgtggagacatgcatcccggaacgtgaacaacgccgtgatgaagcctacgtgtacctacttggggccaacccgatctccctaatgaacaacaagtgacgaactgctttactctgtttgagaagcaatgatacgtgtgttacccc

SEQ ID NO: 585076 - DNA, 644 bp, Homo sapiens
cttccgacgctccgccgatcgacgtatctctgccggtcgcaactggaagaagagatcgccgcgctggtcatagacaatggcatccggcatgtgcaaagctggttttgctggggacgactgctcccctgagaccgtgtttccttccatcgtctgggcgccccagacaccagagtgcgtcatggatgtggcatgggccaagaatggactcctactgtgggctgactgatggcaccatgatgcaagcgtgtgcatcctgaccctgtaagtaccccatatgagcatggcatcgtcaccaactgggacagacatggagaagatctggcaccacacctatctacaacgagctgcgcgtggccccggaggagcacaccagatgctgctgaccgaggcccccctgaaccccaaggccaacaaaagaagaagatgaactcacataatgatcgagaccatacaacaccaccggccatgtaccgtggacccatccagagaccgatagctgtacccgtcttaccccctcttgggctgcaacacaatggaataggtcatggactactggagaccggggtaccacaaaatgtgcccatctacgaaggatacaaattaaaccatgcccatccatgttctgaccttggttggcgtccctg

SEQ ID NO: 585077 - DNA, 247 bp, Homo sapiens
aaaaattttttgcttgccctatgactgggcagactttgggtcgagcaacccgggggaattcccccccaggggcctccccccccttttccagggagggggtttcagtcccacccccgggggggcccccccttttttgggcttttttccctgaggcctttttccccatccctagggggttgggtaaaactcttttttaactttatgccccggggagggttcctttttttttttaacttcccccgttcca

SEQ ID NO: 585078 - DNA, 208 bp, Homo sapiens
ttcagacgctgaactactgtgatttaggatcgtaccagcagctttggaggccgggctgtggtggctcacacctgttatcacagcactttgggaggccaaggtggggcagcatcacctgtagttcaggacgttcgacgaccagtcctggtccaacaatatgcgaacatcccccaaccctactaaataacacataaaattcacgctgatg

SEQ ID NO: 585079 - DNA, 849 bp, Homo sapiens
  misc_feature (23)..(23): n is a, c, g, or t
  misc_feature (156)..(156): n is a, c, g, or t
  misc_feature (611)..(611): n is a, c, g, or t
  misc_feature (627)..(627): n is a, c, g, or t
  misc_feature (660)..(660): n is a, c, g, or t
gtgtattctcatatacatgtagnaataagatgacaacataaaagggccgttctgccgtcatttttctgacttcttcactcagtcaagtaatcatgacattgagtgctggaaggaatcttggagcagggcctgttgaatgtgcaggccgtatttctnagccagtgagccgaggaatggtgccaggagaacctctggggatcacagaatgggatggggcctgggaacctttgcataagctctccaagtgatttacgctgagtaagtaggacagcaggtcctctaatgactatagcctccctatttttatttgcatgtcccttcctcaaaaattatttggcctcaccccattgtctccccagagctactgctcttaccccattgctttgaaagccctgtattctatcatgtcccattgtagtgttgttacctgtggtatgtcactttcccactaggaagctccttggtggccgggacctgttctcctcatcctgtgcacagggcccagtacatgacgacattcattaactatttgctgaatgaaaaaataaatcagctgcatagccaaggaagctgttagttgatctgttgcaatgacaaagccagccctaganccctcattctcctggncccctctacattgtagtttctgcattgcactgntgctcacagagactgatttaattggcacaaaacagtttactagtttgagattttttttaaacttctctgaattatgttagagtgattaaaccataatgctgtaatcttctgatagggtgggcagattgcttgagcccaggactttctctactaaaaataccacaacattagctggtcatagtggcaggt

SEQ ID NO: 585080 - DNA, 823 bp, Homo sapiens
  misc_feature (288)..(288): n is a, c, g, or t
  misc_feature (511)..(511): n is a, c, g, or t
gcatctggttctgtcaataaaggaatgtatagatggtttggcatggaaacaaacagcactagtactgagctttcctcttataggatagttaataaataggcacgtgtttagagaaacctgaattagttggtaaagtgctttaattgtatgtactcagaatataggttggtcattggaagatttagctctttacattgcaatgtatactggtagattatgtgaacagaaggcggaagtttctagtaattgtgatttatggtttagatgtggcttgtgaaattgacctcnttatcgatatgtgtgttaaattaagagttgtaaatgttactcgtaatgatcttatgttgacagtaggatacatcatgaattactgttagagatggcttataagatttaagaaagttatcatcagcgaaacagtagatgtattagtacttctcagtgccacgtataaatttattcttacgatggtacttcatggtttacatgattgtattagggaccatttganttgcatatacattgtaaacgaattcgtcattgtagagtaacaatcgtgggcagaataaatattggaacaggtaatgcccatcgaaggctgagattcgtttaagattaagtcatagactagtaaacattaacgatatttgggagatattgtgtatgagcattgaggatttctcattgtagtcatattgtaggaactattataatcttttataagaggacctatagactgactagaacgaaaataggggcaacgacgacataaagtaacctttgaactaaaaacaattttaaggaacattgggtttaaggatac

SEQ ID NO: 585081 - DNA, 348 bp, Homo sapiens
  misc_feature (16)..(16): n is a, c, g, or t
  misc_feature (32)..(32): n is a, c, g, or t
  misc_feature (94)..(94): n is a, c, g, or t
  misc_feature (97)..(97): n is a, c, g, or t
  misc_feature (116)..(119): n is a, c, g, or t
  misc_feature (128)..(128): n is a, c, g, or t
aaaggccccaacctantatatcttaaaaatcntttatatttattgacattgttatcatttaaaatcaacagtgaaaacaataaaaacaaagaangcnactattataaacaggtcannnnaaacccccngggtggtgatactttggtagaacttctgtaattcttagagtttccggtccaggaattccattttgctaataatactgtatagtcagaatgatttttaagaattaagaaatgcttttctatctcaaaattataaacatattctcctgtatgttcttctaacatcttatagttttggctcgtacctttatctttaaccatctgaagttaattgctttctttt

SEQ ID NO: 585082 - DNA, 284 bp, Homo sapiens
ggctcgatctagccgagcttataatgtggtgttacctgtcacacgcacgtatacacacacacgcatcgaagcttccaggccaggcactggatccgagccacagcttgtcacctacatcacagctgtggtacaggctggctcctttaacccactttgctgggccaaggggttgaacctgcatctctgcactggcccccagccccctgcactgggattcttcatctactgtgccacagtgggagctccctaaaattaaataaacattgagtcaagagaactggatc

SEQ ID NO: 585083 - DNA, 285 bp, Homo sapiens
taaaagaaacactttggctatgtttcccagggtggggctgaaacccggggctaaagggatcctcccaccttagcctcccaaggggcggggattacatgcgggaaccaccaggcccagttggtttctgttttatgggcctgcctctgaaagactgggtcttccatgaggggggaaactacatttgtcttattcactggtgaagaccctcagggcttagcacagggccagcgcatggcaggttttccagcccagatgtcagaatactggaggaatcaagaaacaagc

SEQ ID NO: 585084 - DNA, 294 bp, Homo sapiens
acaaaattgtagaggttaaatcctgatcaagtaactgaggctgggcgtggtggctcacacctgtaattgtagcactttgggaggctgaggtggatggattgcttgtgctcaagagtttgagaccagcctgggcaacatagtgagacctcatctctacaaaaagttaaataatcaggcatgatgtgggtcagtttgaggtctgaggtgggagaatcgcttgagcccaggaggtctaggcttcagtgagctatgattacatcactgcttgggtgagagaaagagagaccctgtttc

SEQ ID NO: 585085 - DNA, 1089 bp, Homo sapiens
ggagagagagagagccagcggtgtgagtgcgcgaggcgaggccgagccgcgagcgacatggtgtggacctgggagcagctgctgcagcatgggcgctggcttggcctgagcaggcggagcgctacgactgacatggcctccgctatgaagtgcggtgacagagctgaatgaacctctctccaatgaagatctgaaatctcctctctgtggcctacaagaatgtggttaggtgccatggctgatcttcctggacgggtcattagcacgcatttgagcagaaaaccatggctgatggaaactgaaaagaaatttggagacacgttaaagcttaccgggcagaagattgagaaggcgctggagacagttatgcaactgatgtcctgtctctgcttgacaagttcctgatccagacctgcaactgatctccagtatgagagcaaggtgtcttacctgaacatgacgggtgattcctaccgctacttagccagcagtgtcgcttctgcgcggagcaagaataacagtgtcgtcgaagcttctgacagctgcctaacagggaagccttcgacaatcacgaacgagcagatgcacaacccacgcatcccatcggctgggcctggccctcaacttcttccgtgttctaactatgagatccagaatgcaccttgagcacgcctgcctctaaagcaaaacacgcatcgcatgcatgccatactgagctggaacacactacaccagaggattcctataaacgcataccagctgaaccacatgctacacgagaaacacaagctacactcttgacaaggacaagaggatgagcaagaggagaaagcgcgtcgaagatcttacaggccacgcgacacacagttcaaacacgacgatagtacaggagctcattgccgcaccgaaaaataacagggcgtagcatattgattggagcgcagtaaaagctcgactcgatccttggagcagcacaaagcgcggaggataatatgtttatgcaactactcacagtggcgaggcgagcagaacaaagagcagagagaatagaacagataagaaaggaaaaaagggatgacttgcacaggg

SEQ ID NO: 585086 - DNA, 773 bp, Homo sapiens
taccaagtgttgggttgttctaaatgctactgaagaaacacaactaccttatatcagttttatggcaaagctactaacaggtgtttttagaacatatgtcagagataacactttaaccagtgtcttcttgagtggaagtccttaaaaagtttgttaagttgcattgtagagaacaccattcatagaccaacgatggtcccctattagctgatattttcatttatgtaagatccttgtgacattctgttgttgtgttggaacaagattttcaactgtttttaattctcccttttctgcctgttcctaaaaactttcaaaataaccatttcaatgtaatttgtcttgaagaagtttacccaatatctttgtcattgcaactaatgtagtatggtgatggtcaatttaacttattgcttataaaatgaacttgattgcagtaaccatggtatcgatgagactaatgcagtgaagctttattactaatatatatagccttatcaacagcaagctaagaagcttgctttcacataattaactaatttacacacaatactccatctacgatgggattcagtttgtccacacgcaagtgacgataccattccaacaggtaaactaggtattctctgtcaaatttacatctctacagacattagagattagtttttacttgctgtatattctacaaaatgacctaataggttactgtctttttaactgcattctgttattctttcgtaattttaagccctcggactggacgttagaccatc

SEQ ID NO: 585087 - DNA, 327 bp, Homo sapiens
  misc_feature (80)..(80): n is a, c, g, or t
ccaaacccggtttgtggccctgaatgccccccccctttccgggtaatggaggaccctttgtgatttccattaaggccaantgcattgactccccagcctcagccgaggccgtgtttgcctccgaagtgaaaaagatgccacaggagaacattaagccgcaggagcagtttacccttgagccatatgaaaaagacccttccgtggttgtgggagtgtaccggcccccccccaaggtgaaaaacttaagttcagccctgtcaggattgcgaaaaatgtgtgttgatactgttgcccgtgtgtttttttattaaaagactcctccgtcca

SEQ ID NO: 585088 - DNA, 368 bp, Homo sapiens
tcttggagagtgaccggggatttgttccttaggagaattttgtgtattcttttttggatatgatttaaatgcctccttcagggtacctgtggtagggcacttacctaaaaggaaagacaaagcctcttttgcattttggcactaacaggatctctggatagtaactggcctggtgcagtgctagctagactcaggaagtcatctgccctgccaccctttccaaattcagaggcttaggtaatttgttggaaatgacaatcggaaactggacttttgctggattttcccaaaaaataaatagaactttttcctaggcctggaattgtaaatttctcggaaaaagaatgagggacacctggcacagaaag

SEQ ID NO: 585089 - DNA, 198 bp, Homo sapiens
attcattcattcatttaatcacttttttgtataaatgtaaggggtacaaatgcagttttgttccatggatatattgcataatggagaagtctaggctttcagtttatccatcaccagaatagtgtacattgtgccctttaagtaatttatcatccctcaccatgcctccccactctcccacccttctgtcgtcttctc

SEQ ID NO: 585090 - DNA, 476 bp, Homo sapiens
ccaaagtttaggcaacttttagaaggcaggcatagagataactatatataaagggaaaaaaatgagagttataattgcctgaagtattactaaatccataggtaggctaaaactgtccttattccctatggtactcttatgatttggaaaaggagaaaataatagccaaaaaacattcagtaagacagtcaaaaaccaaaaccgtaaggcaaaaataacagcatgaaaaaggacggggaccctgggagagcccaaagcaataacagattattcaagtcctttaaaaaatatgaattccgaacaggcgcaggggatcacgcctctaatcccagaactctgggaggccgaggcgggcgtattggttgaacccgggaggtgaaggttgcagtgagccgagataatgccattgcactccatcctgagtgacagagtgagactccatcttaaaaaaaaataaaattattattatttctaga

SEQ ID NO: 585091 - DNA, 366 bp, Homo sapiens
agctctcgatgatgacaaatacatagagatcagacacactatggtctcggaccattggcacaggatacgtagtggcagggccacaatggacagctaatggagaccacaattcgggaacatgtcttctcaaagtcagcatggatagacatctcatcaccttcacagaatcctttactagtacaattcgagcagagacagacacccgcccatcaggaatgaacatgcaggaaactattacatttctttaatagcagacacaggtgccattaaatcaggggtatagacatccaccagatccactacttcaaagtaaaactatgtctcttgagttggctggctcgggcggtcaagaaaagccttaaccca

SEQ ID NO: 585092 - DNA, 261 bp, Homo sapiens
gccaatacggctctctgggtagtggattctaaggccttccccacattttatgtaaacccagtgcagtttctccttctaccacagcttccgtctcaggcttttctagaaatgagctgcattccttaccttctcgattttgttcaagccccttctttgttaggatgcaagttactgccataaaatggctataatagcatcaacccatttactagtgcagatttctaggcttcatccgttatagacatccccaaacagcacggg

SEQ ID NO: 585093 - DNA, 686 bp, Homo sapiens
ggtgcgcccgcgcagcgttgggggtccccgccgagggtttttgatccgcgccccgcgtattgtgtctgcgcccgtcgtcacttagagtttcacccccgcctaatcgttttgtgttcgtcttcactactgcgcaaggggcattttcgattcgggccccggagacacacatttgggagtcgccgtcctctcgttcatgcaatagcaataagcccacgtttaactactctggtgtctacgacagccaataagttgtctcacatgctgcccgtggcgacagcatagatgatacgtctgcgccacaaagcggaccatcccggtggctttcctgcgggccgccaccaagtgcatgccaccacgtccgcctgcagcgtaatattccaggcatgcttccccgcggcccacgttcgctgcgaagagtcatctcgtgctgcgcgtatcgcaggctgcccccgacaaattggggaccacgcaatgggtcacgtactaccccccatcctactgtcgcggacgccgatgcgcgctcgccctcgggcaatgaatgcgagattccgcttgtcacgctcctgctttaccacacggagtaatcgcgcgcgtgcgagtgcccccacggcccgggagagaccacaaccgggggagacccgccccccaggggtttttaaaaaaatccctaaagcggcccacaaaac

SEQ ID NO: 585094 - DNA, 197 bp, Homo sapiens
ctgccctagtccgtccctgaccctgtcctcctgctctaactcctccctgtaccagtcctccagccctaactcctccctgacctgtcctcctgccctaactcctccctgacccgtactacctgccctaaactcctccctgtctcagtcctcctgccctaaactcctacacctgtaccagatcctacctagcccataac

SEQ ID NO: 585095 - DNA, 1449 bp, Homo sapiens
  misc_feature (244)..(244): n is a, c, g, or t
  misc_feature (281)..(281): n is a, c, g, or t
  misc_feature (299)..(299): n is a, c, g, or t
  misc_feature (301)..(301): n is a, c, g, or t
  misc_feature (303)..(303): n is a, c, g, or t
  misc_feature (438)..(438): n is a, c, g, or t
  misc_feature (459)..(459): n is a, c, g, or t
  misc_feature (465)..(465): n is a, c, g, or t
  misc_feature (626)..(626): n is a, c, g, or t
  misc_feature (770)..(770): n is a, c, g, or t
  misc_feature (852)..(852): n is a, c, g, or t
  misc_feature (991)..(991): n is a, c, g, or t
  misc_feature (1100)..(1100): n is a, c, g, or t
  misc_feature (1213)..(1213): n is a, c, g, or t
  misc_feature (1245)..(1245): n is a, c, g, or t
  misc_feature (1306)..(1306): n is a, c, g, or t
  misc_feature (1318)..(1318): n is a, c, g, or t
ggaaagcgagagaggggctcagtgatatgacaaaaacgttttcctctctttctatgcctcgccgatctcctcatcaattgccacttgtgattcgcatgttctgctaccgtctactacatgggtccaaccacacactatggttaaagttgccgttcgtcaagtggttaggctctcctttgtcactcgtgctcactcgcagtctcggtcctcgtctgatggtatctcttaccttctatgaacaagncattctatatgccctaccctttccatagtcttgatanatctatataacaaatagncntntactaactgattaatgactcattactaattcattgacttataaatcagtaacttgtgcataagttcgcgtgtcaccgtattgcaagcgggtactaagaggttctacgagaatgatctcatatgaaccttcgtgtncgtttgcccacacaaacccangtgagngtgcacagagtgcccacggttccgttcgtgtctgcagattagagttacctagaagaacttcaaggacgctggtagcttactgtggatggggcggtcacaccactcatgtgtacgttttgcgcacgagcatagtctgtgtgcgcatgtgtccctgtagttgntcagtgtacacatactttcatgggtaagaagaatgcctcaagcgtgaggaatcgagcaggtgctagtgcatagtaggaacgacccataaggattatgcgaaatgttgtcgcactagataagactctcaatcaactatatggggnctcatcgacagaacgtcatatgtatccgtcgttgaatctttcgcaacgaaaagacacatatataccgttattggggaaatcnttgcagtaagagagggcgagtgcccaccgggaattaacatccatacactaaacacttcccaatatactaagggtcgaccgattctagttggtttatctaaagtgcccatagtacatcggctagggaaacacaaccaggncggggtgctatcgaagcaatggaagacggaattcccagttgtgcccgcttacaccctaagccgtaaagggtgccacaccttgggtggtcggaagtaaatcccctggccntttgtgagcgcgaccaattacgacggactaagagaagcggaatacccatgtgtgcgagcccacacgcacgatcatcgcctatgcgaccaatcaactgcaataacacccaggcncttgaatagtgcgacagaaacagtggccaacnctgctcgaggccgcgagaacatcactctcgcgcgacaacatcaccgggtggcacagtctantgcggacaaccncggcgcatggtgtgccaacacatatctgagccaccctggaggagactgaccatctctaatactaaaggagctgaccgcggaacacacctgttatctccagctgggaggaggccccctctcatatactagcc

SEQ ID NO: 585096 - DNA, 161 bp, Homo sapiens
tacttcttttgacagtggggcagtctcagagcctcccaatggatacaaagaagatgtacctaaggaagcctggacaggtgctatccctttccatttctttttgttccatcactcttctctcaacctgtgtttcttatttttaccgaggaggagaagcagca

SEQ ID NO: 585097 - DNA, 786 bp, Homo sapiens
  misc_feature (48)..(49): n is a, c, g, or t
  misc_feature (64)..(64): n is a, c, g, or t
  misc_feature (66)..(66): n is a, c, g, or t
  misc_feature (92)..(92): n is a, c, g, or t
  misc_feature (275)..(275): n is a, c, g, or t
  misc_feature (303)..(303): n is a, c, g, or t
  misc_feature (378)..(378): n is a, c, g, or t
  misc_feature (751)..(751): n is a, c, g, or t
  misc_feature (753)..(753): n is a, c, g, or t
  misc_feature (760)..(760): n is a, c, g, or t
  misc_feature (764)..(764): n is a, c, g, or t
  misc_feature (779)..(779): n is a, c, g, or t
gctcgggttaatcggcgaggcggaactatcgcattaataccagactcnnggtgaaggctatgtnancccaatgagggtgctatcgtgaggtngcactggaagggtactacaaggacaagctctttgaccagcgggaagctccgctttgagattggcgagggggagaacctggatctgccttatggtctggagagggccattcagcgcatggagaaaggagaacattccatcgtgtacctcaagcccagctatgcttttggcagtgttgggaaggnaaaagttccaaatcccaccaaatgctgnagctgaaatatgaattacacctcaagagttttgaaacaggccagaggagtcttgggagatgaattcagaagcagnaagctggaacagagcaccatagtgaagagagcggggcactgtgtacttcaaggaaggtatgtacaagcgagcttgactacagtataagaagatcgtgtcttggctggaatatgagtctagtttgtccaactgaggaagcacatgagagcaacagggcccgttcgactggtcgctctcagcctcaacctggccatgtgtcatctgaaacatagcaggccttctcgtgcatgccattgaaagctgtaacagaggccctagaactggacaggcaagcgacgagaagggcctcttccgccggggagaggcccacctggccgcgaatgactttgaactggcacgggctgattccagaacgtcctgcagctctaccccnancaagaangcgncaagacccagctggntgtgtgc

SEQ ID NO: 585098 - DNA, 107 bp, Homo sapiens
agcggtctatgttttgttttgttttgtttttttcttttcttggtgtaagctaaggttaatctttgcttgcttcctaagccagctcctttcttgcttgccttcttagc

SEQ ID NO: 585099 - DNA, 719 bp, Homo sapiens
  misc_feature (349)..(349): n is a, c, g, or t
  misc_feature (596)..(596): n is a, c, g, or t
  misc_feature (599)..(599): n is a, c, g, or t
ctttggggaaggatgcaatggacagatttgaggtctgttctggagcatgagccaacaggatgcaatagggctactgggggtggtaatagaaagagaggtggtggtttctcactgggtgtgttgggaggaagatctttggggaagcagggattgggggatggatgaagagtgatggctctgtcctccttcctcctttggggattctccgatggttctgcacaaacataggtgccatgcacaacgcctcaagcttggaagtggtagagctgggatctctacctggagagtccttctctaaatctgtgcggattctgcagaaaccagccactgctgacgggatggagtgganggtggcttgtgccatggccaagctgggcatggatgtggactggcaagtccagtacacacatgtgtgcatggcccagatgcattacactgacatggtcagaaagcgatgtttctgcctcttggtcccaaagtctctgcccagaactggctttttgcaaatgttctgaagtcttcagagcctcttatgtgagcctctttcaagcactcagggggaagcctcacttgcttactaggaggctaagcttggnccngcccatgaggcaaggggatgggtctaggacatggacccttcaagtcccaagaaccctttttgtgggaaacaaccatttggcctaacggccttttgctagcctttcttggaaacaattcat

SEQ ID NO: 585100 - DNA, 818 bp, Homo sapiens
  misc_feature (48)..(49): n is a, c, g, or t
  misc_feature (64)..(64): n is a, c, g, or t
  misc_feature (66)..(66): n is a, c, g, or t
  misc_feature (92)..(92): n is a, c, g, or t
  misc_feature (275)..(275): n is a, c, g, or t
  misc_feature (303)..(303): n is a, c, g, or t
  misc_feature (378)..(378): n is a, c, g, or t
  misc_feature (783)..(783): n is a, c, g, or t
  misc_feature (785)..(785): n is a, c, g, or t
  misc_feature (792)..(792): n is a, c, g, or t
  misc_feature (796)..(796): n is a, c, g, or t
  misc_feature (811)..(811): n is a, c, g, or t
gctcgggttaatcggcgaggcggaactatcgcattaataccagactcnnggtgaaggctatgtnancccaatgagggtgctatcgtgaggtngcactggaagggtactacaaggacaagctctttgaccagcgggaagctccgctttgagattggcgagggggagaacctggatctgccttatggtctggagagggccattcagcgcatggagaaaggagaacattccatcgtgtacctcaagcccagctatgcttttggcagtgttgggaaggnaaaagttccaaatcccaccaaatgctgnagctgaaatatgaattacacctcaagagttttgaaacaggccagaggagtcttgggagatgaattcagaagcagnaagctggaacaccagagccacccatcagttgcacaagcagctgcgggccactggtgtcacttcccactggacaggtcacaatcaccacagccacagctttcactcacagttcatacagcacgcatcgtgtcttggctggaatatgagtctagtttgtccaactgaggaagcacatgagagcaacagggcccgttcgactggtcgctctcagcctcaacctggccatgtgtcatctgaaacatagcaggccttctcgtgcatgccattgaaagctgtaacagaggccctagaactggacaggcaagcgacgagaagggcctcttccgccggggagaggcccacctggccgcgaatgactttgaactggcacgggctgattccagaacgtcctgcagctctaccccnancaagaangcgncaagacccagctggntgtgtgc

SEQ ID NO: 585101 - DNA, 160 bp, Homo sapiens
attctctttttagggggaatgggaaccggccccctcataaagggttcaaagatcatcaatttttttgcctttttaaatcattatcattattatttttaattaaaaaaaggcctgtatccctttttttggtcggattgtaaataaatatcccattgtccta

SEQ ID NO: 585102 - DNA, 530 bp, Homo sapiens
aaagtctgcttctcctgctgcagcgatgggaacattgctgtctgggacctgacaaccagaccctgtcagagttcaggcaacagatggggcactgatagaattccatgatggacaactgtggacagggggctgaaacacatcctctgggactcggaggccgacactacacagcatgacttcattcccagattctcctggctatgccacttgggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaacttctcaacgcctggaggacgccttatggagccagcatattccagtctaaagaatcctcgtcctgcttgagttgtacatttcagcggatgacaaatacattttacaggctctggtgacaagaaggccacgtttatgaaggtcactacttaacaggactcccgcagg

SEQ ID NO: 585103 - DNA, 140 bp, Homo sapiens
catagacgtccagttcttgcagtacggaagcctttaatcacatctcagcccttagcatcggaaagcttatactgtaaataaacgagtaaacttcaggttggtgggtgacaagtgctgaagagaaaaaaggacattcggga

SEQ ID NO: 585104 - DNA, 767 bp, Homo sapiens
ccacgcgtccggcttatcgccacactaggttttcctctgaaacaaggccctggattacaagtgtcattggtggaatcccaaggcatgcgaaagacggccaaggatggcatgctggcgggagaagcctgcgaggacccgatccctttcgaggatccatccctgcagatgactggactctctgacaaaaggcacgccagtgtagcatctgcgctgcttcctgcgaggctggctagccctccccacaagcgggtggtgccacatcagggctcagacatcatcctacactgtcgagaacagatggagcgcccaactgtccatgctgctggaacgtggtctggtagggggtgaataggctacgcgagcctgtgtggccaccatgcctgtggcctacaggcacttgtgtgacaaaggacatgcatcaggcgtggcaaggccatgtatgtgtccaggtcgcaccggaagggacctcccatgggttgtagacgccgccgtcctcgtggcaggcgaaatgcgttaccagccatttctcgatggaattacagagatcgtcattaggccccatgacgctcttcaatgcacgcttcctctaagctccccatcacaccaggtccacatgaagccactctcctgccctgttgaagttaaggccataactcaaacggtaacactcttgtccgtccgagtgacccttccctttaccctaccagattgagcgtgcgccaagccagtggatgcttgcctggacgcttatgaaaaattgcaataag

SEQ ID NO: 585105 - DNA, 815 bp, Homo sapiens
tttttgattattcttgtatgattagttgaccatggtaataaaaaatggtacccaaatataaaaggatcagaaaatgggatcaacgtcgggaacataacccctatagttgtatgatgacaatttgtgtgacgtggcagaatgtgaagaaaagccatcgagaaatgtgcacatatgcgttgtgttatgtgtgagacatcgctcaaattacagtgccacaacaataaggtaactcctcagtgtaagaacatgattaggatgagatgaactcctatccaaatagcctctcacgacgactacaagggtgacaaacaaacatctgttgcgcactcatctttcagtggtagatcacgagaaaaaaaagtggagaaagacgagtgacgaacgacaatatatatcaataatcactactatcaacaatgtagagacacactgacacctaacatatcccaatctagagactctacaaacaatccacagagcaatataataaccctgatatacaaaacatccacaaataatatattctgaatagaaaagatacttaaaacacagaaaaagataagcgataagacgaagaaaaaaaaacagcacaggaagaacgaaggaggacacaagaaaagagaacatcgtagcaggccagacataggaggcgatagaagagggagaagaaattaatcagaaaaaaaagaagaacatacaaaagaaccaacaaatgattaaacacacacaggcccacaaaccgacaacagcacaagatgaagaaagaaagacaacacacccaggacaagcacaaccaacaatccacaaaagaaaca

SEQ ID NO: 585106 - DNA, 448 bp, Homo sapiens
  misc_feature (3)..(3): n is a, c, g, or t
  misc_feature (49)..(49): n is a, c, g, or t
  misc_feature (78)..(78): n is a, c, g, or t
  misc_feature (129)..(129): n is a, c, g, or t
  misc_feature (440)..(440): n is a, c, g, or t
tgnagggaaagttgcctcaggaatgaatcatgcccttgagtctcacccntgtttgatttagacgagactctgggcttnggacttttgaatggggccattgggatggaatgagtatattttgtatgtganaagaacatgaattggtgtaggggcagggatggaatgctacggtttgaatgtttttatctcccaaactcatgttaatatttaattgtcattgtaacagtgttaagaggtgggatccttaaagggtgattaggtcagagggaggataggctggaattggtgctggtataataagatgagcttggccctctcttgcccttccaccttccacagtgacacaacaagaaggattgcaccagacgctggcaccttactctgggacttcccagcccccagaactgtgagccaataaatttctattccttataaattanaaaaaaaa

SEQ ID NO: 585107 - DNA, 255 bp, Homo sapiens
ggtgggtgatctagaggatcccggctcccactgggttgctagtaacttaacatgaaatcaagaacttatgggtcaacactctatacaccgtcaggagtggctgcggtgactagtcgtggaataggaaacgggagcgattctaaatccattaccaccataaaaggaaaagtgatcccaccaccagatatccacattggacagctaatggggaaaataatctaaagcttaacccttgaccatgggagatgtgatatc

SEQ ID NO: 585108 - DNA, 294 bp, Homo sapiens
ttcggcgcgcgccggcgcttaaggaacgtctcccagctgtcgtgccgcgctcaggtgcgtcagagggccgtaatccagcgccgcgcgcttcaagctcttgtcattcaaggggaaactgcaaggctcgatgacgtccagccccacgccgaaacaggcggtgaggcggatggcggcgccgacgttctggggaatacccggttgaaaaagtgcgatacgcataataagcgaaccaaccacaagggcagcaggggctttgccgcgaatcgaaaggacttgcggacttggcccgcgcgt

SEQ ID NO: 585109 - DNA, 468 bp, Homo sapiens
gaactttaaagaggaaatgatgtacccccctgggagccagtgaggtggcagcgatggtgattaaggagtgaatatctcaaggaggtggacgaattcggggatcactagctcagctgcccctctccacctggagcatctccttccagtgctaccctcagaacatctgggctttgctctagtgagggagagactagcaatgaaggtgtcttgagatcagcactgtaattccaccaggacgccaccggagtccggtgttaagcttctactatggcaacagaatgagagcgtggatgggttgaaatgccatttcaacaaggaaatagtagaattagaagaagcataagcactaaaaggaacattttgtagcagaaatgttaaaaatctaaaggaggcaagtgaatcaacaatgactcttctattctgggcaagtccagcccatttatgtaaggtggttattctgcatctctg

SEQ ID NO: 585110 - DNA, 1031 bp, Homo sapiens
gggatttgattaatcatatcagaggactaaggtcatttactatggctcggccttcgagcccaatgctggtacagtggtgttggctgctcgaacgaggataagcggacgtggtgtaaagtgtgaaatttctccccaatgacaactgccacacagcgtcgctgtggcaactgcgaaatagagtctaagcacgtttagactcttaagtgagtaagtgtaatgtggtagaaggtccgtgccgtaattgccagtatcacatggaaaagttatgtgatataagtaagagaagcccaagtgatgagatcaaagtatgtgaccaagcaagagaagtcatgtggctaacagagatactgagtaagtagatgatgagacggcgtgtggataagacaaggacttcagttggtaaatttagagttgatgatgcagcagaagggtgaaagtggtctaaatacagttcgcgagcgttgtttgggaaagcgaacagatttttagccgttaaagtatctaatgttaacttcaactgggagacgaccatgggaattttcactaacagtggacgcttcagatggagcgggaggctcatcatattgcggaaaagacttgttaccattgtgcactgcgtaaaagattcttgttgaaggattcccagtgcacgaagagtggtgaggggtggcaagcccaagattctgaaataacttgggcggcaaactcatcaggggtgtacaggaatgcttcgcaatgtacgtaaagctcagaggtggttatgcaagtacaatgggaggtaatcgtggagaaagaacgaggggatattaaagagcgttggtacttacccacagagttggtttaaattcaagcataggtaagaggggccctgtgggaccattccgtgggaagaacgggacgccgtggctcttggcgtgagaatgtcaaaggagtggcggagacaaaatatgtcgacgacagtacaatcagagtaatgggccgcatatagccatatagagagttgaccaatacgaaaccagaggctaactgaa

SEQ ID NO: 585111 - DNA, 370 bp, Homo sapiens
ggttccaccatgcacttctattctctaggaggttataattttaagtcttacattcgtagtcacattagggcttttcttacggtacgtttcgggaagatttggggggagggctcttttaagacttgggcctccgttgtttaacagtctctttactatattaatccgcactaacatctctgtgatctctgcacatattgtagaggttatcatgtcttctagattacttgagggcattggattgggctgcttggttagggtcccttttaagattaattcatctgattgcgagacaggctctgaatgacctctgttgtcttcactatgtattgatgacttaccactcgtagcttgccctcagatggtgcatgct

SEQ ID NO: 585112 - DNA, 107 bp, Homo sapiens
atggaggtgtcctgcgggaggtggtgaagcacccctccgtggagtccgtggtccagtgtgagatcgacgaggatgtcatccaagtctccaagaagttcctgccaggc

SEQ ID NO: 585113 - DNA, 1419 bp, Homo sapiens
  misc_feature (140)..(140): n is a, c, g, or t
  misc_feature (628)..(628): n is a, c, g, or t
gatttcatcgaccgactaaagattccgtgctgctactgcaagtcatagactttcctcttcgatttccgcctattcacgctctgatagaacgctacagcgcatcacatccatttgcgtgcacgtgccatcgtacccatccnacaggatcggccaaggcgtagtgtatgtcctaaatcgtggcaattgcactcgatcgggaacgcgtcctcacatgccgtcgttaaccactgcgcaatccgacgccacgtataggtcagataagctaagttgatagggtacgcaatcggtcgcggcatgcacgattcgactgtcctatctgagcagccctctcattcaatgtccgtatggactcggtgggccctctgtgtccaatacaattagtccgcgcgcgggaggcgcgcctgattattgttacggagcattcgagtaatatcctcaatcaacgttccaagtatagaaacggtagaagatatccagtcaacgcttcggagtctaactcctctcatccccgtcgccattgtctgtccctatcctcaattcaccgttagaaacgacgagacccttttcaattcaacgcaggcggtgacttaagtacgcataccgcaaccggttctggaggcgcgacccnataaaattttaaaatgagtgctcctgaagagggggcgagcttcaaaccaagggcaattttttgagccaaaaagtgtatggaatcccaattctggggacgcctactggctcggtgtggcgccactcgggggagcatctcaggcacccagtccagtgtgtcccccggtaggcacagttccgttcgcacgggggaggtgtcttcacatcggggggctttgtccacttagggggctctccgtacgccacttcggacctcctcgtgcagttcggcgtgtcgtgcaccccttttgggcgatacctttgcaagagtctctctagcccccgtcttggtccatggtctcatcactactggtcgacgaaagaccgcccgttttcagttccaatcggaagagctttcgcacaaatatcaaattcggcgcctaaaacttggtcacatttggtcccaccaagggagacatgggggagtgggaatttctcccatacatatatacatgattgttaacccccccccccgttaaagtcgggacacacactttccgaaagaggggttgtcttcctacccacaagtatcttacaggcagggaatagtttattcaacagagcattgttgcgaaaagggcccgttcttctttcaaccaacacaccctttttcacccagttttacccattcgtagaaacgtcctaaaacacgcagagaaaacagtggcccagacacatttcacgatggtggatatagtaaccaatctttcctttcggaaaattatccggggtagttacccttctttttcccat

SEQ ID NO: 585114 - DNA, 455 bp, Homo sapiens
gcgtgcggcccagcgctggcgcaggtgcatcaggtccaccagaagcaggaagatggccacggccatggtcagggacaccaagatgtctcccatcaggagccccatggctgtcctgttgatctctggctcctctggtcacagctgctgcccctggttcccaaggcactagggaccaggcaggatgctctaagcacaccctctgtgctcccaggtgcagaccgtttctttaataagggagccaactgctgtgttgtccatgttttttcaggttgcacgcagtggccagtgtggtcaggttctcaggcagccacagaggtccttgcccctcctgtcctcctcatgggcgtacccctggcgtggtgctgctgtcaatgcgttctgagaagaagcacggtgggggcaataggtgctgattcaccacacagacaccgggagttgagtgaaagggagctaga

SEQ ID NO: 585115 - DNA, 630 bp, Homo sapiens
  misc_feature (384)..(384): n is a, c, g, or t
tgggtgttcttgtagttgaaatacaacgatgtgtttttcatatcatgggtcggggttgtagcccgttgcgaaaataatgatgtatgcttgggtgttctggtgaggaggtggtgggtgtatatagtaatgggggttatggtgggggttttcttctaagccttctcctattatatggggggttaaagtggagagtctgggaagacagactgtgcaggaaatgggcaacctcaaaaggggagacagggaaacaagaagggaaagaacacagggtcgcatacaagctctcgctggaccctccatgggttggtctaagaaggtgaagaagaaatggtgatattgggtgtgttctttgcgcataatttctttgggcttctcctctccaangaggaccatctttttgtgtccccagtggttcactgagatccttctctgtggccaaaaaacacccatactggccgggtgtgaaactgggtggggaaatagaaagcgggtaaaggggcaagaaccagaagaatgaattcctccaccattattgctggctaattgttggggtctggcccagtggatggtgggccccaaatggggcgcaaagggacgctgggtgtattcacctgccctacacattcaaac

SEQ ID NO: 585116 - DNA, 292 bp, Homo sapiens
cgtgcgaggaatgctgagtacatttggctggtgtatatttaggtaaaatgcttgtgttcattatctggtggtgggaggggactgaagccgtgtagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcattcctcgcaacag

SEQ ID NO: 585117 - DNA, 752 bp, Homo sapiens
  misc_feature (13)..(13): n is a, c, g, or t
  misc_feature (17)..(18): n is a, c, g, or t
gatgatagcatgnaccnnctagacacgtagtacgccaagcttgaaactaagccttaatgaagggaacaagaagctggagcttcaccgcaaggggctggcctgtctataactactggcatactccggtctgtacgaatactgcacgaagttataaagtttaactataaaactaatttttcttacacactaaatgggcatttgttcaaaataatgaatttatggcttcacatttattgcaggggaatatggaacttatataaaacatggggggaacttcatttgtcaaatcatgtttgaatctacataacagtaggactagtgatcctttttgaaacggggtcctcgctctcaaaccacgctggattgcagtggttctaattaatctcactgcaagctctacctccgaggttcacaacaattctcgtgcctcaaactacctactagatggtactacaagtgctcaccaccacgcctggctagtattatgtatttttagcatagactcactattaccttgtaaactcagaaggtcttgatctgcagatactttgaaatgcttcatcttgcgctctcaaagatcagcgtattactggcatataacaaattcgtcacagtaaacatactctcactaatttctatgtatatggctgccatttttatcacttttaaaagacttaaacatgattaaatttttgggaagaataattttttttcgaatttaaactgatggtaaaatatcgggaacaatttta

SEQ ID NO: 585118 - DNA, 569 bp, Homo sapiens
ctgtagtattaaaattccatggggaggcaattaggagagaaacttatacagatgttccttagcggggccgtggaaaaataaagatcaagaaacaacagtagaatgatggattggggatttataaccttattatttggtgtttgatgaagcacttcttcagtttttcttgaacttctctcacaagctgaaatagatcccacctgttctagtataggagctttggttcataaggttaaggacccactactacctccatgatttaaaatccttggaattgtagcctgttaaatggaagggacattggagacattgaggggaggctttcctgttgatccaccattacagcaccctgacaggtcagttccctgtagtaacattacagtgtgataagccctagacaattttcaaattcagtttagcccacttggtatcattcggaatttatatatttcaggaactagtatggtacttctgtaatgtgccctttggtgggagaataatgaaggttttgttagcatatagatcttgggttagtagcttttaatttgttacgtgacatctagtgttat

SEQ ID NO: 585119 - DNA, 192 bp, Homo sapiens
ccagtcttccattgttacggctttggcacatacagtataagataaataattcgaccacataattataccaaattcctcttatcaactgtcatactaagttgttcttcatctacaagtatactccgtgataacaatactagggaaaccttgattaaataacagcgtaaaagtagagatattactagtgcaata

SEQ ID NO: 585120 - DNA, 170 bp, Homo sapiens
accggggaagggttattaacagaagtatcgtccaacatagagaatcttagtgtcatgcacgcaggtatggcaaactgcactctccactcatgtgtcagggctcaacgggctggttggtgccactgaagacgaccctggcttgtaactacatttctgctcctttaccttga

SEQ ID NO: 585121 - DNA, 511 bp, Homo sapiens
ccagagaggtcatttagttttactcctgataggtagatgcagctctttcttatatttacttgcgaaagtgcagtggggaagagggaattctagattgatagggctggcgccttctgaatttggtatttgaactaggagtccctatagaggggctgctttatgggaagtttttctctgaccaggtacaacacctgagtttaaaggcctgaaatgctaccatttcttcctctggctcaaaattcttccctgaggagagagttatattcccttatttattgatatttagtccagaacaccagatctaacgaagcatgcgtgtctcttcatctacaggatgcaataggctgattgtatttaaaaatcaaagtacccaaaactgagtcccttgggctcagaaatgtctgtgtgattgggtcagactctgaccaacagattttatgctagatagcacaatttctattgagccttacctgcaacaatgaacccttaaaagatttttttcactcccgta

SEQ ID NO: 585122 - DNA, 774 bp, Homo sapiens
attgatattataggatttgaaaactttctataatcagcaggagtaaaactggctcaaaattcctaggcaagattatgttataatagaaattgatcgtcctaaagcatgctccaccccctttcagaagtttagtcccccaatagcatctttcttgtagatctcttgacctggatggggatctaggccccctaagggcaaagggactaaacataaatcaatgtgaatttttttcccaacaggggttaagggaggtactcctgtctgatatttgaccactagaaagtaatctttttttaccaaaactgtttttctaggtgggtggaaagtgaaactgcccacatccctgttggtttaatcccagagatccatttgccaaccaccgtagatgtcccggttttgtttctgtccttttattatgaaaactatgttaagggggaaaatgtggacttatggtaacccgaggaatccctagcccttgttttcccttagaagacttgtttagtgttttatcagacgtctgttgtagttgtagacaggaaagcgttgtgagaaaaaccacccacctggagccctgtacaatgtttttgccacccaccctgtaaagcatttcttggacagctggcccattaaaaggggttttaccatttaaaaaaaaatgtaactgtgtccttgtttacatctgtaactttttcctcccctgttctcattacacccttctggcgaaatgtaggccaagtagcttcccgttttagaataaataaccctttggattga

SEQ ID NO: 585123 - DNA, 162 bp, Homo sapiens
tagttatatgcaatgtcccattcctcaaaaccaaattactgtgttaggctgttattgcattgctataaataaatatctgagactgggtaatgtgtaacagaaaagaggtttaattagactcacagattctgcagtactgtacatagacgcatggtgtacagc

SEQ ID NO: 585124 - DNA, 134 bp, Homo sapiens
agcccggctacccccaagacccaaccggaaccagccccctatgcggacaagacatcaccatggggacggtggcgcgaaacgccccacaatgccgcacccaaactatgcagacccccagattcaatgggcggccg

SEQ ID NO: 585125 - DNA, 450 bp, Homo sapiens
  misc_feature (120)..(120): n is a, c, g, or t
  misc_feature (129)..(129): n is a, c, g, or t
cagtacataagcttggatctctagagcggcgccgcggcgcgggcgctggcgcagccgcccgtgccgttcgacttcgacgtcgagttccgcaacgtcgcggatctcgaccgcacgattgancgctcccgntgcgggttggatccttttgccgttgctgcaattcctacaatgaattatagttctgaagccttccattcaaaagatgatgcccagtgctccatatgtttaggtgaatacaatgataaagagatactgcgtataatgcctacatgccgacataacttccatctggaatgtatagacgtatggttacagaaacaaactacttgcccaatatgtcttatctcattgaaggaccaacctggtgcaaaatctacagcatcccctctccgtaccctccctcaaatattgggacatgccgagagctctgtcaatagatcgcctcattgg

SEQ ID NO: 585126 - DNA, 919 bp, Homo sapiens
tctcaatcccctgacaaaacacatagcctaccccttccttgtacctatccctatgaggcataagttataacaagctccatgctgcctactgagaaatagacctaaaatcgctcattgtgatactcgttcaatcagacgcacatagccctcgtagtaacagcccattcgtcatccaaaccccgctgtgaagcttcaccggcgcagtcattctcataatcgcaccacggacttgacatgctcattactgattctgcctagtgaaactcaaatctacgaaagcgcactcaccagtcgcatcataatcctctctcaaggagcttcaggatactactcccaggtaatagcttgtgtgatgactttctaagcaagccgcgttaaacctcgcgttagcccccatattaaggctactgggagaagctctctgtgctaggtaaccacgttcgtcctgatgcaaatatcgactctcctactatacgggactcaacatactagtcaacagcccgatactccctctacatattgaccacaggaaaggggggctcaatcatcgaccacattaacaaacttaaaacccgtcattcacacgagaaatacagccttccatggttcataaaagctatgccccatctcatacgtattcctcaaaccccgaagattcataaacgggggttctccctccttaatgaaacgtcaaaagatcctcaccaagctgggaccgaccgtaggaaaacaacacaacgtttgggggggcgcgtcccgcatggaagaccatagacaactttggcgaggaccggaacggacgccacgcacaagcagccaagagcccagcagaattgggggggcacccaaaaacccggggccggtttcaaaccaagggtgcctgcgacacgggacgaaacccgcggaaacagaaagacat

SEQ ID NO: 585127 - DNA, 362 bp, Homo sapiens
  misc_feature (89)..(89): n is a, c, g, or t
acaattcgggcaagctgccgggcattttccccaggattatctttgcatgctccttgaacacctagcatctgaaacaggcttgttgaggntagtaggttggtcccaccaccacaccgttcctaatctctatagagtggcatggtagcagcagtgatatataaatcttcatttgtggggaccactgtgcttcgcattaacagtaattacagttggaatctacctaacattctggtgctgcatccttgtccacgaggcaatgtagagtggcggtgacaatgtttgctgcatgggcgttgtagcctcctatgctcccagccatggcagagcccactaaattcttgtaaatgtgtagaaatggaaca

SEQ ID NO: 585128 - DNA, 516 bp, Homo sapiens
ggttcagaggattcccagaacttatatctagctcaggcattgtaatacaccaatcagcaccctgtgtatagctcaaggtttgtgagtgcaccaatcgacactctgtatctagctgctctggtggggccttggagaacctgtgtgtggaaactctgtatctaactaatctgatggggacgtggagaacctttctatctagctcagggattgtaaacgcaccaatcagcgccctgacaaaacaggccactcggctctaccaatcagcaggatgtgggtggggccagataagagaataaaagcaggctgcccgagccagcattggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggaggaacgaacaactccagacgcgctgccttaagagc

SEQ ID NO: 585129 - DNA, 528 bp, Homo sapiens
ggccgcacgtgtcgggcgctgtgatgaactgcgtggtatgggccagtcctgagggaagggccttctcgctgtcctcccattgaccatggagaaacgggctccctcaggcccttcaccgaggccactggtcctgtacagcggcttcaccctcacgatctaatcacttcccccaaagctccaccttttaattccatagctttgggggttactgtctcaatatatgaattgggaaaggacgtattcagacaacagcagatgttaagatatgtgtatcctgggacatgggtaaaaggtctcattgtcttgggatgaatgaatagtacatatcatggtctcataataaaccagccaacagtatgctatgggctgaactgtgtccttccaatatccactgtatttggcgacaggtcatgtcaccaggtgattacggtaaaatgtggtcactagaatgggccctattccaacaggactggagtcctaagaagaggagatggggacacagacacacacagaggtacgaccacgtgc

SEQ ID NO: 585130 - DNA, 1111 bp, Homo sapiens
tgagcggggtcgctctcatgcgatcccggtgtggctgtgccgattggtcctgtgcggtcacttagaccaagatgcctgaggaaagcccagacccaagatcaaccgatggtaggaggaggagagttgagacggttcgcctgttcaggcgagacagattgcccagtttggatgtcgattgtatcatcaagtacctttcctactcagaactacagagcaatcgtttcatgacgagagcgtgatttcaaaaactccactcagcatgcaatcggaccacaaatccggtattgtataagcttgagcatgaatcccgaagtgcacaatatacgagctcatggtgacacaggaagctgcactactttacccattatacgcgataccaacaccagaatcgatcccgaacctcatccaccttagtctggtgcgatacccttgggaacttcggaccatgacccaacgtggcttgacgatatagaatccaacttacacgcctttggctcaactaaatacgaccaaacagctcctcggcgaccccacacagggtgttctcaatgagcacatgacctctatgcacggcctcgagcttgccagaattattctccttatcggatcccgaggcccagctttccgagctgttctggggactccactaaatacccttggcgtcttactctcctggcgtctaggccttcggacagatcacactacgtactcacgcctcggctagacattccgactccccaccacacatttacaacgcgacatcgctactcggactgccgaggctacaccggcccatctgccgcgcaaacgttaccccgctctaacgcgccaacagagagagcagccaactcccccacttcccccaccccgcatcgccaagagggccacgcacggccaccgaaaccaaggcgggtctaggcaagcacccaccaaaattggcgcggcctaccaggagtaggacggacaaacacacacacacgacggacgttcaatcaccccccatcacacgaccccccctcgcacacaacagaacaacggaaacccccccacacaccctcggcacatactacaccatctgcgccacccgagcacacccgcatcaccgcgaacc

SEQ ID NO: 585131 - DNA, 391 bp, Homo sapiens
cagactgtgacaggttgagttagtggcacatattgctttactgacctctgcctcccgggttcaagcaattctcctgcctcagtctaccaggagtgtgaggactacgggcctgtgccatcacgcccggctaatttttgtattttctcatagagataaggtttcaccatgttggccaggctggtctttaactcctgaactcaagtgatccacctgcctcggccttccaaagtgctgggattacaggagtgagccaccgtgcccggccatgtctctctttttaacactaatgttaccctgacctttgtacgtcacgagcacttctgttctagaaccttctatctctacctaatgtctctactgctatgacgtggtacagccaaactggtcgaca

SEQ ID NO: 585132 - DNA, 149 bp, Homo sapiens
cttagcaggatctccccgactagcccgacagaaagatgaccgggtaggggtaaggtagacagtgcctttcttgtgtcctttgaaggcttctggcacgtactttcatgtcatttgaacgtgttatccccccctgtcgggctagtcggggg

SEQ ID NO: 585133 - DNA, 1210 bp, Homo sapiens
tatcagtgttcaagcacaggagaccaagcagaaaacatatgcatttgagtgtttgactagttgttgtggttcgtgcacttatagctagggtctctcttctctcctcggtgtgatatcacatctttgtgtgatacgattgacccgtgtttctatgtgtggtccgccctcgtcattgggggtgctcccccttttacgccctcgtagaggtgtttgtgtactactgcgttatttttgcgccgcacctgatttgttcgtattgatggtctcctcccgcttctctctcgccgtcgtttttgggccccgcctgtctgtgttgttccctcccgcaaacgttgtgtgctgagaaaccccccttgttaagagcctccgttggtgggcctcccagtagagcctgtatttgggcggccgccttcctcttcctcccatgagatatgggggggttgtcttccctccggggggtggacccgtgcggtggtgccccggccccgtggggtctgtccccccccccccccagatgtggtgggtgtcgggcttctcctcgtgtgtggtggttgtatcaggaaagaggtcgggggggtcaccacaaaggtgttggtgtgtggggaaccccccgctgtctgggagaatttagaggtggtggcaatatgtttctgcccgcgccggcgttgaggaggacgctgtggaacctgcggttctctagagagtggtgaggcccccccccaccggtggaaaactctctctcttgtgcggggggcaaaatgtgtgaccactctcgtggagaagacgttgttgaacacttgttgaaaaattgtgggccccctctgtgtgacgacgctcttcaatacacagttctcaaagggggtgataatgtatataggcgcgccttctggttccccccgccccccgcgggttttcccccagggtgtctctgaggaggttgcaccccccgaaatgtgtgttagaggtagatatctgtgtgtgtcgtaattcttttcacacaacacacgcacacacaagttcgctcgtgttttttggggccgcggagagagaagaaagtgttttataagtttgtgggaatttgaccttagggtgtatttctcagccccccgcgttctccccgttgtggtgaggttaagaaaagtttgtggggctccctattgaaatttaaagcggtggaacattttgcgaacacaacaatgagatcgcagaa

SEQ ID NO: 585134 - DNA, 94 bp, Homo sapiens
acgactccatgatatgatgcctaatacctcaattttgtcaagggtttggtggactcagtagtattcccttgatgttcccgcgagatctccagca

SEQ ID NO: 585135 - DNA, 210 bp, Homo sapiens
tttaccggcgccatgcggacgagttcaccccgaccatgacggccctggtcaagatgaaaacccgggggggcgagcaggaggtgcgggtattcagtcttcgtggcgccatttgcttggcatgtttgcgcgcacggaacgggccaaagctttccggcgaaaagtcctcgatgtgctggatgagcaagcgcgccagggacagtcgcttggcgt

SEQ ID NO: 585136 - DNA, 89 bp, Homo sapiens
ggcacgaggccgccaggcgtaggcggggtggcccttgcgtctcccgcttccttgaaaaacccggcggccgagcgaggctggaccacata

SEQ ID NO: 585137 - DNA, 852 bp, Homo sapiens
ggttacttcgtctatagctccatggcagactgctggcttctgggcggttatatgtcttttgatttcaagagttaggagctcgagaaccgtttggcaatcatgtacgtacgcggcatgcatgcatcatgcacatatgcatgcaggcatgcatgcatgcacacatcaccccgcgaccattagttggccaagcaagctatgctggacataggtacatcaagaattcctcatatatagactgagcaaaggcattggcttaagaccaatcacgcctggattctccatatattggaataggacgtatatattccctcgacttgctctcagtcacacaacagacacatagtaggaacgaacagcatcctccctataagaccctatcatgtgcatgaacagccctcacgccaatagcatacagttagggaagcacagatatcgaagaggcaaaatctgctccacggaattaacttacatggagatgaacacgcattcttgacacaccaatatagtctcaaatcactcatcccacacagcaacctataaccacccaaattatggacacaagaccggcagaaacttgcgtagcattccattaccacacccaaatatgtactgacctccagaactggaacactcactatacaccatctttcataagcgcaaattccatacaaaacattaactatcccatggccttcatccgccctttccataaggtttaggaataccttaaaccactaccaattctcaacgtccaacttctcaacccaagaaagtcgatcgcactgacaaccacatttacaccgacatacccgccattcactacaacacattatattaactaagcgaaaaact

SEQ ID NO: 585138 - DNA, 364 bp, Homo sapiens
gcccatccggctcctaatggctgtttccaattttggagtgtgtgtccccttgtcagggcccgtctggcgtcaagtacaaaagtaggagtaggctgggtgtggtggctcacccctgtaatcccagcgctttgggaggccgaggtgggagaatcacttgagcccaggagttcaagagcagcctgggcaatgtagcaaggtttttttaactacaaaaaacccaaaaattagctgggcacccctgtaatcctggctcctcaggaggctgaggtgggaaaattttttgagcctgggaggtccaggctgaagtgagccaaaattgccccgctgcactccagcctgggcaacagagcaagaccctgtttca

SEQ ID NO: 585139 - DNA, 104 bp, Homo sapiens
gctcccgattacatcgcgccgtggcctgctcgtcgcgcaggtcggccgggtattgcccagaatctccaggatgctgatgcacaggcgcaggtgccgctggatcg

SEQ ID NO: 585140 - DNA, 250 bp, Homo sapiens
ttagcactgaactctgctttgggtcagcatctcgtgctcagcctctcgagtactgggattagctcctgaataactgggattacaggtgcacaccaccacatccggctaatttttgtatttttagtaaagatgaggtttagtaaagatgttggccaggctggtcacaaactcctgacctcaagtgatctgcctgtcttggcctcccaaagtgctgggattacaggtgtgggcctcccaaagttctgggatt

SEQ ID NO: 585141 - DNA, 229 bp, Homo sapiens
ggagtagggggtgtgggtgtgtaacagagaccgagagcatgagtggggtgtgctcgtgtgcgttggatcgtgtgtgtgtgtgtatcttgtatatgtgtgcgcagagtgcatcattttcagactctactatttccgtcaagtttctgtttgatttggatcatctcaggatcggattctgttttagagtgtttctgggccaggaaccgggcccctgccctcctctgcacct

SEQ ID NO: 585142 - DNA, 186 bp, Homo sapiens
agctcggtacttgactctcacgttcagtgatctcccacctcagtcctatgcctggactgcaggcatgcaccaccaggcctggcaatttttgtatttttttgtagagacagggtttcgccatgtctcctaggctggtcttgaactcctgagttgaagcgatccacccacgctggcctacagcacatg

SEQ ID NO: 585143 - DNA, 225 bp, Homo sapiens
ctccctttttttttctttagtaagacgagggagtcaccggtgttagccaggagggtctcgatctccggacctcgtgacccacccacctgggcctcccaaagggcggggattacaggcgtgagccaccgggcgggccaggagggtctacagtttacaaagcctttccataatagatatcactccatgggagccggtgcagaaggaaagagttctgaaccgacggga

SEQ ID NO: 585144 - DNA, 607 bp, Homo sapiens
  misc_feature (3)..(3): n is a, c, g, or t
  misc_feature (25)..(25): n is a, c, g, or t
  misc_feature (32)..(32): n is a, c, g, or t
  misc_feature (64)..(64): n is a, c, g, or t
  misc_feature (109)..(109): n is a, c, g, or t
  misc_feature (160)..(160): n is a, c, g, or t
  misc_feature (181)..(181): n is a, c, g, or t
  misc_feature (196)..(196): n is a, c, g, or t
  misc_feature (263)..(263): n is a, c, g, or t
  misc_feature (313)..(313): n is a, c, g, or t
  misc_feature (555)..(555): n is a, c, g, or t
  misc_feature (582)..(582): n is a, c, g, or t
  misc_feature (591)..(591): n is a, c, g, or t
  misc_feature (604)..(604): n is a, c, g, or t
ccntgaaaatcttcttcttgacgantacagancatgagcacgcgcaacttcacaggggaaaatntggggaaacagcatgcagcccgcgaaacctttccccatgaatgcngcagagcccccttgagcgagtcgcaagtctctcttggtgaaagtggaactntgccaaacttgggaatttccnggaacagggggcccnagggtggtcagcaacctgctgagggaatcagcttgcatgaatcaagcttctgcgggccaactggtcnggtctccaggttctcgccttggttcacgtaggcttggcagggcagggtcngctttcagctttgcagtggagtcagagtagggtctgcgcttctcctgccactcgaggacgccgctccaagccagcagcttgttgctgagccggtgctcgctcacggcccagacccccgagggtgagcccaggtgaggagggaccgatgggacccagtgccccgaagacccgagcaccttccatgggagggccgagcgggcccggatccgcggaggctgcgggcctcgggggctggcaggccnaggagcgcgagcggacggcgcgcaccnacagatgtnggcggagggcggncgc

SEQ ID NO: 585145 - DNA, 899 bp, Homo sapiens
gacagttggcacaagggcaaggtgaccacatgttaattgagtggctgatggcagccatacggactgtttggaatgatgctgcagagataatagaaattgtgagtaaatggcaatcatatactgatttggtgcaggtactccaggagatgggtatgtggcaggctatgtttgatctgaatacccaggggctgaatgatgaacattttacctcccacatgagggatcttgtgctgggctcagcgcccctgagtgcttttggctctctagctgctgttccactccgtatgtggggtgccacatacatgaagtgactactgctatggcagccctcagggaagcagaaggcctttggcaggactggggaacccatgcgataaagaaggggaaggtgtcccctctgcaggtaaccaccccaggagatcaacaggggccccagcgggtgacccatgtgcagcatgtggattgatttaattgcagctggggttgcttgggagaaaactgacaggcaacccaatgggatgccgttggctctgtggaggcaactgtccgcagagcagcaattccagaacatgtccgaaagggggcaaaatactcttgatcaacccagccccagccagatgctgtactcaaggactgtttgctcgacggccaaagagaccagaccttcctttgaccgggaactggccaaggtgcccagcagaggccacgtgtggaactggcaatccattggcctcccaccaatgtacagtgggtcctagcactggtagatactgggtgccagactgccggcttcgttctatggaagtcccggggtaagtttccgcgccccagcttgcttcattgcatggttcttggcggccagttggtgacgttaacaccggtgtctctgcatcttcgca

SEQ ID NO: 585146 - DNA, 1243 bp, Homo sapiens
  misc_feature (409)..(409): n is a, c, g, or t
  misc_feature (646)..(646): n is a, c, g, or t
  misc_feature (663)..(663): n is a, c, g, or t
  misc_feature (704)..(704): n is a, c, g, or t
  misc_feature (719)..(719): n is a, c, g, or t
  misc_feature (1064)..(1064): n is a, c, g, or t
gaagatgccgatcgggaaggagagggcgagggaaagacacggtggctccggacccagttgtcgtgaagatgcaggaggctagatgaaagatggtgaatcggccgctgttctggagcaaacaggccgtacacggaagtttatggcgactgtgtagcaggtaaacaattccgagcccacgagagacagcagtaccgtgcaactgcgtcctatgtgtgggagaactggtgcccgactgatgatccagggtatgtcaggcgtggcgagcagtacgaccgaatccattctagttacacgcctggccgtagaacaatgctggcactctcatgtcggacttaagcccaggtttcaccgcgcgaagggactccctggaatcccgtgcatagacgacgtcttcacccgtcagtcgtgncattttagatggcatgggcggccatcacagggatacaagtatcctaggcagggagcagatacggcacacgcatgagaagagagcaatgaaggaacgtggtgttgcgtcacccgtgtggctcggcaaggagaaggacatggacctgcatggagctagagcggggatcgtaccctaagcgtagagaaagaaccacgcctgtctcgtgtcgatgtcgagcgcagttttaatcgacctcgntcttaccctacctcatntgagctgtgcacgtagaccgagaggacaccatgcattcgantacctgtgctgaggnttgcacttggccaaccaagctggacctgctgagaactgcacgaatttcctgaagaccgtggcggtttcgttacttttccttgtgtcccattgcaacacatagtcgattccggtggacagaaactcggtggtggggggtaccccccttgttagcattgtctactgtgaattctaagagggggcggcagagaagtgtccgaacggaaacttgggttggaaccggtacttttagactccccacacccacggggacatgtacccctttgcaacgcggaccgtttgatcgtgcgcggttttcaacggaaccgcgggggtggtaaaccttcggggccaccacaacgaaaanaagggccgtccgtttttggggaactttacacgacttgggttgtgaaaagccttaattctaagggaacccgaatttttacatgagtgccatcgaggattgagttgaatgtaaggcaattgccgtccagattcaatagttgcggtgcgttggcccagagggctccctttggtggctcccta

SEQ ID NO: 585147 - DNA, 319 bp, Homo sapiens
gagctcgaaccggcacgagcgcccaagtggctgggatcacaggtgtgacaccacgcccacctgtgtatgtatttttagtagagatggggtttgccatgtaggccgggctggtctcaaactgctgacctcatgtgatccgtcaacctcaacctcccaaagtgctgggattacaggcttgagccaccacatccagcctagcctttaaatttaaataccctaaagtttttatagtaattgaaaaagactatgcctctctattattataccttaaggaaccagggcaaagagaaatgaaagattaattcttctactctactac

SEQ ID NO: 585148 - DNA, 457 bp, Homo sapiens
tatactaacataagttctactatagggatgatagataggatccacttgagatgtgcggagttcagttatatgtatgggattatttaggtagtgggatgttgagctagaacgcttaacttaattggaaggctgcttttaggcctactatgggtgttaaattttttactctcactacaaggtttaatcctagatgtccaaagagctgttcctctttggactaacagttaaataaacaaggggacttagagggttctgtgggcaaatttaaagttgaactaagattctatcttggactaaccagctatcaccaggctcggtaggttagacgcctctacctataaatcttcccactatttagctacatagacgggtgtgctctttaagctgttctaaggtagctcgtctggttacgggggtcttagctttggctctccttagcaagttatttctagttaat

SEQ ID NO: 585149 - DNA, 407 bp, Homo sapiens
gggggcctcatatagacacgccaggatatggagggtcttctactattaggacttttcgcttcgaagcgaaggcttctcaaatcatgaaaattcttaatattactgctgttagagacctgcagtgagcctacagatgataggatgttccatgtggtgtatgcatcggggtcagtccgaatactgtcggggccatccggatcaggccgagcaaagtttgtgggcagcaacagttcagcattcacgcctgatgaatcatgcatagtgcaaatggcatttgggcagtcaggttgggtctagggtgtcagccggcagcataggggaactcagtgcaatgaagcctcctatgatggcaaataagctcctcatggggtctgaacaccagtgcagggtaccgcagctcgaatgcg

SEQ ID NO: 585150 - DNA, 592 bp, Homo sapiens
gcaactgcacagacgagtttttattctgctgtctaactcttgtaaagcacatggtaagatctttgccgattatcgggtcgaacgaaaatgccaaaagtctaatgaagccggaatgcacccctatatggctgggagttgattgtgccaacactggatgaattagaccaaaagatgacagaagctgaaacagaaccgcatgagggaaagaggaaagtggaactttttgtggtccatcttcaggagccaccaccaaaaaactcgttacatcttcgaccttttttacaagtggaaagccatcagcagagaactctatgaatatttgattaaagaaggctatgcatacaaaaacctgtttcgcaacatggaaccaacttcaggacgaacttggattgccgggtgcccaaaccaagctggaagtggtccgaatcatcgagtgcacacactgcggctgtcgaggatgctcatggctgaggctggcgcgctccaccctgggcctctggacttccgaaggttcctggctgttacgccaccccccttcttggaagcaactgggcaatgcccccaagcccccgattgggagcaccggctctcc

SEQ ID NO: 585151 - DNA, 558 bp, Homo sapiens
gtttcttgtaacagtcatagtcatctgacaaagtaatggcacacttgtctcgagtccacttataagtctttatatctatcctatggttttggctaatttacacagactagaatctagttcagggatgaatggtatcattcccactaaaagtctcaaaatctgatattatctgatagagacacggatctggtgctactcatgcctggctggtagtgtcctggcacaatcaccgctcacttcagtgttgaactccggggctcaagctgatcctcccaactcagccgtcgcagagcagctgagtccacaggtatgtgcgaccatgtccgcactaatttcgttttcttggtagagatggggtcttgccatgtagcccaggcgggtctcacactgctggcttcaggtgatcctcccatctcagcatcccagagcactgggattacaggcatagccactgctcccagccctataaaagtagttttaaagtggggaacaaaagagacatcgtacaggaggacccaggtgctgatggctcatttcaagtctactccttcatatgtt

SEQ ID NO: 585152 - DNA, 153 bp, Homo sapiens
cacatatctgctgacttctgaataatatctaacagcaggttcttctattttggcctctgaatattctaatgtgcccatacaaaagtagcactaaaatctttaatcaaacagaagagaagcctgtaacagcgaagaacacacatcttgaatctg

SEQ ID NO: 585153 - DNA, 709 bp, Homo sapiens
tgggtctgggaggatgggggaccccaaaatccctttgggcagcagaggtgaaacgaagtcttcacaaaagtagtgttctaagcaacagccaactcagttttaatcactctccagaaaccccgtggcttattgttgggatttgtgcaacccctccccaatctcaatgtttccccgaaaaactcaggtgaaaaagggttttgtgagttctcacacgtgagtgggtggctcgggtgaactcaggctcataggaaaattgcgacctctctctcaattaacgcaggccctatattctccataacctgtgatctctgtggtcccccagagaaagagaggtctcatatccctgtggaggccacggcaagaaaaaatatgtgtgacaagagacacctgtgctccagaaatgtgtgaggggcttcatcacccctgtgtgtgtgaaaatgttgtggaaagagagcgccggagggggggtctcacgaggctattagcgccccgtgagacgaagtgtgggtgtagatatatccccccgcgtggggcctgagtgtgtgtagcagccgcctttttacaaagcagtgtgcgcggagaagaaagtgtgggttttataaaagaccccatattatatttcctcccttatttttgtggatgtgagagcccaaattgtggggaggagggtatcacccgtgtgcatgtgacagcgagagagcgcggggct

SEQ ID NO: 585154 - DNA, 414 bp, Homo sapiens
aggaagaaggagcaagaggaaagacaacaagagcagaagaggaacacgcgaggacacacgcagaacaaacgcaaagagaaggaacacagagagaaaaaaagaacaagccagaaaaaaagaagacgaggagggacaggcgagggcgagcgcatggaacaaggcggggagcaagcagagcaacgggcgcgcgacgcgaagacgaggcaggaggagaaagcaagcaccgacagacagggagagaaaccgaggatgcaagaaaagaagcacgagaaagaacagcggagaaagagagaaaggaagacgaagagagaggaatgagaagagagaagcaccagccagaaggaaagaaagagagagagaggagcagcaggagagcagaaaagcggagagagagaacacgcagcagagaagaac

SEQ ID NO: 585155 - DNA, 406 bp, Homo sapiens
  misc_feature (60)..(60): n is a, c, g, or t
aagaatttccaacccctcaaacatcacccccgggctggcccagttccctcagctggaaanccccccgtttggagaagagatgccctgttgtttcaaaaaacccaacattaaggagtaccaaagatagtttcctcctaatgagaagtttgattttccgcaacccaccccaaatatcactttctttgtttatgtcagtaatttcaccctggcccatcaaaattcaggtgcaaactgaacaatgaggacgcatggacacaggaaggggaacatcacacaccagggcctgttgtggggtggggggaaggggaagggatagcattaggggatatacctaatgttaaatgacgagttaatgggtgcagcacaccaacatggcatatgtatacatatgtaacaaacctgcatg

SEQ ID NO: 585156 - DNA, 749 bp, Homo sapiens
ctaattatgtatttttaatagagacgaggttttgctatgttgtccaggttggtctcgaactcctggcctcaattgatccgcctgccttggtctttcaaagtgctaggattataggcacgagccactgcacctggcctcaaaaatcatttttaaaagaagcagtatattagctctgggtcttctcatgactaaaatgactatttttaaacataagaccatattttataaatgtacagataattcaaatctattatctaatgtattaggttaatttctatttgttctatacttttttttttttttttttttggaaatggagtttggcttggtcgcccaggctgggagtgcaggggtcgcaatctgggctcactggaaagtttccgcctccggggttcatgccattcctcctggctctcggccttccaagtaagtcggggactacagtggtgcccgccccgacacctgggctatattttctaaacaaatattattttagtagagacagggttccaccgtggtagccaggtgggtctcgattctccgtgacctcgatgatccgcccgtattgggcctcccaaagtgctgggatacacagggcgtgagcccaccgaacccgggcctatggacattctttcaacggttcccagattccctcggggtgtctagcaactcgcctttaacttgtcaaacgactacttggctaattggacttgaaccatggctttgcgggcctaccatttgtctgtgtc

SEQ ID NO: 585157 - DNA, 687 bp, Homo sapiens
tgcggaggggccgatggaaagggaaaggtggcctgtcctcccctcccgacaccaggtctagctgcgtgggtgtgcagaggcaaagcggtgtgtgatggaatggctgggagtgtgaggggcatgtgagactgaagccaacctcgtacttgaatgatgcatgcttgtcagttgcatgtggtgatgtgatgccccatgcccctgctgactgatggagtgaatgctgtgagctggatgctgctgagtgcatgtttgacctgtgcctggcagtactgtggccctgcacctggtgatcacacggctgcaagctgctggtgtcggtgccaatgcatgatgggcttgtgatgcctcccccagaggtgttggcatggtgctgaatgacccaccccggagacccccgcttccagtgcatgtctctggcatctctatacccctatgaggcaccacgtaatgacctcctgcccttagctctcttgctcaccacccaagaacctcaggacagaagcgatgagcccattgctcctgctcagctcaggcccggcttgcggaggaacccttggcaggcatgaacctggctggtgtccagaggctcaactcctccatctaaccagcaggctcccagaggtccccgggaatgagcctgcgcaaggcttaagccagagtgcttctagatggagagtggtcactgtg

SEQ ID NO: 585158 - DNA, 152 bp, Homo sapiens
tagcaatcgtcctgcctgcggtctcgtagtagctgggacttacgggcatgtggcacgcgggcgggctaacttctggtagtttgtagtagagacagggtttcaccatgttggccaggctagtctcgaactcctgacctcaggtgatccgcccg

SEQ ID NO: 585159 - DNA, 548 bp, Homo sapiens
cagatgtgttgcgcgtggattcgattgctgaagaagaggtgaatcatgggtgccatatctatcgatgaaattctagattagtgctatccttagtaactatgcagtttatggattgagggatctgaactataaaaccaggcggcagcctcctgcatcctgtggtttatactaccgctatcattctcctcttatgtctcttagccgtcatttgtcagttacatataccatcacagttttgattagaatcagccttcaaagagctggcacatgcttggtgaacttgtgctttcatattttcctaacctgtgtggtcctttgtggcgacggaataaacccagactaacggaattgccaagcatctggcccaaggcaagatggggaataaattcttcactaatttccaccctctgccacaagtactatgggtagagaagtgcacagctcgaacacttctacaggcaagtcactaaaaaagctaaaagatgccaggatcctgattgaaccaacactcaacaagaccaatgctcagatttacctgattgtggtgg

SEQ ID NO: 585160 - DNA, 752 bp, Homo sapiens
attcgtcctttacatcagccttcctcgttagatgcaagtcctttatatcaaagatctattgacctgtaccattcaagagatgaaagagcagctgaagcatgatcaggacgtcaagggaaagggctattctcctgtagtgggacaaatttattgtgcaaacctctggagacaatttagggttcgttgactcgcgtaatacacttcagattttcttggagagactaaagaatgaaattaccaggtgaactacagtaaaggcatcgacactggatagcttgggtcacctttgaagatagatttagaggcctgttctgggagacaggggttcctaatccttgcttcatttcttagaaaaaaccagagagctttgagactgggtactctgttctggcccttgatattctaataaaaaactatagtgacagcttgacagctgccatgcattgatgcagttctagatgagctcccacctcttatcagcgaccagtgatatgcatgtttcacaaaatggccatcagtttacttacgcacttgggcaaacagtatatccctcctccctttcaacagatcagtggatccgattctcaatgaacttatggacttgtgacgatcacccttatgcacggggggagctcttagtgcagtggttagacttgttccaagctctggttgtcaactggaacacataattgaggatacatggattcgagcgcattgccgactggtgccggttaactcttccgagcaacagt

SEQ ID NO: 585161 - DNA, 933 bp, Homo sapiens
  misc_feature (29)..(29): n is a, c, g, or t
  misc_feature (223)..(223): n is a, c, g, or t
  misc_feature (226)..(226): n is a, c, g, or t
  misc_feature (230)..(230): n is a, c, g, or t
  misc_feature (255)..(255): n is a, c, g, or t
  misc_feature (259)..(259): n is a, c, g, or t
  misc_feature (267)..(267): n is a, c, g, or t
  misc_feature (278)..(278): n is a, c, g, or t
  misc_feature (281)..(281): n is a, c, g, or t
  misc_feature (300)..(301): n is a, c, g, or t
  misc_feature (313)..(313): n is a, c, g, or t
  misc_feature (327)..(327): n is a, c, g, or t
  misc_feature (330)..(330): n is a, c, g, or t
  misc_feature (346)..(346): n is a, c, g, or t
  misc_feature (348)..(348): n is a, c, g, or t
  misc_feature (354)..(354): n is a, c, g, or t
  misc_feature (368)..(368): n is a, c, g, or t
  misc_feature (372)..(373): n is a, c, g, or t
  misc_feature (376)..(376): n is a, c, g, or t
  misc_feature (384)..(384): n is a, c, g, or t
  misc_feature (395)..(397): n is a, c, g, or t
  misc_feature (402)..(402): n is a, c, g, or t
  misc_feature (407)..(407): n is a, c, g, or t
  misc_feature (424)..(424): n is a, c, g, or t
  misc_feature (428)..(429): n is a, c, g, or t
  misc_feature (436)..(436): n is a, c, g, or t
  misc_feature (438)..(438): n is a, c, g, or t
  misc_feature (441)..(441): n is a, c, g, or t
  misc_feature (447)..(447): n is a, c, g, or t
  misc_feature (451)..(451): n is a, c, g, or t
  misc_feature (460)..(460): n is a, c, g, or t
  misc_feature (470)..(471): n is a, c, g, or t
  misc_feature (474)..(474): n is a, c, g, or t
  misc_feature (482)..(482): n is a, c, g, or t
  misc_feature (491)..(492): n is a, c, g, or t
  misc_feature (508)..(508): n is a, c, g, or t
  misc_feature (577)..(577): n is a, c, g, or t
  misc_feature (586)..(586): n is a, c, g, or t
  misc_feature (601)..(601): n is a, c, g, or t
  misc_feature (932)..(932): n is a, c, g, or t
gataatgaagctgtattgattgcaggagngggtgagggtgaagcagggtccagctgtgaagtgcttgggcaggagaggggatcttccagtgggatctgtgtccacacggggggcctcctaggcctgagcggggctgggcagcctcagttcttggtgcgaaggacctgctcgtgggtggacaccaccttgccatcgtgcacatccatgaccttggtgcggattnggnggcnggaggaggtcacatctctggatgantgcnatccagangagaactgggnggnggagaggtgggcgtcctcnncctccagcaggnggcggtaggtggcnatntcttgctccagccgcntnttcacntccagcaggatttngtannccnggttctgntgctccatctnnnagcgnactgngccagctgctcctccangctnncaatcangnccnggatcngggncagctgcangcagtagcgnnctntgtctccnccaggtttnnctccagggatgctttnatgctgagctgggactgcagctcaatctccaggttctgcatggtgcgccggagctccgagatctcgctnttgccgctnttcaccagctcgctnttggtggccacctcgcggttcatctcctctgtcttggtgaagaaccattcctcggcatccttgcggttcttctctgccatcttctcatactggtcacgcatctcgttcagaatgcggctcaggtccacgccaggtgcagcgtccatctccacattgacatctccacccacctggcctctcagggcattcatctcctcctcgtggttcttcttcaggtaggccagctcctccttcaggctctcaatctgcatctccaggtcagctctggccagggtcagttcgtccagcaccctgcgcaggccattgatgtcggcttccacactcatgcgcng

SEQ ID NO: 585162 - DNA, 976 bp, Homo sapiens
  misc_feature (266)..(266): n is a, c, g, or t
  misc_feature (269)..(269): n is a, c, g, or t
  misc_feature (273)..(273): n is a, c, g, or t
  misc_feature (298)..(298): n is a, c, g, or t
  misc_feature (302)..(302): n is a, c, g, or t
  misc_feature (310)..(310): n is a, c, g, or t
  misc_feature (321)..(321): n is a, c, g, or t
  misc_feature (324)..(324): n is a, c, g, or t
  misc_feature (343)..(344): n is a, c, g, or t
  misc_feature (356)..(356): n is a, c, g, or t
  misc_feature (370)..(370): n is a, c, g, or t
  misc_feature (373)..(373): n is a, c, g, or t
  misc_feature (389)..(389): n is a, c, g, or t
  misc_feature (391)..(391): n is a, c, g, or t
  misc_feature (397)..(397): n is a, c, g, or t
  misc_feature (411)..(411): n is a, c, g, or t
  misc_feature (415)..(416): n is a, c, g, or t
  misc_feature (419)..(419): n is a, c, g, or t
  misc_feature (427)..(427): n is a, c, g, or t
  misc_feature (438)..(440): n is a, c, g, or t
  misc_feature (445)..(445): n is a, c, g, or t
  misc_feature (450)..(450): n is a, c, g, or t
  misc_feature (467)..(467): n is a, c, g, or t
  misc_feature (471)..(472): n is a, c, g, or t
  misc_feature (479)..(479): n is a, c, g, or t
  misc_feature (481)..(481): n is a, c, g, or t
  misc_feature (484)..(484): n is a, c, g, or t
  misc_feature (490)..(490): n is a, c, g, or t
  misc_feature (494)..(494): n is a, c, g, or t
  misc_feature (503)..(503): n is a, c, g, or t
  misc_feature (513)..(514): n is a, c, g, or t
  misc_feature (517)..(517): n is a, c, g, or t
  misc_feature (525)..(525): n is a, c, g, or t
  misc_feature (534)..(535): n is a, c, g, or t
  misc_feature (551)..(551): n is a, c, g, or t
  misc_feature (620)..(620): n is a, c, g, or t
  misc_feature (629)..(629): n is a, c, g, or t
  misc_feature (644)..(644): n is a, c, g, or t
  misc_feature (975)..(975): n is a, c, g, or t
acaggacctcccttgtacgtggtgttattattgaaatgtatgtttgagctcaaaaggcccgaccaccccccttcgggcgggtgaagcagggtccagctgtgaagtgcttgggcaggagaggggatcttccagtgggatctgtgtccacacggggggcctcctaggcctgagcggggctgggcagcctcagttcttggtgcgaaggacctgctcgtgggtggacaccaccttgccatcgtgcacatccatgaccttggtgcggattnggnggcnggaggaggtcacatctctggatgantgcnatccagangagaactgggnggnggagaggtgggcgtcctcnncctccagcaggnggcggtaggtggcnatntcttgctccagccgcntnttcacntccagcaggatttngtannccnggttctgntgctccatctnnnagcgnactgngccagctgctcctccangctnncaatcangnccnggatcngggncagctgcangcagtagcgnnctntgtctccnccaggtttnnctccagggatgctttnatgctgagctgggactgcagctcaatctccaggttctgcatggtgcgccggagctccgagatctcgctnttgccgctnttcaccagctcgctnttggtggccacctcgcggttcatctcctctgtcttggtgaagaaccattcctcggcatccttgcggttcttctctgccatcttctcatactggtcacgcatctcgttcagaatgcggctcaggtccacgccaggtgcagcgtccatctccacattgacatctccacccacctggcctctcagggcattcatctcctcctcgtggttcttcttcaggtaggccagctcctccttcaggctctcaatctgcatctccaggtcagctctggccagggtcagttcgtccagcaccctgcgcaggccattgatgtcggcttccacactcatgcgcng

SEQ ID NO: 585163 - DNA, 344 bp, Homo sapiens
gttcacaatgttgattctgatgacctcattaccatgggatccaaggacagtaagctacagttaagttactaaagaaaactgacattccatctgtctttattgttgaatcttcagttaatactctgaaagctgaattcgcatatgaacaagggggccaccttatcttagtcctagaattcagtctaccttgggcatactaccttattccattccttatcatagtgggcatctgtctcatcttgatagtcattttcatgatctcatagtttgcccaggataaacatagagctctaagaaacagacttcgtaaagatcaacttaaaaaacttcctgtacataaattc

SEQ ID NO: 585164 - DNA, 648 bp, Homo sapiens
gcgctaggccccccgtcccggtcatggccatgctcaggatccagcccgaggcccaagccaaggtggtatgtgtttcgtgaagacctctgtaccaagacagagaacctgctcggtgagctatttccccaacgaagatttctgagctggatgcatttgtataagaggagccatgcttctcaatgaagccaagcttgagcaattgtgaatggccccgattggtacatctcgcagtgcctgtgatcctacgtcaatggacgaaatgaggaaacgcaggacgcggagagaagagcatgcatggatgaacggaatgacaaaggcatgaaacacgaacgacaggggcgaggactgaacgagcagaagggtccgtcccgtgttggtcccacgttgaacctgtcaactgacaacacgagtcgctggatccgttactgcagtcgccttgaacgcgctgaggatcaacggactgtcacttgacgcagtctcaagcctggatcaccaaccttggcttggcagcatgctagcatcaccgtcggaacttagacggcatcggctaaccaagtatattgcgcagatggcatagtcccaggcagcaaccggtgtcatagcagcttgcatgaacctagctctcccaacaccgaagcctacgcacag

SEQ ID NO: 585165 - DNA, 485 bp, Homo sapiens
  misc_feature (12)..(12): n is a, c, g, or t
  misc_feature (25)..(25): n is a, c, g, or t
ctgttagaggcncaggctgtatgcntgcggtccttcctccggccagagtggaggcccaaggctgctagcacaggtggaaggctggggcccgggggcgggtgctctgccgggggctcctccgtgcttctctcctaagttctctgagtgcagggagcggacagagatggcggagtcggagcggcggggagtgctgatggggggcatgctgtcctcctcgtcccgccgcgagtaggcaagggtattgaagtagaaaggtgtcatgcagtactgcttgtaggtactggtcctgtcagcttttgtgatggtggtgccgtctgaaaaggcgggtcagaaggtcgtttccattatggtccctgtggtaacgtctggggtggtaaaaaggatgggccccccgtagaattggttgtaacgggcaatattgcttgagatcatgttctagagtaggcatgtacggtccttgggaagcacctcccgcccgcggccgc

SEQ ID NO: 585166 - DNA, 938 bp, Homo sapiens
  misc_feature (751)..(751): n is a, c, g, or t
gccagagcctcctctctcctgtgcaagatggcaactcttaacggaaaagttcattgcaccagttgcggaagaagaggcaacagttccatacaataagatcactgtattgcgtgtgtttggacaagttggtatggcgtgtgctatccagcatgctgggaaagtctctggctgatgaacttgctcttgtggatgttttgcaagataagcttgaggacgaaatgatggatctgcagcgtgggagcttatttcttcagacagctaacaattgtggccacgatagaagattattctgtgaccgccaattcataagattgtagtggtaactgcaaggagtccgtcagctcgaaggggagagtcggctcaatctggtgcagagcaaagtgttgatgtcttcaaattcattattcctcagatcgtcaagtacagctcctgacttgcatcggtaatcgtggtttccaacccaagtggtacattcttacgtactgttacctgcgaaactaagtggattacccaaacaccgcagtgattggaagtggatgtaatctggattctgtagatttcgctaccttatagggtgaaaaacgtgggatacatcccagcagatggcatggatggatctgggggaacatggcgactcaagtgtggctgtgtggagtggtcgtgaatgtgggggtgtactctccacgaattgaatccagaaagtgggaaccgacaatcgatagtgaaacatcggaaggagtgctagatggtnttgaaagtgccataagtcatcgagtcaagtgttacacgggctatggtaagtgtgtgtctatgaatccggcggatccatcggaataccggtaccctggagggtttggtgaaaaactcacccaggtcaagccgggaacgttccaaaagatagttccaaaagacccggaccaggcactggccggaaaccc

SEQ ID NO: 585167 - DNA, 135 bp, Homo sapiens
tcagaaacagtgtaccaccgcaaacgattatccgcggcttcggctgcggtagatgtgacttcggtcacacggcgccccgagcgcggtctgcgcattcacccaagacgagcggcattatgctgaataataaagata

SEQ ID NO: 585168 - DNA, 177 bp, Homo sapiens
  misc_feature (159)..(159): n is a, c, g, or t
tgggcattgccgatccgcaatggggcgagcggcccttcgccttgttggtggtgcgtgaagggcatgtgatcgatgcgcgagagctcaaggaacacctcaagccttttgtcgagctgggccatttgagacaagtgggcgatcccgaagccagtatcgccngttgttactgtaaattcc

SEQ ID NO: 585169 - DNA, 347 bp, Homo sapiens
ttaaagtcagaatcatagacgatcccccgtatgggtccctgcttgctgctctatctgcttgtacatctcgagctgcatgactatacttgtaccttcgagagagccctactttaccctatctgtaggtagctcctgtttggttcaggctctaggcggtattgatagtcttttctagtggagtctagatagtctttattccaacaacagttatgcccagacggcagagaggtaggcgtacctagattatctacctataggtagcctataccttacgcaggtatcaggggattgtacacggaactagtagtgtagccaccgatagaggttagcatacctatatgagaatt

SEQ ID NO: 585170 - DNA, 872 bp, Homo sapiens
tgacagataaagctaggtgctgagatctggtttgccctctttatgatgtcccatcggtactagaaagtgaagtcatgctccaatttggaagaggagagaataactggctgaggggtgagaaagacagaaatagctcgcagctcttttttttttttttttccaacaaagggctctcaactctggttcccccaggctgggatgtggcagtggactatggtatccacggtattcactggcagtctttcagttttaaaaacagtttttaattaactattttctcttggtgggaagctggttatttctaaccttaagtaacttcattttctggctggggtctggaaagataccttctagtagtgggcaacttggtgtcaagtagagtcatggggtctcttggtaaccttaccccttatattaagggaccagcggggtgcgggcttacaataaacacacttagggtggccacttcagctgaagacaggggacaaactaagatagttctgaagggtaaaaaaccaaacaaaaaagcaaaaaacaaaaacaaattttagataccaagttatgctgaatggttgccttagaatgtgtgttttccgtggttcaggaagaggtaggtgtgggacccctatttaaattactaggggttcggagggagggtctggaatcgaaagtttttttggtcttgacctggtctggatgtggtctaaaatcctaaggtcaaggggggtgatctaaggggggggggggggcctcgggtggttgggaacatggtgtatgtgggggttttcccattggaagggggtgtgtacacagggggtctttaggcaaacaagtgtggtagatagataggtgaagagggccgcttgtagaac

SEQ ID NO: 585171 - DNA, 377 bp, Homo sapiens
taataaaattgatttgtgtacccccaatctcaagagcttcataagaatggctccaaattttaaaaaaaaaaagggtaaatggtatatgaaataaaatataaccagctcaaggaaagtgtgcttcataaaataccggaagcttcaacttcttaagtccgagtttcctgccagatagtaaccatccattcacaaggtatttttcttaaagggtgtaaactctggtttgaaaattcttcagtcacagacgcagcctacacatgccatttagaacctgcacacactctatatgcgcgtgaaagattacacttagcgcacagacacaacgagtttctgagctcctcagtagtctcgtgtcttttataagtctcgctcgtgcc

SEQ ID NO: 585172 - DNA, 950 bp, Homo sapiens
  misc_feature (2)..(2): n is a, c, g, or t
  misc_feature (66)..(66): n is a, c, g, or t
  misc_feature (135)..(135): n is a, c, g, or t
  misc_feature (137)..(137): n is a, c, g, or t
  misc_feature (146)..(146): n is a, c, g, or t
  misc_feature (149)..(149): n is a, c, g, or t
  misc_feature (159)..(159): n is a, c, g, or t
  misc_feature (182)..(183): n is a, c, g, or t
  misc_feature (189)..(189): n is a, c, g, or t
  misc_feature (208)..(209): n is a, c, g, or t
  misc_feature (212)..(212): n is a, c, g, or t
  misc_feature (263)..(263): n is a, c, g, or t
  misc_feature (297)..(298): n is a, c, g, or t
  misc_feature (300)..(300): n is a, c, g, or t
  misc_feature (319)..(319): n is a, c, g, or t
  misc_feature (347)..(347): n is a, c, g, or t
  misc_feature (349)..(349): n is a, c, g, or t
  misc_feature (351)..(352): n is a, c, g, or t
  misc_feature (356)..(356): n is a, c, g, or t
  misc_feature (364)..(364): n is a, c, g, or t
  misc_feature (366)..(366): n is a, c, g, or t
  misc_feature (368)..(368): n is a, c, g, or t
  misc_feature (371)..(371): n is a, c, g, or t
  misc_feature (374)..(374): n is a, c, g, or t
  misc_feature (383)..(383): n is a, c, g, or t
  misc_feature (403)..(403): n is a, c, g, or t
  misc_feature (414)..(414): n is a, c, g, or t
  misc_feature (419)..(419): n is a, c, g, or t
  misc_feature (868)..(868): n is a, c, g, or t
  misc_feature (941)..(941): n is a, c, g, or t
anaaatcctgtatgtagaaaactataaggaattcacaaagaaactactacaactagtgaataaaanaaggacgaaggatacaagaacaatggacaaatcgattgtatttctacaggttagcgttaacaacctgananccaaaattnganaacacttccnccattcaagacagcatggcaaannaataanatacttggcaataaatttnncanaaaaaattcaagactcgtacaccgaacaactacaaaacactgctgagaganattaaatttagagacctctgtgtcatggattggnnanctcaacgttgttgacagtnagtctccccaaattgatctataggttcnangnnattnctaccatntntnctnctnttttttttntttttttttttgctgatatngtcaatttgtntggtnctgtacaggtcccggcatagtcaaaacattcctgaaaaagttagagggcttataattccaaatttcaaaattcactataaagctacagtcagtaagacagtgcagtattagcatgaaggatacaccttcagaacaaaagagaactcagaatccggaaataaacccttatatttatggtcaattgattttcataagatgctacggcaattcaataggggagggacagtcttttcaataaaaggtgctggaataatcacacacccacatgcaaaaagataaattatacccttacctctcactataaacaaaacaatatagatcacagacctaaatgtaggagccaaaattataaaactcttaaaacgtacgagtaaattttcattacctttaattaggcaatgtttcttagataaccataaaactgcaaaagcaatttttaaaaatgatanataggacttcatcaaaaggtaaacgcttcaaaagatactactgagaaagtcacagaataggagaaaaatctgntgagactct

SEQ ID NO: 585173 - DNA, 647 bp, Homo sapiens
atcacaagtacacccctgtgtcttgtgccttcttcaacgttccgccaagcagatgcgtctctgtagcatcaggattgggataatatcaattctgttgacatgcctctttgggagtctttgttttcctaaggggagcccagtttaattgagtgtgggatgttagtatcatacaatcagcagccagatggtccagagacggggatttggatacatgtggtctctgtccttcagaaggaagtgatgtgctgcgttctcgctgtgtctgagatgctgtaggctatcgggcagatattaacaataggcggtcgtcagtgcaaatgcaatactgtgacgatataagtatgagcacaatctcagtcctgagatgtctttctcctagtatgcattcctccagccagcaggagttctggaggagaattctgagacttgccagcagggcaatctggttccagttcgagattcgcaaagtgcgtcaagtgagtgaactgaggcccggataagactccctcgagaaagtaagtgacgggcagaccacaaaactagaggccagattactaaactctcattatagtgctcagttttacccacaattctggatctagattattcaaacatagaatggctaatcctttactggatatctaaga

SEQ ID NO: 585174 - DNA, 727 bp, Homo sapiens
  misc_feature (36)..(36): n is a, c, g, or t
  misc_feature (63)..(63): n is a, c, g, or t
  misc_feature (77)..(77): n is a, c, g, or t
  misc_feature (87)..(87): n is a, c, g, or t
  misc_feature (91)..(91): n is a, c, g, or t
  misc_feature (109)..(109): n is a, c, g, or t
  misc_feature (125)..(125): n is a, c, g, or t
  misc_feature (148)..(148): n is a, c, g, or t
  misc_feature (156)..(156): n is a, c, g, or t
  misc_feature (208)..(208): n is a, c, g, or t
  misc_feature (227)..(227): n is a, c, g, or t
  misc_feature (264)..(264): n is a, c, g, or t
  misc_feature (304)..(304): n is a, c, g, or t
  misc_feature (341)..(341): n is a, c, g, or t
  misc_feature (347)..(347): n is a, c, g, or t
  misc_feature (349)..(349): n is a, c, g, or t
  misc_feature (369)..(369): n is a, c, g, or t
  misc_feature (383)..(383): n is a, c, g, or t
  misc_feature (439)..(439): n is a, c, g, or t
  misc_feature (494)..(494): n is a, c, g, or t
  misc_feature (613)..(613): n is a, c, g, or t
  misc_feature (656)..(656): n is a, c, g, or t
  misc_feature (713)..(713): n is a, c, g, or t
tcagtcgacatactatggctcattcgtgacccgggnactcctggactctcagttgagtgaccngcatgccattgaanaatctgtcgntctnatttatgatcccataaanactgcccaaggatgtntctcactaaaggcagacagactnactcctanactgatggaagtttgtaaagaaaaggatttttcccctgaagcattgaaaaangcaaatatcacctttgagnacatgtttgaaggagtgccgattgtaattaaacattnacatctgatcaatgtcctaatgtgggaacttgaaaagaantcagctgtggcagataaacatgaatggctcagccttnccagcngnaatcatttggggaagaatcnacagtggctgatgnacagagtggatgaaatgagccaagatatagttaaatacgagacagacatgaggaanactagtaaacgacagcagcagagacatcagtttcagcagcgtcgccagcaggagnatatgcagcgccagagccgaggagaacccccgctccctgaggaggacctgtccaaactcttcaaaccacgacagccgcctgccaggatggactcgctgctcatggcaggccagataaanactgactgccagaacatcaaggagttcactgcccaaaacttangcaagctcttcatggcccaggctcttcaagaaaacaacaactaagaaaaggaagttnccagaaaagaagtt

SEQ ID NO: 585175 - DNA, 1033 bp, Homo sapiens
cccaaatggtagtaacagactttattaaaagtgaatgtttaaataactaattggtgactcctctcctctgattagagccactgttgggtattattgatcacaactatagcgctcgcaagggagacttgcagaattggcctgacctcttaccaaaactctgtagcctgttggattctgaagattataatacctgtgcagggcagcatttggagcccttcagcaagcatttgtcgcaagcattctgctgagcattttagcaccagtgcatgttttcagcatcgtccgtctccaacatcatgcattccccaaatctctctacagttcttccaagccatcagtagtcccaaacaatcaaggtctccacgctgttagcaatgtgtccaatcaagtcttatccatccagtcaggactccaagctctaatgttgcacattgacttctattaaattgagaaatctcatttgccattagctggtgactgcaagaaccagaaggtacggcaaacacatgtgtgccgagccacttggtgctgtcagctcgaagtttcgcaatggcatcgccctgcttcctcaccatgcatcatcatagtggagtacatgctacagcggactcaagatccagatgcacacatgtgagctttcagacagcctggtgactattggctaaccttaacctgcaaccagcccaatactgcaagaatgtcactcgcacgggcatcttcctaagttgatcctggtgttcgtggacatggcccttgtcagtatcatcagcaccatcagactcttaactcccaactttccaggatgactatacgaaccaccaacatccacaacagaaccaccccgcaaacaccatacaccaggccaaacaagagcaccccagttaataccacgcgatacaggcgacaggaggagacacacaagcccgtgcacgaagaacaggccacccacaccaagcaaaaaaccaaccaccaaaccaaccaaccacgagcacgcctaccaacccaacagacagtcagagaccagacagcgacc

SEQ ID NO: 585176 - DNA, 316 bp, Homo sapiens
ggtgttcagtccgagtggagctgaggctcgggacactgcaggaaaggacgccgctgcccgggctcctggagaggcagaacttggtgtgaggtcttgggaaaacagttcacacctgatgttataacgacgccagaaaaacattcccaccccgttgacttggtaaccccactgtggtggggatattctcttagagggataagataccgggcacaggggaggtgacaatgctcaccactgccaaaacacggtgcttgcaactgcaacatcggaggatgagagggagcagtcggctgtggtgcagaatgctcagcagccc

SEQ ID NO: 585177 - DNA, 1370 bp, Homo sapiens
gggagaatccagcggggctagaaggcagggcacctttggaaacacacattgaagggaatgtgagcacaaagcatactgtcttataaccagcatgtatgttgattgtacgatcatttctgtaattatcctgtaactagtatgtattaggtcagcaaccatagggatgaaatcgttcccagattaattccatcagttcgctgtaagcagtcaattcggaattcctctttgcgcacttttggtaaggtgtactggactactcttaaatggcatgattgcctcgctactcctcgattagtcagtggagaggggagaacaggtgtttagagctctgttggcttgagctggagatacgccacatacagagagatccgcatagtggagaaggactacaccgacgtagttgtgtgaaaaatcccgtacgttggtttcctggtaaccgaagagtaaactttagcttcaacaacctaggataagagtcgcaatttccgaggtaaggcaagtatacagcggtagaaacaagacagaaagcaaagaaagacagagagatagagtgttgcctaagtgtcaaaagggtgtgtatcaaaggcatttattaacagcataattcgtaatttgcggtattgacattgtttgcaatttacggtgaatttttgtttatggattatatatattgtattcgaatggtgatgagaagtatgaacgcaaagatataaaggatggggtaaaggaacccatcatagaagaacactaaacaaatatgataggcgcacgaagtcatcgtaacacgccctcggtcaataagaacatggctattacaaagaaaattgagaatgcaattgtcgcacccgcatataattcgtataggaacgggtggaaggccagctatacaagtattggcgtggttcacataggccgtcactttagaagaacggacgaaacgaacaaggaatacacgaatacagcaaccttggtggatactagattagggcgctaccctcggaagtaatgaacggcgccagattggattagaaaacacgatccacgttccttccagtatacctcgccctattttccatgggggttctttgggaccaagccgttgcactgggtacgtccctgaagaacagcggtgggccagtcacgtccaacacatagggtggccatatgggggtagttcaaggtgccaagtgggcctggggaagtaaacaaatccgcttggcacacttaagacgtaaagttggtttaccagaaaaaacgtgtccaggaacacgattggaacttatttaaactatggtagtgacaaaagctttgagcacttcagagcaggtatatgggaggagagaaccgacctggagatgcacaacccccag

SEQ ID NO: 585178 - DNA, 366 bp, Homo sapiens
  misc_feature (8)..(8): n is a, c, g, or t
ggctgggnggctcatttatgttattatcagcactatgcaagaccagcgtgtgggataacttgatgctaggataccgagaccagcctgcgcaacatggtgataccccacctctactaggagacttaggaagtttaatcgctagaacccgggaggcggaggttgcagcaagacgagatcacgccagtgctctttgtcctggatgacagagtcagactcctcacaagttatagcaatgtcggggtagttggtacttgtcggccgactgggcccagtagagtctagacttgagcaaacttatgtaagaggccttaattggagttcaatagaccaattggccctattgcgagccggattactctggccggg

SEQ ID NO: 585179 - DNA, 126 bp, Homo sapiens
gaaaggtcaagcagattacagaggccataggcccagcagcatcaggaccttgctgtggcagggcctgagatgcaggtaaaactgctccagtccctgggcctgatatcaaccctcttcaccggccat

SEQ ID NO: 585180 - DNA, 1041 bp, Homo sapiens
acttcagatcacatgaaaatgctgatttaacatttgaggtatcacagcattaaaagaaaaagaaagtaaaccagtccttatgtattcagtgacctaatggggtgccatcaataagctgcgatatcagccctggtagctcagtacagccacaccttccgtagcactcctattggccttattcattgaaaagtgagttagtgaatctgccagatctgtgaatgatagagattatgctagattaatgctgattctttgtgtgtgtgggaaatctctgtagagcacctgtttctttcttgagagtaatgtaacccagtgtacaatgtagttgttgaactggaataattagaacttcgggcgttctcttagggaaaagacgacgttccgtaggtcactaggtgtccgtatggggcaaacttgtattgtttatttagatgtcctgtgtccttgaagtgcgtgcaaattatcagtatctataaatgtaacttgattttggcaccacttgcttcgttactgtgaccacggcagaatcacagtgtcttctatgactatatctatgtcccgttattgcgaatggtatctgttcatttgagtgagtatgaagatcagcaactaacaactgacgaatcagagtttgccagtgcaaattcagcatggctgcagctgcattaatgacattcgctctgattattctttgctagcctcatcttactaatggacttgtatactgggccagttacaaatggggctcccaaattgctgtttgcaacaggtcttagacctttcaggaaagaccagttagcgaaaaataagttccaggaacatttgccatctgtctccctgctaactttgcaaagggcggctaacataattaatggggcatttctcaccgacgtttgttcacggaaatctgtggtgtaacaaggggaccaatttcccttacacaaagaaaaaggggagcactaaaatacctcaaagggccacataacagtcacacatatgtgaaagagagcgaatagaggacataaaaaacgacgagtatca

SEQ ID NO: 585181 - DNA, 396 bp, Homo sapiens
gtggtacgatatatatacccaagtaatgctcataagcaggtaagtggctgacctagggctcaaaaatgcttcccactccatcatactgcaaaataatttgatccagtgataactaatcaaagaaaatctatgatgagaggaggtggaaggagggaagccctttcactgcacacttgggatgaacagatgcttttaaagtgaatagcagaaaaacatcttttcacgatgaagttgggatacaagcagtcaactgacatctctcagcagcataaaaaaaaaaaaaaaaaaagggggcctttccaaaaatgtatgctttcaacatccattcaacaacaaacttgtggtttggtgggccaagggctgacctgtggtcccagtcaaaatttggccaaaaaa

SEQ ID NO: 585182 - DNA, 842 bp, Homo sapiens
  misc_feature (15)..(15): n is a, c, g, or t
  misc_feature (91)..(91): n is a, c, g, or t
  misc_feature (116)..(116): n is a, c, g, or t
  misc_feature (118)..(118): n is a, c, g, or t
  misc_feature (138)..(138): n is a, c, g, or t
  misc_feature (143)..(143): n is a, c, g, or t
  misc_feature (192)..(192): n is a, c, g, or t
  misc_feature (199)..(199): n is a, c, g, or t
  misc_feature (201)..(202): n is a, c, g, or t
  misc_feature (223)..(223): n is a, c, g, or t
  misc_feature (258)..(258): n is a, c, g, or t
  misc_feature (266)..(266): n is a, c, g, or t
  misc_feature (313)..(313): n is a, c, g, or t
  misc_feature (364)..(364): n is a, c, g, or t
  misc_feature (367)..(367): n is a, c, g, or t
  misc_feature (458)..(458): n is a, c, g, or t
  misc_feature (660)..(660): n is a, c, g, or t
  misc_feature (839)..(839): n is a, c, g, or t
tgtcgattccgacanggatttccaacgacaaggaaaaaatgaccccacttccttatttgaaaattctcgtaattaataagatactgaatanaaagaactatctcaattacttgttnantaatcatattatcattttgntaacnatctttggagagcacagaaaaaatgatagaacaacaaaagaaaattcantgatgcnanntttaaatgtatatttaatccnattacttttttcaaaaagtcacactcacgtctgcntgagagtnttagaggaatataatgtatgagagagaattccaataacataatgtanaaaaatgttgtcacatacagaagagcaaaaatctacgtattggggactatngcngtgggaagaagggcctgatcttcatactcatcttcctcattgagtaccatgaccccttccaattcatccatactacaccatcatctgtgcnatgctttgccatgtcccaggtgtactgtccaccccagtagtatctgccgtttggattggctgcatgacatctattataccaccatccaccaccgtcttctttagaacactgttttctgggatctgatgttaaccagccgtcattgtctctgtcatacgtgctgaagaacatgccgttgtgaatggtcatggtcctgttttcngccatcagctgagatgctccatccatgagggcattaccggctgttcctctgtatttgttcactgagatctggtatttgttggcttcattctgtacagtgaatcctccatagtgagcctttactttgtctcctttccagtcctccatttctatcaaaagttctgtgggtcccatcctggnaag

SEQ ID NO: 585183 - DNA, 141 bp, Homo sapiens
ccgctaccgaggagcccccagcgcctccggagttccactaccaagtgtgcgaccagagatttacacagtcctggtttttcaaggaccaacatgcgtaagcacaagccatcaataagatcatgagtatccggtgtgcggccg

SEQ ID NO: 585184 - DNA, 142 bp, Homo sapiens
atcccgtgtggtcgacatatgatataatacatatgattagttctgtggctgtgcaatgttataattaaggagattcgtacggagattagtatagagaggtagagtttttgtcgtgattgtggcaccctgggtgaagtaagca

SEQ ID NO: 585185 - DNA, 134 bp, Homo sapiens
agcctttgacaagttttttattgtgaaatattggatctagaaaaaaagtacaaaatgtcaacagtcagatgtgtacatgtttattatctttttagtctatacatgtgaacagcttaacaggttcactgcagaat

SEQ ID NO: 585186 - DNA, 637 bp, Homo sapiens
actccccacgcgcaccggttcaaagtggtagttcaagaatgttacaattgatgaatcgtacgtatacccgcgaatggtatatggcgaaagtggatcgtatcaaagaactactccccgactgtggtatcagttcagatatcatcgcaggttttggtactgagacagaggaagatcatcaagagacactcagcatcatgcaatacagcggatatgacatgagctatatgttcttctacagcgaaagacccgggacactagcagcaaggagatatgaagatgatatacctgacgaagtgaaaaagagaagattgcaggagattgtagacttacagggagagttatcacgtcagagtaacttgaaagatttaggaaaaacattcaaagtgtgggtagaaggaaacagtcgtaaaagtgatgctgattggatgggcagaaacagtcagaataaagtgattgttttcccaaaaaaagatatgaatgaacaactgaagggaagttatgtaatggtgaaagtgaccgattgcacaaagacaacgttgcgaggagaaagagaattgtaatgttgaatatcaatgttgcatgcgttaaaaatcaataaaggatttctacttagaaattcggatcagggatcataatt

SEQ ID NO: 585187 - DNA, 111 bp, Homo sapiens
ctgagagtgtggtacagccatctcctagccttcagatctgcttaataatttttctgcttcagcaatggttgttgcttcctcttcagccaagagaatataagcagttgcaca

SEQ ID NO: 585188 - DNA, 326 bp, Homo sapiens
acagaccaatgaggcaaccacaatgaacttgacaagactgtctccttcctaatggtccataaagaccaaggtctactacttctagaactgtgattctccttggtaggggaagggcgtaatcagaatactccagcagactttccacactccacaaatcccacctccagttactgacttgcctcctggttgagatcctccctgctgtggaaacccactgataacgtttctggaaaagagctgtgacccatcattgggagggcaatcatgaccaaatgttcatccaattctaagattctgctagtttaatcttcgcgattagggtaagt

SEQ ID NO: 585189 - DNA, 146 bp, Homo sapiens
ctatatcccaaagaccagaagtatacatacctgcatagactcccagtccggcggactgccgcctctccagcctccccatacagcgtctggctagccttcctgctaggtaccattacgcaggtcgatagtcataagctagtcccctg

SEQ ID NO: 585190 - DNA, 141 bp, Homo sapiens
cgaggaagaaggtggggaggaagaggaggaggaagaatattgtgatagtgaggaataggatggtgatgaagatgaggaagctgagtcagctacgggcaagcgggcagctgaagatgatgatgatgactatgtctataccaa

SEQ ID NO: 585191 - DNA, 440 bp, Homo sapiens
aggaacacagtctctttaggagtacggttcagacggcctctaagtttctgcagggactggctatctttataggcattactaagctagtggtaggtgatgaggcattaatcatcaaacatcattgactttgtaattggcattgatggtttgtaattgtttttttaataccagccctttagcggatttaggaagggagtttagagaaatcctcttgaattttattgattaaggccagttcagatggtagactgggcatgagttgaaccctgctttttcattccgtggtgacaactttgtgctcccaagaagagggcctctctttgcagtgtccccggaggtcttgaagcctcttccctactgctcaccccttagtacagcaaaccttcctgctggcacccccagtcctcttaaagcctgctggcacagtgtcacttcttcca

SEQ ID NO: 585192 - DNA, 316 bp, Homo sapiens
  misc_feature (6)..(6): n is a, c, g, or t
  misc_feature (15)..(15): n is a, c, g, or t
  misc_feature (83)..(83): n is a, c, g, or t
  misc_feature (316)..(316): n is a, c, g, or t
gaaagnattcctccntcaggggccctgaaagcttgcgggatgaataactcctcctcctcaggcccagtcccaaggtacaaacnttgcaccgagcagcaagatagcagaggcaggaagagagctggctggaagacacgtaccccctgaagatcaagagggaggtcgccctggtactacatagcagtcacgttaggctgggacaattcctgtttacagaggactataaaacccctgccccatcctcacttgggctgatgccattttaggcctcagcctgtctgcatgcaggcgctcattaaaacagcatgttgctccn

SEQ ID NO: 585193 - DNA, 191 bp, Homo sapiens
agtataataattgaaacagactacttcatattcctgcttatgtgacatacttgtttttgttttgttttgtttttttgagacagcttcttgctctgtcacccaggctggagtgtagtggcatgatcatggctcactgcagcctctacctcctgggcttaagcagtcctcccatttcagcccctcgtcgacgc

SEQ ID NO: 585194 - DNA, 217 bp, Homo sapiens
tagtctaagtccgcctagtacagttttaggtgaccagtgactttgtcgatcaggtctagcgggtcctggtccattccctagagacagtacgagagcctgtgtgaatttgttattcctccagcatcttgaattaaacttacagtcagtcccagcatttttgcatgggccaataatgcaatcagggtttcttcatcaggagctttgaccaccaccttgg

SEQ ID NO: 585195 - DNA, 106 bp, Homo sapiens
actctagattgatcccctttgaatcactccttactgctgaatctgccttcttacttgctgaatctggcttcttaacatgcttgtccacccaccacgtgcccttgtg

SEQ ID NO: 585196 - DNA, 344 bp, Homo sapiens
  misc_feature (45)..(46): n is a, c, g, or t
  misc_feature (65)..(66): n is a, c, g, or t
  misc_feature (75)..(75): n is a, c, g, or t
  misc_feature (109)..(110): n is a, c, g, or t
  misc_feature (307)..(307): n is a, c, g, or t
tgattggtggacagtagggtggaccaaaggaggccactgagttanncagcaccagttctgtcacnnccgcgcctnccgtacctagtgggtgttcctgtttgctcctganncctgggtgggctagggcctgcattgcgggaagatgcctttgcagggaggggaggataagtgggatctaccaattgattctggcaaaacaatttctaagatttttttgcttatgtgggaaacagatctaaatctcatttatgctgtatttatatcttagttggtgtttgaaaacgtttgatttttggaaacacatcanaataaataatgggcgtttgttggtaaaaaaagggtgg

SEQ ID NO: 585197 - DNA, 360 bp, Homo sapiens
agcggatcccttatgtatgtatagaaataggtacaaaaccaaggaggttatctattacctttgaagggttactgatggcatagctcgtgtttcactaagtccaataaagggtattagtgtctaaaagaatggaagatagtggtgatacctttgaaccccctcccccttgcgtaatctcatagaatccctaatcacgggccctgtgggagataatagaaggtcgtagtgtatcaaccaaagtaaatgttgagatatctcttaccctcatcagttagtcaacccaagtaagagaagaccacattcaagagataagatcaactagccaccaaaggacgtatatgaatcctatgtgatggagat

SEQ ID NO: 585198 - DNA, 112 bp, Homo sapiens
tactttcacaggcgataataaacaagtataatgtcaaatatttttttaaaccgtatattggccaggtgctggctcacgcctataatcccagcactctaggagactgaggcag

SEQ ID NO: 585199 - DNA, 386 bp, Homo sapiens
ccttgggccccccagggtgcagcccccattgttggacatggacatggaggggcaaaaccaaaaaagcacagtgcccttttggggggccccgggttcccattaaggcctgcccccccccgcccgcttgggcagccatgaatgtagggccccaggccctgccccagccccccatgccacaaggtgggggaggccctgggcagaatgtttattttttttattggggaaggagggaggggggggacatttaattttttcttttgtaccccagggggtggagccctgtgccccccctgccttggggggagggtgggcagggatatttagggaaagggctttatgggggttttggcccaaaatggagcattaaaggtaacccctgcccccta

SEQ ID NO: 585200 - DNA, 643 bp, Homo sapiens
aaacataaaaaatcaccagtagcagtaccacattcctgtagtcccaggcactctgggggcagaggtgagaggattgcctgaacataggagtccaagcctgtggcaagctatgatctcgccactgcactcctgcatgggtgatagagacccatctcaaaaaaaaaaaaaaaattcggacggggggcagaacctcaggccggttattccagcaatttggggaggctgaggcaggcggatccactttggggccaaggagttggagaccagcctgggccaacttgggtgaaaccttggtttttagtaaaattggcaaaatattagccgggatgtgggtgggaaagtggcctggtaatcccaagctactggggaggctggaggcaggaaaatttcttggaccctggggaggtgggaggttggcagtggggctgaaatagtggccatggccctcccagctggggcagaacaggtgaaacctccggttttaaaaaaaaacaaaaaaaattctaaattaaagctggagaaaagtaacccggtagttcacaaggggggttattactctccaaggaccaagggcttaaatcccttaaaagcattcctggaattacccggagcattattggtccatctggtgtccactccttta

SEQ ID NO: 585201 - DNA, 156 bp, Homo sapiens
agtctagaggatcccaagcagttatacagactcacctcaacccctcataatctccagaagagtttctgccaaaactgtggcatagacgacttttgatatggttcttagccagttgttttatagtccctaaacctcattgtgaatcctataggggta

SEQ ID NO: 585202 - DNA, 325 bp, Homo sapiens
cacgaggcgctggccgattcgcggcgagtcggagaacctggccccggccaagttcgtcaacggcggctccgcgcaggagtcggtggtgggtgcgggcagcatcatctcggcggcctcggtgcgcaactcggtgctgtcgtccaacgtggtggtcgacgacggggcgatcgtggagggcagcgtgatcatgcccggcgcgcgggtggggcgcggcgcggtggtgcgccacgccatcctggacaagaacgtggtcgtcgggcccggcgagatggtcggggtggacctggaaagagaccgggagcgctttcgccatcagtgccggcgg

SEQ ID NO: 585203 - DNA, 763 bp, Homo sapiens
ccagggcctgcagtgccagcgtggccaccctcttggtagcctggccagtaagaggaggacagttgtgtgctgaattagcacacgcacgtgcagcgcgcacagacgcgcgcacacacacacacatacacgctctgctgcatttggacaaaccatgcctgccagagtgtagcagaggtgaggaagcaggtgggcagcttgcctgacccggcttttcaggagagcgtgtctccaacagagagtctccacactctagttcagggttatcgacctgcctcaatgagatgacagactcatttgggaggggtgttgcaaacaagttttcagtgagaatagttaagttccagagcttgtaaaggattcagtgactgacacttcagtaaattaggccaggcacattggcttatgcctgtaattccaacactttggaaggccgaggtgggcggatcatttgaggtctggagttcgagaccagcctgaccaacatggtgaaaccccgtctctactaaaaatacaaaaattagccaggtgtggtagtgcacatctgtaatcccagctacttgggaggtggaggcaggagaattgcttgaaccctggaggttgcaatgagctgagatcacactacttcactccagcctgggtgacagagcaagactcggtctcaaacaaacaaaaacttatggcgatgcaggttttcatgctcaaacgcttgcattcaggtatgctttcttttttgagagagacaaatgggtcacaactggcaccc

SEQ ID NO: 585204 - DNA, 504 bp, Homo sapiens
tggctgtagctaagcagaccacgcgctcggggcaggcaaagcagcgtgcggggaagtcacgaaacagtgtgcctaaggaagtggggaactacgtcccgtccagatagccttgaactaccaacattcgcttcgggaaagtaggtcagcagcacctaagatcaaggatgcgtaccatatacacacttcacagtcatgaaaactgagaagactgtcttcagcgtgaactaagagttcacaagcagatcactgatccagaacacttcaagaactcgtcaaacagctcgataagccttattgactgtgtacatctgtaccgggaataacattcctaggctgaaatttccacaaagaatagaacctgtacccagttcttcaggctgatttccctgacctcttgggcatttgtatttgtagtacagtattgcagagattcctaagtattttatagcagccatcaaaatgggactttgtatcgtatattcataaaagacacttggtaataga

SEQ ID NO: 585205 - DNA, 752 bp, Homo sapiens
ccagggcctgcagtgccagcgtggccaccctcttggtagcctggccagtaagaggaggacagttgtgtgctgaattagcacacgcacgtgcagcgcgcacagacgcgcgcacacacacacacatacacgctctgctgcatttggacaaaccatgcctgccagagtgtagcagaggtgaggaagcaggtgggcagcttgcctgacccggcttttcaggagagcgtgtctccaacagagagtctccacactctagttcagggttatcgacctgcctcaatgagatgacagactcatttgggaggggtgttgcaaacaagttttcagtgagaatagttaagttccagagcttgtaaaggattcagtgactgacacttcagtaaattaggccaggcacattggcttatgcctgtaattccaacactttggaaggccgaggtgggcggatcatttgaggtctggtctcgaactcctggcctcaagtgatatgcccacttcagcctcccaaaatacaggcatgagccaccgcgcctggacactacttctttaaagaaatatttaactgacaacctaggaatttggaatgtgttagtaaaatgtgacgtttgctatagcttgccagcaaaggttgtatcaggtagtatagagtttgggctgttctcagataaaaaggataattcaacgtcaaatagggttaatatctccacaatggcgaggtatcaaggtacagtccaggctcatcagaggatgtggca

SEQ ID NO: 585206 - DNA, 241 bp, Homo sapiens
  misc_feature (72)..(73): n is a, c, g, or t
atcccagcctttgggaggccattcgggcggatccttaggtcggagtctccccgcccaccctgaccccctttnnactaaaaatacaaaaaattagccaggcatggtggggcatgcctgtaatcccagctacttgggaggctgaggcagaagaatcgcttgaacctgggaggcggaggttgcggtgagctgagatggcgccattgcactccagcctgggcaacaagagcgaaactccgtttca

SEQ ID NO: 585207 - DNA, 1009 bp, Homo sapiens
gcacgcaagaagcttgcgtgatcgtttcaaggccgggagagatgtggccgagacagatggctgaatgtgctagagggcaacgagtggagtgctatcttaggaaaatcaaaggcccgcaagaggcaaataaatccttgtctttgtcttcagcccagataagtaagaacaccattgagtaagcatgggtgaagaagcaaaacaaggatgcagtaggcatagtgccctaaaacaaaaagctgacgagcaaaaatcacaaaaacaaaaaatcaagatacaagggggggagagatcaaacacgaatacgccacaagagaggacacaggctcggaacgagtcacggacaatgtcacacgggagagataaacagcgggaagcaaaaaaagaaaggcagaaaaaacaaacaactgaagacactccatgagtacacgacagataaagcaacaacatcaccatacacctcggcgaacacaacaaggggaaacactggcagagaaccattcacgataggatgagagacgcaaaacacatcacggacgtacacgaaagccaccaaaaagggggacgacaacaaaagcaacagaaaagaaaaagcagatacaaagaaaagccaaaggagacgagtgaacaaacctccctcgagcatggcacacaaacagagccaacatacagagacaaacaaaatcacaaaccacgaaatagaccacgaagtgacaacataagaagcaaatacgacaggaaacatagcagaaccagaacagcagcggtaactagcacacaataacagagtagcaaagaaagaaagcaatagaacataacacaagacgagaacagacaaatagacaagaagaaaaagacgaaagaaagcgacgaagcgaggacaagcagaacgaccacagcaccagaacacggagagaacagacagagacacacaacccgaacaagacaccacaaaacaagacagaaaacaagacagaaagctcaagaacagcaacagcaaaagaaacaaaag

SEQ ID NO: 585208 - DNA, 193 bp, Homo sapiens
tgcctggcttgattaggaataaaggattgtgataggcagctcagtctccaaaccccattgttagggtaaggcgaatgtatagcactgtataactgtcttttaatgtcagtgtcactgtaacaatggcttgtggtttagtttgttagttatttggttagtgcttagagaagaaaacgcgaggcttcagtgccgt

SEQ ID NO: 585209 - DNA, 195 bp, Homo sapiens
caatagaaatggcatgaggcaggcaggccaattagtgcccatgtcgagtgaggtgtaataatgtgactcaagtgttgctgcctgtgtgacaaagagcagtaagagaatccctgcaggtggtagtgaaactcaaaggtcactcatctcctgtgcacggagatcagcacagtaaaaccattttcagtgcaagagcta

SEQ ID NO: 585210 - DNA, 480 bp, Homo sapiens
ccagctgcatggacaagagttaaacggtggcttcccatctgcatcatctttctcttcagcccccggagccacgtaccgcggcgtctccagccacacgtcgcctgtcagcgggcccgacagcttcctgggctcccgagggaccacagctggcagctccggggatccctcggcaaagcactggcttcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccagcgttccgcagcacgccgtggcacagccggcgacatgcacacgctgctgcctggccacggggcgctggcctcagtttcaccagtcccatgtcgctgggtgggc

SEQ ID NO: 585211 - DNA, 318 bp, Homo sapiens
agttcagggagagacaccacagaaggagacccagacgtccgaggaagttcccagcagagcaaactggtttccagcctgaagcctgcttaactgtgtgatgtgcaataactgagcttcagagttaggaattgtgttcgagtgcttggatttccgtctgtagatttaacagctgaaattgtatctctcagtgcttttagatgtcttttaaaaaattgaaaaacatagtgttagactgtgtgcgtgtgcgttgatcggcactcgagagtcccgtgagtcatccagccctgcctttcccctgcgccctccctcctctcacgc

SEQ ID NO: 585212 - DNA, 166 bp, Homo sapiens
tgacatgggccaagcatctgagtcatgctgccggatgacgtgcgtgacttcatcgacaaggtggacagatctccaggttcctcctacttaccgctatgctgagtcttccatgaagaacagcttcggcctaaagtaccttcataagttcttcaatatcccatttttg

SEQ ID NO: 585213 - DNA, 176 bp, Homo sapiens
catcggggacactataaatttacccggaagaccaggcctaagggggagcggggcaccactggaaataccaggtctgaagggattctttggagagaagggaacagaaggtgacttcggcttccctgggattacaggcgtgactggagttcatggccctcctgggattgggctatcaa

SEQ ID NO: 585214 - DNA, 236 bp, Homo sapiens
atcccattatcatattcctacgtgtgacaaacccggtgcccactgtgatgaacagaccgaagggctcctgtgagcaacggaaggaggactggatgcggggaagggcaaagggcgcggaacggggtggggagtctagcgaggcgagctcgagatgacactagaaaccttgactgctattcctattcactgtactcagattacctccagtatccagacatggtgcccatcgacctgaa

SEQ ID NO: 585215 - DNA, 914 bp, Homo sapiens
tgtaatcccagcactttgggaggctgaggcgggtggatcatgaggtcaggagattgagaccatcctggctaacacggtgaaaccccgtctctactaaaaatacaaaaaaaaaaattagctgggcgtggtggtgggcacctgtagtcccagctactcgggaggctgaggcaggagaatggcgtgaaccccggaggcggagctggcagtgagctgagatcaggcccctttgaaccagcctggggcaatagagcaagactctgtctcaaaaaaaaaaaaaaaaaaaattcttccttaaaaaaattaaaaggaaaaagggtccccccttttcccacgggaatctgtagggggcgggaattttctataaaacatttaaagcttggacccaatttgttgttattcaggaaaggggagaaaaaaacggttttaaagaagggtccatattttaaattataaattttaaaccacggggtgatatccaacaccacttttgtggggagacattttatcttctcacaaaaaagggtaatggggcggaaaccgccatgtaagggcgggtaaacaactttttaacatgggcgctggggggaggtacgaattaaacagttggactagttggacaaaattgggatggttgggcaaataactcaggattattttacccccatttaaaaagtgggcccccaaattggcggagaacccaaaaaagcggcgctgagatccaacaaggttaaacaaacgttggccgtggtaaatggacacggccccttgacacgtgggtacttcttttccccccagaggataaaaccccggggcgtggggccataaaataaaaacgcctcaggggcccttgggaagaagaaaaaaacacaacaaacacgacacaaacagcacaccaacagacgcaacacaccgac

SEQ ID NO: 585216 - DNA, 107 bp, Homo sapiens
aggtggaggtgggctctaaggacggctgggcctttgcgtggcccgcgagagcgtgcgccgaaagggcctacgcccttcactcccgaggagggacggtcccttacctt

SEQ ID NO: 585217 - DNA, 119 bp, Homo sapiens
tctggtgtatggtagcacagcaaactggtaggaattagtatcaatagtaaatttggggtttttaaggatgtggcattccgttttttaaaaaaaaatttggtaataaaattatgtatatt

SEQ ID NO: 585218 - DNA, 211 bp, Homo sapiens
tttgaagattcccttgaactttcgggggaatggggtaatgaccttgagggggttttttggtgggaatgagggtttatggtggtaatggggggggtggaggaaccccattgtgttgtggtaaatatgtagagggagtatagggctgggactagtatggtgagtccttgaaggaggagagtgatatttgatcaggagaacggtggtactagca

SEQ ID NO: 585219 - DNA, 89 bp, Homo sapiens
tcgggggggccccgggggttgtttttttttttttttttttcgggggggggcccccgggggggggcacccccccggggggtcccccaata

SEQ ID NO: 585220 - DNA, 237 bp, Homo sapiens
cggtaccgcagcatcttttcttcaaactcacagagtgaattcagctcttctgtgatcaagacccagccagttctctttcattcagacgctgttggctaacaaatttatatttgccaaggatattacggcaaatgaggctacttgattggtggacaacctcgtgcccacattgcaaggtatctattacatagggtcttttataaagctatagtcggaggtagggtcagctctaattat

SEQ ID NO: 585221 - DNA, 399 bp, Homo sapiens
gtcattgtcagctctggttttatatatatattaaatatatacatattttgagacagggtctcgctgtcacccaggctggagtgcagtggcacaatctcagctcactgcaacctctgcctcccagcctaaagagatcctcccacctcatccttctgagtagctgggactacatgcgcatgccaccacacccagctattatttttatttctttttgaagagacaagggctcactatgtttttaggctggtcttgaactcctgggctaaattgatccttctgccttgggctgccaaagtgctggaattataggcatgagccacttggccttgcctgattattttgtttttgaatagtgaccttaatgtgcttttccaatttcaagagacttttgattaaatt

SEQ ID NO: 585222 - DNA, 650 bp, Homo sapiens
  misc_feature (351)..(351): n is a, c, g, or t
  misc_feature (397)..(397): n is a, c, g, or t
  misc_feature (400)..(400): n is a, c, g, or t
  misc_feature (412)..(412): n is a, c, g, or t
  misc_feature (420)..(420): n is a, c, g, or t
  misc_feature (480)..(480): n is a, c, g, or t
  misc_feature (509)..(509): n is a, c, g, or t
  misc_feature (558)..(558): n is a, c, g, or t
  misc_feature (583)..(583): n is a, c, g, or t
  misc_feature (615)..(615): n is a, c, g, or t
  misc_feature (617)..(617): n is a, c, g, or t
  misc_feature (645)..(645): n is a, c, g, or t
gtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggangtcattctgccctttcttgggctgtgttcacggcagcgattattantanagttcagtgtangattgtanctttggatctgcgaaatcatggtgaaacaaaggtcaagaatcctgaagatctgtctgcanaaacaatggcaaaagacgttggcaatgtngttgaaccatgtttggggaccttcctcctccaattatgctgattggacnttagcatggggttgtgctattgcantccacacaagcatcatcccaacctggttaccnancctctttgggtctgttcatgaattgatnttgtt

SEQ ID NO: 585223 - DNA, 255 bp, Homo sapiens
taccgtggacacacgtttgtggtgggaggcctgcttcttcacctcccgaggtggtagtggtagcagatgccaattccagagttccagtgtaactgttctcttccatccagaggagggatttattactgtgccacccggactgaccctggcagctgcagaccttagtcttctggtcccactcacatcactgagactcttggttagtagatggtcccatagtgagaggttacctgttcgttaattgagaagtcctcg

SEQ ID NO: 585224 - DNA, 506 bp, Homo sapiens
agttcaacctgcattacagttgtcatctgctgcacctattaattagactctacattgtccttattctatgtgttcattgctcttccttcgtcacccctgtatgagaacatgtcatacttgtataaaccaagctcactgactcttccttattgctagtatataataataccatatatgcatttaacaattatgtgcaccagtacatgttgtgcacttttgaatcatagcccatacttactcctcctccttcccccagccctaatctgtggacacaattgtcttgctattacaagtggtgactgtggccaaaccctctgcgggactgctgatttaaatggttggagatattagtgcataaggtatgatagttttgttcccaactcagttacatcttcccacaccccttcgatcattgtccctttggcccttttttctttgtatgtgcgttctcagttaatatatagctaataactcttatttttcttatgttttagactgtttacgct

SEQ ID NO: 585225 - DNA, 202 bp, Homo sapiens
  misc_feature (10)..(10): n is a, c, g, or t
  misc_feature (12)..(12): n is a, c, g, or t
  misc_feature (187)..(187): n is a, c, g, or t
acacctactncnatttcaaatcttgtgccatcaatgacttcactcggttgcaaatgcaaacgataattcacgtcagctgccaccaatgccaacggttgttacttggcatgatgcgcaatatcagctaatagttgcaaatcctgtgcggtcatttcatgcaaagctgccagaatcgttaaacgtaacnattcgatatgcgtac

SEQ ID NO: 585226 - DNA, 219 bp, Homo sapiens
accaccacctgagtcagaacggaacctgaagggaatggaccaagtccaggaagaatacaccacttgcttgactaaagagccctatagaccctgaataatcaccagacagcaaacaagtaacacacactgtgggacctcagactaagactacagacatgcagacttcagagtgtgaccctggcatattacacacgctagcggctggctacgacggcaaag

SEQ ID NO: 585227 - DNA, 696 bp, Homo sapiens
  misc_feature (4)..(4): n is a, c, g, or t
  misc_feature (87)..(87): n is a, c, g, or t
  misc_feature (111)..(111): n is a, c, g, or t
  misc_feature (115)..(115): n is a, c, g, or t
  misc_feature (130)..(131): n is a, c, g, or t
  misc_feature (147)..(148): n is a, c, g, or t
  misc_feature (172)..(172): n is a, c, g, or t
  misc_feature (175)..(175): n is a, c, g, or t
  misc_feature (178)..(178): n is a, c, g, or t
  misc_feature (191)..(191): n is a, c, g, or t
  misc_feature (193)..(193): n is a, c, g, or t
  misc_feature (203)..(210): n is a, c, g, or t
  misc_feature (214)..(214): n is a, c, g, or t
  misc_feature (253)..(253): n is a, c, g, or t
  misc_feature (266)..(266): n is a, c, g, or t
  misc_feature (276)..(276): n is a, c, g, or t
  misc_feature (290)..(290): n is a, c, g, or t
  misc_feature (300)..(300): n is a, c, g, or t
  misc_feature (302)..(302): n is a, c, g, or t
  misc_feature (314)..(314): n is a, c, g, or t
  misc_feature (317)..(317): n is a, c, g, or t
  misc_feature (320)..(320): n is a, c, g, or t
  misc_feature (380)..(380): n is a, c, g, or t
  misc_feature (385)..(385): n is a, c, g, or t
  misc_feature (394)..(395): n is a, c, g, or t
  misc_feature (437)..(437): n is a, c, g, or t
  misc_feature (468)..(468): n is a, c, g, or t
  misc_feature (553)..(553): n is a, c, g, or t
  misc_feature (685)..(685): n is a, c, g, or t
aganccaggatgtttggctcttccgcgcaggcctccatctgtctccccgttttgctcttcctacgcgttccaggtcctccacctggntgagggggccgtggggctcccgcnagcnctcgattggctgggnntttttcgggccaatgnnctgaagactgcggagatttcgggntgngcnttcgttcagcagntncagtattttnnnnnnnncatnagccagttgctccgggctgatctgtagctcccagcagtnctcagccttctcntcaggctctngggcatccagggantccagctttntnttccggcctttnttnttnaggatgtggatctcggcatttggggatgctgcctgctcctgaattagctgtaggggcatnaccanagccttttnnaggggctttgccctgtgactgtgcgatgtgaaaggggccggngcattgtgggacaatggttctccttttcctnagccttctgggccaacatcttggcctccagttctttttgcttcgtcttaagcctctcaatctctaggtccttctcttctactgtnttcattagcaccatccgctctcgctttggggtactcaacagaggggccccctgtgctcccctgggaggcaagcagacggtccaagctgaggaggcgctccagcatggccgggtccatgctgcttagcttctnttgggggctga

SEQ ID NO: 585228 - DNA, 169 bp, Homo sapiens
aatgaacaggcaagccgggcccccacctctcccggggggtctcagggagaaccgtttcacggcaccctttccctacctttgccttcttgaatctccgggtttaccatggatgacttcgcctcggcatctacggacttgatttttcattctgccactccatcacaaacgg

SEQ ID NO: 585229 - DNA, 119 bp, Homo sapiens
gactctgcagatcctcaagtgccttagacaatggagctgggagattggtttggagaccagagatcagccaggatttctttcagtaagactctaggccttccatttttgaggcatcctat

SEQ ID NO: 585230 - DNA, 2016 bp, Homo sapiens
aaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgccaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataaccgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttc

SEQ ID NO: 585231 - DNA, 5407 bp, Homo sapiens
  misc_feature (5314)..(5314): n is a, c, g, or t
  misc_feature (5319)..(5319): n is a, c, g, or t
  misc_feature (5324)..(5325): n is a, c, g, or t
  misc_feature (5327)..(5327): n is a, c, g, or t
  misc_feature (5331)..(5331): n is a, c, g, or t
aaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgccaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataaccgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaagggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatcagagcagcaggagggaaaatgaagaaggaacgatctcgtaagaaggattcaagtggatggagagctagaagctctgatggaaaatggtgagggtctctctgataaaaaccaggtgctcagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaagaaatcagcctgaataaatggaatgacttgtctgcctcacatattctaaggtgcagagtcagaatatgaactgttgcaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcattgaagctgagatggacctggggaactccaacatatggatgaaaaccccatgaaggcttcgaaaaagcccaagacagcagaagcagacacnccagngaacnncnaagnaaggccggcgtttccaaagaaagcccggtctcgcccgcgcgtgaactatggaactgctggatgtgggattcccggg

SEQ ID NO: 585232 - DNA, 548 bp, Homo sapiens
cctgccacatcctgcactactgcaaaggactgcgggcacttttacatgtgttctgctacggagccaggacaaacggccggtcagaagccggaccagcagtcggtggtgacgagagcctccctccagcaggcaccacgtcagagaggccccaggcccagtgagcccgggaggagacccagccgtccagccagacgtgtgcctgaatgccacagacttcaagcagttaacaaaggaaactcactgttaaaagctgttaaatctcattaaaacagcagaggagtgctttagattctctgaatatcaaataatatatacggatagacactgagacctgacagtctaatctaaggcatcttttacagatgcattgtgttgagaagttagtcttcttttaaactctgaatcagtgataaagttgttaattggcaaaaagagtacagttttaagcaagaatagagtgaaactacattttaaatatggggaattgggggagtactacctaaggtgcctatgtaaaggttccattcagatgcccaaaaggacaaaga

SEQ ID NO: 585233 - DNA, 4905 bp, Homo sapiens
  misc_feature (4812)..(4812): n is a, c, g, or t
  misc_feature (4817)..(4817): n is a, c, g, or t
  misc_feature (4822)..(4823): n is a, c, g, or t
  misc_feature (4825)..(4825): n is a, c, g, or t
  misc_feature (4829)..(4829): n is a, c, g, or t
aaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgccaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataaccgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaagggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatcagagcagcaggagggaaaatgaagaaggaacgatctcgtaagaaggattcaagtggatggagagctagaagctctgatggaaaatggtgagggtctctctgataaaaaccaggtgctcagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaagaaatcagcctgaataaatggaatgacttgtctgcctcacatattctaaggtgcagagtcagaatatgaactgttgcaactgaacgaggaagggatgctgttggcttcagagatcaaacacctgccccgaagactcctaataggtcaagagagagagacccagacaagcaaactcaaaataaagagaaaaggaaacgaagaagctccctctcaaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcattgaagctgagatggacctggggaactccaacatatggatgaaaaccccatgaaggcttcgaaaaagcccaagacagcagaagcagacacnccagngaacnncnaagnaaggccggcgtttccaaagaaagcccggtctcgcccgcgcgtgaactatggaactgctggatgtgggattcccggg

SEQ ID NO: 585234 - DNA, 534 bp, Homo sapiens
  misc_feature (359)..(359): n is a, c, g, or t
ctcggctctaccttgtcggctgttctctgtgtttagatatcacatgctttcttcctaacttaattcctaacttttctgcttaaatgaccactcatcagaaaggtctccctctaaccaccacctcagagactctacctttaccctactattttttttttttggaaatagggtctcactcggttgcccaggcgggagtgcgggggtgtgatcacgactcactgcagcctagactacgggactcaggtgatcctcccacctcagcctccggggtagctgagactatagacgcataccaccacaccgggctaattttgggtatgttgggtagagagggggtttggccatgtggcccgggcggntcttgacctcgggggctcaagaattccaggtgcctcagcctcccaaggggtggagataacgggtatgagccagggtgcggggccccttaaccttatttctcttttaagtactctccaccatgggctatttaaaaattattgggtttaatggtatctgggagacagggtagagccg

SEQ ID NO: 585235 - DNA, 175 bp, Homo sapiens
ccacggacttacattctcattactattctgcctagcaaactcaaactacgaacgcactcacagttcgcatcataatcctctctcaaggcacttcaaacctctactcccactatatagctattttgatagacttctacccaagtcctcgtctaacctcggccttacccccacacta

SEQ ID NO: 585236 - DNA, 282 bp, Homo sapiens
  misc_feature (43)..(43): n is a, c, g, or t
  misc_feature (101)..(101): n is a, c, g, or t
  misc_feature (123)..(123): n is a, c, g, or t
  misc_feature (150)..(150): n is a, c, g, or t
  misc_feature (197)..(197): n is a, c, g, or t
  misc_feature (267)..(267): n is a, c, g, or t
ctcatcactgatacttagattctttcacttttattgtttgtcncagaatagttggtgctcatttctgtctgggaggtgctttctttttatctcttctcttngccttctatctgatgttagcanaataataggatttaagagcatcttaanattatataaatggctcaagactatgccttgggagcctagggtccagncttctttgccctcctgagtcctctgaaatagaataggagagaatttatgaccagtgttcccaaatcctancgtaagaatgctaga

SEQ ID NO: 585237 - DNA, 5331 bp, Homo sapiens
  misc_feature (5238)..(5238): n is a, c, g, or t
  misc_feature (5243)..(5243): n is a, c, g, or t
  misc_feature (5248)..(5249): n is a, c, g, or t
  misc_feature (5251)..(5251): n is a, c, g, or t
  misc_feature (5255)..(5255): n is a, c, g, or t
aaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgccaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataaccgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaagggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatcagagcagcaggagggaaaatgaagaaggaacgatctcgtaagaaggattcaagtggatggagagctagaagctctgatggaaaatggtgagggtctctctgataaaaaccaggtgctcagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcattgaagctgagatggacctggggaactccaacatatggatgaaaaccccatgaaggcttcgaaaaagcccaagacagcagaagcagacacnccagngaacnncnaagnaaggccggcgtttccaaagaaagcccggtctcgcccgcgcgtgaactatggaactgctggatgtgggattcccggg

SEQ ID NO: 585238 - DNA, 530 bp, Homo sapiens
  misc_feature (108)..(111): n is a, c, g, or t
ggtgttgtgaaaaccaccgctaattcaaagcaaaaatgggaaaggaaaagactcacatcaacatcgtcgtaatcggacacgtagattccggcaagtccaccacaaccnnnnacctgatctacaaatgtggtggaatcgacaagcgaaccatcgaaatgtttgagaaggaggctgctgagatgggaaagggctccttcaagtacgcctgggtcttagacaaactgaaagctgagcgtgagcgtggtatcactattgacatctccctgtggaaattcgagaccagcaaatactatgtgaccatcattgatgccccaggacacagagacttcattaaaaacatgattacaggcacattccaagcttgctgggctgtcctgattgttggtggtggtgttggtgaaatttgaaccttgtttttccaagaaccggcgaccccggagcctgctttttttggttaacccctggggggaaaacaattattgtttgggttcacaaaaggtttcccccgcccccctttctttcgtaataaa

SEQ ID NO: 585239 - DNA, 5498 bp, Homo sapiens
  misc_feature (5405)..(5405): n is a, c, g, or t
  misc_feature (5410)..(5410): n is a, c, g, or t
  misc_feature (5415)..(5416): n is a, c, g, or t
  misc_feature (5418)..(5418): n is a, c, g, or t
  misc_feature (5422)..(5422): n is a, c, g, or t
aaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgccaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataaccgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaagggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatcagagcagcaggagggaaaatgaagaaggaacgatctcgtaagaaggattcaagtggatggagagctagaagctctgatggaaaatggtgagggtctctctgataaaaaccaggtgctcagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaagcttctcagggcagcaaggagcttgttaacatcaccagctgaccatgtgtctccttttctcaactccatttccaacttcgtgctgaagaaaaacgagaacctagcgtgcattctgtgaagaaacaggaagatggttgggaagttggatgatgcatgaaaaatatataggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcattgaagctgagatggacctggggaactccaacatatggatgaaaaccccatgaaggcttcgaaaaagcccaagacagcagaagcagacacnccagngaacnncnaagnaaggccggcgtttccaaagaaagcccggtctcgcccgcgcgtgaactatggaactgctggatgtgggattcccggg

SEQ ID NO: 585240 - DNA, 334 bp, Homo sapiens
ttggtcagaagccaggaactggtgtcttccttaaaagatacgtgcggggccaggtgtggtggctcacgccctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgagga

SEQ ID NO: 585241 - DNA, 2607 bp, Homo sapiens
  misc_feature (2514)..(2514): n is a, c, g, or t
  misc_feature (2519)..(2519): n is a, c, g, or t
  misc_feature (2524)..(2525): n is a, c, g, or t
  misc_feature (2527)..(2527): n is a, c, g, or t
  misc_feature (2531)..(2531): n is a, c, g, or t
gatgggatctcttcaaggttatggttttatgtttgtattgattattgtttagactggtatgacttttgtgtgtatagccaacagttttgtatggttatacttccacatagctgacttctttcctatgctctttgaacagaaaagaagcccagaaatgtttctgcggatcagccaattgccggggttacctgggaggagaaaacagagtcagcatcagagcagcaggagggaaaatgaagaaggaacgatctcgtaagaaggattcaagtggatggagagctagaagctctgatggaaaatggtgagggtctctctgataaaaaccaggtgctcagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcattgaagctgagatggacctggggaactccaacatatggatgaaaaccccatgaaggcttcgaaaaagcccaagacagcagaagcagacacnccagngaacnncnaagnaaggccggcgtttccaaagaaagcccggtctcgcccgcgcgtgaactatggaactgctggatgtgggattcccggg

SEQ ID NO: 585242 - DNA, 346 bp, Homo sapiens
cttactaacctaatcgctcatacgtaccagtgtcaaggtctacttccccaccatcatccagcacaaaaacctcacctgcagtgaacagagaaaccatttacgttaagtgaaaaatacctataccatggcacaactgcaatcctgaaataaaacactcattaacaaggtgtgcaattacgtaataggaagcacagaaattcacttctagaagactaaatatgacacacaaaaagaaaaattaccagctattctctaaaaggtaacctcatacttctagcctgtcaacaaactcattcttaagaagagttataaaatagcatgggatgggaaggcgattagggttagt

SEQ ID NO: 585243 - DNA, 1585 bp, Homo sapiens
atgctcgcgtcggtcgcctccctactccgccgcgttgttgtcgcccgcccgcagttaggggagctcccccggggcggagttatctcgtcgttccgcaggggtttgtgtctgcttgggtcccgcggggggcgggagagaacaacaagtggtgttcacgcaccgaggggtccgactgtctggtgtggcggccccgtgtgtggccgcccatgttttttgggaggccacccccttttgtgtgacgccccggttgtgtgtggtgcccacgaaatacacacgggcgttgtggtgtgtcccgccggtgtccggggtgatgttttcctcccccggggggttatttctggtgtgcggggccccacagaggtggtggtctcggaagtgatcggtctgtggtggtaagccacgtgggaggtgttgggtgtgctcgtgcccgttccccacccgtgaggagggtgttcgtcgtagtttgtgtgcccccccacgcgccccgctgttttctccggggcgataagagtagtggtgttgtcttctgccgggccgccccctctataaaggcgccgcccgaggagtgtttgtggagaggggggtgagcgaccccccctctggtgatgatgggggagatagagaggagagggatatttttgggaaaaatccgcgggaatattttagtagggggaaagagaaagtgtgtgcccacagaggcgctcatcggcgggctttactagtatatattgttttgtgtggtgagggtttttttattatgtatgaaacagctatgacccttttgtagagagaaaaaattttggggaatataagggtgttctgcagatgttgaatgtgggtggagtatagagtagaataggggtagcacacatcacccaccgctctctcgagagagacgctcgcatagaaatttttataaagatgctggagatgtttccccacatggtagacaccgcgcagcccttctcacagatggtctgtcgcgttgtatagagactgcatctcgtcgaggagagatatctcgtctgtgtgtatagcaccctcggcgtgtcccctcgcgagatattctatacactctctcgcgatatataggagagaatattgtgttccacacagatatacacatctataatatatagggtgtgtagagatatctcgcgagttaaatttggtgtgaaagtgtgttctgtgggcacctcacaagagagagggtgtgttataaactcccgccgcgtgagaagggtgtggagagagagtttatgagtgtgttttctcgcgcccgccgagtgtgagatctcacactctcgagacacacacacaggcgtgaagaatatacttgagagggtcacatttttttttctctttgttgttacacacacgagatgagatgagaatatattatatattttctttcttttgtagatttgtttcacacaagtttgtcccacaaagaaaaacccccacaccccctccaccttctttctggatgataaatatgttagatggccgttaatatttttttttaagagcggaaattaatagctttcaccacattattaaactgggatattaattattggaggga

SEQ ID NO: 585244 - DNA, 241 bp, Homo sapiens
aaaaagtcacaccatttccccaatttaaatcaaagactagacataattaagcttagtgaggaaggcatgttgcaagttgacataggctgaaagctaagcctcttgtaccagttagccaagttgtgaatgcaaatgtaaagttcttaaaggaaattaaagttctactccagtgaatccatgaatgataagaaagcaaaacaccagcatggcacatgtatacatatgtaactaacctgcacaa

SEQ ID NO: 585245 - DNA, 400 bp, Homo sapiens
atctcgaggatcccgtgattcctttgtatctacaatggatcaatactcccttgaacaaacaggatgccaacgaggcactgtttggtgcccagctctcagtatatagaaactaaacttcttggccgggcgtggtggctcatgcctgtaatctcagcactttgggaggccgaagcaggcagatcacctgaggtcaggagttcaagaccagcctggccaacagggtgaaaccccaactctactaaaaatacaaaaaaattagctgggcgtggtggcccacgcctgtaatcccagctactcaggaggctgaggaaggagaatcacttgaacccgggaggcggaggttgcggtgagccgagatcacgccactgcactccagcctgggcgacagtgagactgtctc

SEQ ID NO: 585246 - DNA, 1588 bp, Homo sapiens
  misc_feature (1495)..(1495): n is a, c, g, or t
  misc_feature (1500)..(1500): n is a, c, g, or t
  misc_feature (1505)..(1506): n is a, c, g, or t
  misc_feature (1508)..(1508): n is a, c, g, or t
  misc_feature (1512)..(1512): n is a, c, g, or t
actggaacctcaaacctcctgggctcaagagctccacctgcctcaacctcctgagtggctgggactataggcatgggctgccatgcccaggaggtatatcgaattccaaagaaaagtcaaactgaaaaggaaaacacaagaaatcagcctgaataaatggaatgacttgtctgcctcacatattctaaggtgcagagtcagaatatgaactgttgcaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcattgaagctgagatggacctggggaactccaacatatggatgaaaaccccatgaaggcttcgaaaaagcccaagacagcagaagcagacacnccagngaacnncnaagnaaggccggcgtttccaaagaaagcccggtctcgcccgcgcgtgaactatggaactgctggatgtgggattcccggg

SEQ ID NO: 585247 - DNA, 819 bp, Homo sapiens
aggagagaaaaaaaaaaaaaagaaaaaaaaaaaaagtgttccagcccttttaagggatgtgtttggggcaaggatgatttgccccgggttaaatttgggaaagcttattgtattctttaaatagattgtgggagcattgactctcgaagggatccttttcccctttctccttatttctcctacccaattgggatttctatcctgcaaaaaaagagagacctgtcattagaagcaaaccagggttctcctgattacaagagaagaattgctgtgatgacaatatgggttggctgtatctgctccccactagctttggccattgggaaacaacccaaggggggaacgtttcctcttaaagcaggagacttccattacacaggggacacacttcggcggggcaacaacaagggttcctcacacccaccttggtgtaacatctcagattaaggagtatccagattttttattgcgttaccaattacgggaaaagggggacccttccaagtgggggattcacgtggtcaggagggtttgtaccaaggtgctttcctgggggagaatagatcttggttcgggctaaccaacggggtttgtcccaattgaacagtagtaagcggttgggcggcagttcctcggaaacaatcagcaaaattttaggatggccacaaatccataattcccagcggggtgcattaggatcacctttctctacacactggtcaacaattggagggcaaaaaacgggctgtcacccaagaaacgtggtgttcaggggacccagagtttttaccggataaaaattcccatttagagagagat

SEQ ID NO: 585248 - DNA, 564 bp, Homo sapiens
acagcccaagccaaaagcagtgagcagcagttttacctgaagacaaagcaggtgtttcaaaaaaattgaactgaaccctggaagctagctccatgtcatgagctggtaaattattcatcagcgatgaaggaagagtaattgtgccaatactgttctcaggagcttgggtttccagagaaacctgaaaatcaagtggaagataagaataaatgtctggagctagtataatgagatggaaaacacatctattaagttggtgcaaaagtaattgcagtatgtgccattttttttttaaaaaaagataaaaaccacaattacttttggcaccagcctaataattaaaacgcagggttctgtaaggacctgacctgcggcatctctatgcaaaatagcttctacttctattcctctgggtggctactaaattaaagaaaggaagtataggctgggcacggcggctcacgcctgtaatcccaacacttggggaggccgagtcgggaggatcacctgaggtcaggagtttaagaccagcctggccagcatggcagcagccctgtctctact

SEQ ID NO: 585249 - DNA, 202 bp, Homo sapiens
tgagatactaacagtcctctatagtctgcccacctagtgcagctgcaggactagtgaagagcagtggatatggcccctccccactgccccgacccatggtgagttcgtgctgggtaaggaagaggaagtcagcaaaggacagaggtcaaggaaagaaggaggaaacagagccgctggggagacaggattgcttgttccgctg

SEQ ID NO: 585250 - DNA, 189 bp, Homo sapiens
tcattagcattttattgaatagaatttcccaggcaatagtatcttttaaaaagctttcaaaaatatgtaatttcaaaataataggaggatttctgtaagaaataaactaactaggtttgatagtaaagtacaattttataataaaatcagcactaacaaggtttaaattgaacaaaagatgaaaaataa

SEQ ID NO: 585251 - DNA, 583 bp, Homo sapiens
aattttgacgcgttctcctgcctcagcctcccaagtagctggggctataggcacctgccaccatgctcagctatattttttgtatttttagtaaagacggggttcaccgtgttagccaggatggtcttgatctcctgacctcgtgatccatccgcctcagcttcccaaagtgctgggactacaggcgtgagccactgcgcccgactgaatactttttatttttaggaagcagttaaagttagtctatgtctcagtgttttttataaatgcattgagagacgtcttgaataatgttcaccaaatgctaatggtagttatttttggggaaatgggtattaaggtggcaattaaaaattttttttttggcctggtgctgtggcttatgcctgtaatcctcctcctgccttggccttccaaagtgttgtaattacaggtgtgagccactgtacctggctcaaagcaacagatttggataatagataggagagtgtgtacatcaaagatactggcaggatttctagttaacgtgactgggtgtgatgatgggaactctactacctacagaaggaaacatgggaatggg

SEQ ID NO: 585252 - DNA, 97 bp, Homo sapiens
  misc_feature (23)..(23): n is a, c, g, or t
acatgcgaactggactgatcaancactggtgcttgtctgtggcttgcaccacacattgtaccctggtggcatttgcctgacatgtgattgcagaatg

SEQ ID NO: 585253 - DNA, 594 bp, Homo sapiens
ctggttgtcaatgaggatatttattggggtttcatgagtgcggtgagaggctggagggtgctaggcccgtgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaa

SEQ ID NO: 585254 - DNA, 155 bp, Homo sapiens
attatactaacgtgtagtgttgtgctcgtgtgtgtgctgtgtcatgcgtgtgctgtgtgttgtgtgtgtgtagctgcggggatgcataaagtgtgagtgctttttaggatgggaattgaggtggaagagtttgtggaggggttaggtctacctgg

SEQ ID NO: 585255 - DNA, 676 bp, Homo sapiens
tctaccccgtttgctgtgtcgaagtgtcattgtttattccctgtcgctgtcgtgaacaaaaactgtatggaatcaacaccaccgagctctgtgggaaaaaagaaaaacctgctcccttcgctctgctggaagctggagggtgctaggcccgtgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaa

SEQ ID NO: 585256 - DNA, 233 bp, Homo sapiens
gcaggatggatcactgagtcaggagtttgagaccagcctgggcaacatacagatgtctacaaaaataaaaattgcaaggtgtggtggcatgcacctgtagtcccaactgctagggaggctgaggtgggcagattgcttgagctcaggagtttgagaccagtctgggcaacctggcaaaaccaaaaatacaaaaaattggctgggtgtggtggctcatgcctgtgatcacggca

SEQ ID NO: 585257 - DNA, 934 bp, Homo sapiens
  misc_feature (8)..(8): n is a, c, g, or t
  misc_feature (12)..(12): n is a, c, g, or t
  misc_feature (16)..(16): n is a, c, g, or t
  misc_feature (76)..(76): n is a, c, g, or t
  misc_feature (105)..(105): n is a, c, g, or t
  misc_feature (110)..(110): n is a, c, g, or t
  misc_feature (126)..(126): n is a, c, g, or t
  misc_feature (139)..(139): n is a, c, g, or t
  misc_feature (141)..(141): n is a, c, g, or t
  misc_feature (145)..(145): n is a, c, g, or t
  misc_feature (157)..(157): n is a, c, g, or t
  misc_feature (159)..(159): n is a, c, g, or t
  misc_feature (190)..(190): n is a, c, g, or t
  misc_feature (195)..(195): n is a, c, g, or t
  misc_feature (201)..(201): n is a, c, g, or t
  misc_feature (219)..(219): n is a, c, g, or t
  misc_feature (245)..(245): n is a, c, g, or t
  misc_feature (253)..(253): n is a, c, g, or t
  misc_feature (258)..(258): n is a, c, g, or t
  misc_feature (260)..(260): n is a, c, g, or t
  misc_feature (283)..(283): n is a, c, g, or t
  misc_feature (295)..(295): n is a, c, g, or t
  misc_feature (318)..(318): n is a, c, g, or t
  misc_feature (344)..(344): n is a, c, g, or t
  misc_feature (351)..(351): n is a, c, g, or t
  misc_feature (498)..(498): n is a, c, g, or t
  misc_feature (613)..(613): n is a, c, g, or t
  misc_feature (742)..(742): n is a, c, g, or t
  misc_feature (794)..(794): n is a, c, g, or t
  misc_feature (931)..(931): n is a, c, g, or t
aattcaantganacanaagctttggtcctggctctcggcccgtagttgtagaaggagccctgctggtgcaggttanaggtgccgcatcccccggagcactcgaantggangcggaaagaaaagganggcttgcggctancnggangaagctttggancnggccaaggcaaaaaaacccaaaaagctgaanaccanaaaaanaaaatcaagggttggcangcccttgttggaacgaaaaaagcacnaacaaaantaaananaaaagtgagtgaaaacaaaaagntgttccaacganaatcaaaaccaaaatggaaaatntgtgtagaaagaaagggaagaagaanaaaaaangtatgtagctaaaaagcatgaatagttcgaagatgactctgatcctcctcctaagaaacgtgctcgagtacagtggtttgtccgattctgtgaagtccctgcctgtaaacggcatttgttgggccggaagcctggtgcacaggaaanattctggtatgattacccggcctgtgacagcaacattaatgcggagaccatcattggccttgttcgggtgatacctttagccccaaaggatgtggtaccgacgaatctgaaaaangagaagacactctttgtgaaactatcctggaatgagaagaaattcaggccactttcctcagaactatttgcggagttgaataaaccacaagagagtgcagccaagtgccagaaacccgtgagagccaanagtaagagtgcagagagcccttcttggacccagcagaacatgtggccaaaangattgaatcaaggcactccgcctccaaatctcgccaaactcctacccatcctcttacccaagagccagaaagaggctggagcttggcaacttaggtaacctcagatgtccaacagacttcatgtgcctcttggattntca

SEQ ID NO: 585258 - DNA, 1092 bp, Homo sapiens
  misc_feature (699)..(699): n is a, c, g, or t
ctggttgtcaatgaggatatttattggggtttcatgagtgcggtgagaggctggagggtgctaggcccgtgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaaaaaaaaaaaaaaaaaaaaaaaaaaaaaaaaaaaaaaaaaaaaaaaaaaaaaaaaaaaaaaaaaaaaaaaaaaaatttaaaaaaaaaaaaaaaaaaaaaaaaaanattttttggggcccccttggccccatttttttttaatttgggcaaatttttggctggggcccaaatttggggttacttggccaatttcccctttaggggggggaattaaaaataacgggccggggttttaaaaggcgggaagggaaaaaccccggggtacccaaattaaacgcgttggggaaattccccttttcgcagggggggaaaaaaaaaaaggggcccgcacgagtgcccctttaaaagatttgccacccctgagggggaaagggaattgaacggcttaatttttgtgaaaatctccggttaaatttttttaaaaaaccttttttttaaacccaagggcggaaatggggaaattctttttaaataaaaaaaagcggggccccaccgaaa

SEQ ID NO: 585259 - DNA, 1174 bp, Homo sapiens
  misc_feature (781)..(781): n is a, c, g, or t
tctaccccgtttgctgtgtcgaagtgtcattgtttattccctgtcgctgtcgtgaacaaaaactgtatggaatcaacaccaccgagctctgtgggaaaaaagaaaaacctgctcccttcgctctgctggaagctggagggtgctaggcccgtgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaaaaaaaaaaaaaaaaaaaaaaaaaaaaaaaaaaaaaaaaaaaaaaaaaaaaaaaaaaaaaaaaaaaaaaaaaaaatttaaaaaaaaaaaaaaaaaaaaaaaaaanattttttggggcccccttggccccatttttttttaatttgggcaaatttttggctggggcccaaatttggggttacttggccaatttcccctttaggggggggaattaaaaataacgggccggggttttaaaaggcgggaagggaaaaaccccggggtacccaaattaaacgcgttggggaaattccccttttcgcagggggggaaaaaaaaaaaggggcccgcacgagtgcccctttaaaagatttgccacccctgagggggaaagggaattgaacggcttaatttttgtgaaaatctccggttaaatttttttaaaaaaccttttttttaaacccaagggcggaaatggggaaattctttttaaataaaaaaaagcggggccccaccgaaa

SEQ ID NO: 585260 - DNA, 914 bp, Homo sapiens
  misc_feature (599)..(600): n is a, c, g, or t
ctggttgtcaatgaggatatttattggggtttcatgagtgcggtgagaggctggagggtgctaggcccgtgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaggatnngatgctttcctctcacgcataggctatgcttactatgaccttccaagttcgactctgtataacatcactgctcaaacttctgtcaccctaacttcgtactcttttccgatacgcactctcgccggcatgacctcagggctcatgtggcattgacgtaatgggcatctgcaatcgacatgtattaatcatctcccatagctgggcacacgtggcgttcaatcttgccattggttccctgcacagtcattcaccatcgatcccggcgatcacccagcatagctccatactctctgcagtaccattgtgccgcttga

SEQ ID NO: 585261 - DNA, 163 bp, Homo sapiens
  misc_feature (43)..(43): n is a, c, g, or t
ccttatggctttacagagcaagaatctgatgcagactttcaanataatgaaaatttgtacagtttaaacaacagctgaaagaactaaagaagcaatgtggtcttcaagctgacagagaagctgacggaacagaaggagtggatgaagatataattgtgaccca

SEQ ID NO: 585262 - DNA, 991 bp, Homo sapiens
ctggttgtcaatgaggatatttattggggtttcatgagtgcggtgagaggctggagggtgctaggcccgtgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgagcatcatctttcctttccagtgaaaaaaaaaaaaaaaaaaaaaaaaaaaaaaaaaaaaaaggggggggggtaaaaatccccggggggccccttcggccccttttttggaagggggcccccataagaggagaccgcaaaataataacgcacgagagcgagggcccggccgttttaaaccaccggcccggatggggggaaacagcggctccccgggacaccctttgggagaagggacccccaacactccggggcggggcgacacataatttggggacagaacacaccctacaagagatttaaacgcccacaggggaacaacataaacactttccaaagtgtccaaccgggggttacccacacgcgccaatagcccgccgctgcaaacactgggccacaagggtatcatcacgaccatttactctgagccgtacataaaga

SEQ ID NO: 585263 - DNA, 290 bp, Homo sapiens
catagcatctctccccgccatacacgcaatgcctctttgatgacaggtagcctagagttatgtgcccttaggacaccaacgcacatacctctctgtccatctcgctcctttcttcaattgagacagggtctttcacgtcattccagaatatggaattgcggtctccactctcaaaaatcacactgtactgatctctgcatcctgcctcttgcatccagtcacgtacgttcccctggtctttgaaaggctgtttctctggaatatcccactcgtcactgttcgtcatatac

SEQ ID NO: 585264 - DNA, 135 bp, Homo sapiens
  misc_feature (79)..(79): n is a, c, g, or t
atctcggtttacggatgatataacgtgaggcacagagagaggttacagaacttgaacaaagttatacaaacagtaagtngtagagataagagtagagcatacatcactaaactcaacattacacacacttaaatg

SEQ ID NO: 585265 - DNA, 977 bp, Homo sapiens
ggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcctggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaacgggaaaaacaaaagacacaaaaaatggtgcgaaccaatgggtgacattacgtcatagtgtctataatccatttctcatgtggggcacgagctaagcgcgtgctcgcacgaaaccttaaccattgtgctaacacgtgcctctcaatttccgggccctcttggtccaaagtgttcacagcgtttcacctgttcacaaaaccccattttcagagttacgcggaacagtgcaattctactagtgcgggctccaggtgtgcctcccacacaaacatctagacccttgatgtgaagcacaccccaaacgaaagttcaccccctctaaggggcatcattgactacgacaccgcgaactacgcctctagtgcaacagagcctctccccacggtttcacaggatactcgtacaggctcccataataaaaagcggcgccactcatgtgacccgccgggcattcaccccgtgagaatgccttgcggccaccttagaaacccccccaagcttacgaaacacaacagctcgctttgtcacataggctcctgaccgacccattgcgggacggaaccgccctccaccctatctcggcgcggacacgcaccctcttttatcttcctccgcgaacccccttatcgcgcacaacaccctgctcgcgctcccg

SEQ ID NO: 585266 - DNA, 366 bp, Homo sapiens
  misc_feature (21)..(21): n is a, c, g, or t
  misc_feature (50)..(50): n is a, c, g, or t
  misc_feature (74)..(74): n is a, c, g, or t
  misc_feature (128)..(128): n is a, c, g, or t
  misc_feature (213)..(213): n is a, c, g, or t
  misc_feature (244)..(244): n is a, c, g, or t
  misc_feature (275)..(275): n is a, c, g, or t
  misc_feature (298)..(298): n is a, c, g, or t
  misc_feature (306)..(306): n is a, c, g, or t
  misc_feature (359)..(359): n is a, c, g, or t
ggaggagctggtggtgggggnttcgagttcgcagccaagtacagtgtttnggccctggagacacagccgcaganacccccttttcatgcatggacctcaccctacggtcagccttgctactccagganttcggtttttccaggagcaaagtgctgaagctcactcggaaaattgacaatgttgagaccagctgggctctgggggccatttttnattacatcgactccctgaacagacagaagantccagcctcatagtggccgagcatccctgtncccgtcagcagtgtctgtttgtntgcataanccctcctgtcctggacgtgacttcatcctgaggagccacagcacaggccgtgntgggcac

SEQ ID NO: 585267 - DNA, 129 bp, Homo sapiens
ggtatgtgttgatgttgagcatctggccactgggaagcatatggcccctagggcactgcctttgttggaaaacggcgtccagattgttgtaatgttttgaggaattaaactgttttgtttagaagcaga

SEQ ID NO: 585268 - DNA, 458 bp, Homo sapiens
agcggggtttcctgacatggtgtagtgcaggcagggtggggaaaggacggggaaggactcgtgtgctgcgagctggcggccgggccggagtgctggggctattgaactccgagaggaggtggaccagaacttatggaactagtgccggcggctcatccactcccccagtataaaagaacgtgtggatcactgttgctgagttacatccaagtatttgagagggaagctttgggacaccaggtagaaattcaaggggctatttatagagccgtggcattttataaaagatatctggtgttggaatattgccgcctgacaagagtaatagaagatgatgagtgatgcaagtgacatgtaggctgcagcgttggagcacgatggatggtatcatgagcaggttctaaggctctggaatattccagatgggcatttcagattgccaatctcccagcctctcc

SEQ ID NO: 585269 - DNA, 713 bp, Homo sapiens
ctcagccccatagcagctatgatcccgctgctgctggcaggcgctgctgtgcgtccccgccgtgggccctgacctgctacggggactccgggcagcctgtagactggttcgtggtctacaacgctgccatgctcttagagggtccgggggagggcggcgcagagatgggctgcatgtacaagtatctgtgacgagatgctccggaggctggcgggacggcatggtggcactcatcaacagcccgtgatgttggggcctgtgggccgaagcctgcatgccgcttgtacctggagcaaacaccaggccatgactcgccatatccttgcctcgtaacaaattgaccaaaacgacacataccaaacccaagcaatggctcaggactcttaccattgcgtgggcacacgaagggtgtcctgctccttgaccaccgatgggtggcttctggctggtccacagtgtacctaacttccctccaccggccctcctcttgcttgcactacacagctgtgcctcaatagacgcctgtaccctacggtgctagacccttgattctgtgttgtctatttcccattcagaatcaagtctcgaaagatgggcaaagcagtttgaactaaaacttaaccctggggtcatataaactaccaagcttgcaacggcatctattgccccaggcaattccccgacttgcaaacatgtgctccaaaggcgcacca

SEQ ID NO: 585270 - DNA, 430 bp, Homo sapiens
atttttcccctaaattgtgactctcaccattcggcttcttatgcacggaaaggaagtagaagcatcattgggaagaaaggggagtcaggttaagacagatccgcgatggagagtggcgcgcggtatcaagcatctcgcgaggggccattgtccaggatgagaatcatcactactgaccaggccccacctaatgccttactttaagcgctttcgctcatgatcattcgacaacgctggagagaagatatcaacagtctccagtgaccaatcagtacacgctggccagcatggcccccaggtcaccctgtaggcttggtggttgccggccacccatgtgcggctcccgtgattgggacaaggcgggtgtaagatcaaacgagatccgcgagaggtacgggggcgcaggtccaggtggcgggggatatgctgc

SEQ ID NO: 585271 - DNA, 323 bp, Homo sapiens
tatgcacaacctagggtcagtcttgcaggtggtaagccatttaccaagatagttgtaggtaaagaagggcagatttattagagaaatgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcta

SEQ ID NO: 585272 - DNA, 183 bp, Homo sapiens
ataactggtcctggttctttactagacagtaattcgcaggacaagggtccgtctcaaaggcctcagtaagaatcagtgtattagatatctagtcaaatttggtcctcctatgacctctgagctggctgtaatggctcatgcctgtaatcccagcactttgggagaccgcgcggccaggcagaa

SEQ ID NO: 585273 - DNA, 184 bp, Homo sapiens
tacgcacacgcgctttcttccagatcgtgaaacactttttagctcccgcgacttccattgctccggagggaccttttttggtacagtcatagttttgtttaggcttactttttcttgtcttacatgtgtggcagtatttttaaagaacttccacatcaagtatttttcctgtatctatacttga

SEQ ID NO: 585274 - DNA, 733 bp, Homo sapiens
gcttgctggtgtacttcttgtcttcagttaagtattcatttagcaaatatccgagtacccactgtgtgtctgtcagtttgcttacgcttttacagaccctagttttggagtttcatatgtgtcacgtgaagttgttttttgaatcttttagcttttatattataacgctactgcaatgaaatccgtaccagaaggagtttggtggtatgaaacttgtgtatttgttcaggattcttgtgacatttagacgccatttgaaaataagtatagttgaaatgtcaagattttctagcgctgtggtgataaatcatgtggggtaataccttgagatttataaatggacaatgtgatgtggcatttgtttgaaaatacttgattctgtgctggactggcttggtgaaaagaatggaattgggacttttctgtgcaacgttatgtaagaagttggggaactgtgtggtttcttagactaggcttttaaattcactcacccttgaaggggtctcttttgaatttgtattgctaggtagtattgcctatgcttacaaaacagggaatttgtgtctttgctgccctcatttagtagatattatactagcattgaccatctcacttctaggaatactagttatatcgctacacacctcatatcctccgtactatgcctaggaaggaataatactatcgggtgttcagttataggtaatcttccataaaccctcagacccgatcc

SEQ ID NO: 585275 - DNA, 704 bp, Homo sapiens
  misc_feature (366)..(366): n is a, c, g, or t
ccagatttatgaactagtcttatgctcttaactagattagttccttttccattaactgcttaaagtaggacagctgtccgagctgttggttgtaaatttgccaatgtctacttccttaatctcagatacaaaaagcagcagataacaggatcaaagtttcaggaccttcgtttttcacagcctgaaatgagcatggaggggctcatgaatgagagattgaaaagatgtgaggaagtgttacattggagaaaaagggatgacttctgtcattaatcttaattaattgctaagagttttaaatctgagttattaatactgatgttaagctcttaatacacttttcatgctctggcatcagatactctnttatgagataagaagtttaggaaggagagaatgtgtgtgtgtgataaaatattttcatttacatatttcaaatatttccttgggttaatattcagaacttcaccttttgacagttactgtagggcagttaggaatgatagacaagtaccaatacattcaaattccctaaggatagcaacagcagtcaatctgaatataatacctttatgtttaccagcctatagatcatcacgttgatagagacagactatcactccccacctctccacatccctgctgcccgcttggcccttcgcctttgactcaccaagcttatcatccgcgcccttggctccttt

SEQ ID NO: 585276 - DNA, 259 bp, Homo sapiens
  misc_feature (42)..(42): n is a, c, g, or t
actcttaggatccaatcgcacgacatgagcactgcgcttggnttggatcacacaggactgtgtgtctgagtggtggactgagatgcccgtactgttcttgggatacagcacacgggctcaagaatgagtctaatggcgaagccctgaagatccacttgtcttctgagaccaaggctgtcctggaggagttaggtggttcggagctggagcttcgaggcgatgtagagatgaaggggaaaggcacggttcggacctactc

SEQ ID NO: 585277 - DNA, 101 bp, Homo sapiens
ctttgagcaggacttcttctgtggttcagaacaaggcctatatcatattgtcaaagtaagaggtctgctgcttaaaaagaaaaaaattttcttccaacaca

SEQ ID NO: 585278 - DNA, 359 bp, Homo sapiens
acaaagagaactggtctggagtgctgtaggctttgtttcaatattttttacaaaaaaaacgattgtgtacacgcattgtctatatggatttcaatgatcattcgatgtgatccagaataaatatgctatggttggtttgttatgaacagatggccaccagtcacggccgtgctgtgtaactcctaatatctgcagtccctgggtgtcgcgggtggccagtgcgcagactgagtacgttgccatccttgggaacccttactagaactcagacctgtatggctaagaaaacatggtcctaccttaggaagaggtctacatgctggggcatattaagagcataatatatcattctggcccgg

SEQ ID NO: 585279 - DNA, 482 bp, Homo sapiens
gacctttgctggtgtatcgtgtgcggccgtccagaagcatgatgacagaggatatactgtcgcttgcagaatgatgggctgatactggcttttgatccaaggactccagtatggctaagcagtacaaagtgtactgagttggggtagtagataaacttggtgtcgttgtaaattagcaaggataggacattgttaaagacaaatccaaactcatctgggctgttccacagtgtccagtgccagggtgtgtagtcctgtggtcagagagggtgccatggtcgatgtcagggtggttgtgttcacaactttacacacattgacagattctttgccattgaattagactcggctcttgcctcctccggagggaggcaagagccgaggaggagagcaactcggacgaagatgacgtcatccccgacatcggtggggtcacctctcatgccctcgctcactgcagaccctggactcgaatctgtgtt

SEQ ID NO: 585280 - DNA, 336 bp, Homo sapiens
actgtcgtcgtagcaagtctttggagctccttagtgtctaggatagttcaaatgcacatttaaagatactctcatgattcagttagtttaattttaaaaacataatagtattcatcactgtacaaagtacagaaagtatagagaagaaaatgagaagcacccatagtcagccatgtaaggatcaaacctgatactccgggtttctgtggattcctccattcgtgtgccgtgcgccccagagctggcgtcttgctgtaggacactgtttggaggtttaactgactctgtgctcatgcttgtttgactacctggtttcatttctctcttgccatctca

SEQ ID NO: 585281 - DNA, 150 bp, Homo sapiens
catcatcattccccagctacgctgcttggtttgactacaatagtgttcatgccattgagcggagggtctccccgagttcttcaacggcaagcaaaagtccacgcatccagagatctacccgtggctagtcctcctggcctaccggagtac

SEQ ID NO: 585282 - DNA, 219 bp, Homo sapiens
cgggggagttattcatctctaagatagagaggctgatggctactgtggacacagaaagcaagtttctgaagtgggtggccgccatcaaagccgccttggtcagggttaatgtgccctgagggcagagtctaggaaccttgacccagcccgtctcagcagacgcttcatgataggaaggactgaaaagtcttgtggacacctggtctttccctgatgttc

SEQ ID NO: 585283 - DNA, 185 bp, Homo sapiens
catttagtactggactatagggttaaggtgacagagacagtccatcaatcatggggttgggacacggcgactgaagtacagggtgctgggctggatggtgatgggagcaggtaatgtggcatatacctaaaaagaaggagcctctgtagcctcctagaagggctgtggccaaaaggtcagagggg

SEQ ID NO: 585284 - DNA, 244 bp, Homo sapiens
cctatctaggagggggattccaccagtacggtggctgctcctctcatatggtgaggtgttcttctgcataagcagcatgctctacagaatagcctcaattcaggccaaatataatcttaaccaaaagtggtagttaaacttccagcttcttttaataggacctttggcttgaaaaccatttcatgcacaacataagatttttcttctccagacagcagtatgtatctggcactatgtgctcagc

SEQ ID NO: 585285 - DNA, 296 bp, Homo sapiens
tcacggggaaatcaatctctttcctaagggcaattgttgcgggttaatttgaactactttggtccatcccttacggaatccatgggtgacggttaggagacccccaaaaaacattcatttgtgccccttggctaaaacgtttgtgacagactcccctcatggggccaaaggcgggccccgttttttatgggaaggcctgggtcctgactatcaatcaatgttggccattcttcccagatttgtaagcacatcattggtaatgcccttaattgggccactaaaacctgcccgatact

SEQ ID NO: 585286 - DNA, 1249 bp, Homo sapiens
  misc_feature (122)..(122): n is a, c, g, or t
tctttgggagagtggggaaatgggcttacagtttcaaatggtttatgtggaagtgggaaagtgtgactaagctcgaagaagggaagagagggacaaagaaggggaggaggtcacccctaagngggaacctaccaggacattcaaagcaagagcagtaagttctgaatgttctgggacaacctgggtgatatgcatggatatgggctgtggaggctgagcattttaatgataacttagggaaacgaggcatggccatggtgtaaaactctcaaatcccaagccctaatccaaccttaaaatccgagtcttctaaagggctgttttaaccatgaaaggaccataagaaaggcaattcacagaaaatgaagccatgtggccaagaaatataagaaaaacagtaaaagcccttaatctcaatagcaatagagtggatgcaaatgaatataatgagttgccatgtcgttcttactggattggaaaagaaattagaatgtctaaataacatgtatcatccaggatgtggggaaatgggagctcttgtaccctgcaggcaggcatttaaattggtgcaaccgctttggattgctgctttgtagtatctggtgcaactgaagatgaacatgccctgtgacacagcaaccgcacttctaggtcaataccctaattatattcttactgtggttcacaagaaggtatgtaagaggtcattgcctgagcactgtttagaataggggcaaactggaaatcctctaaatgtctgtcaatgaaggaatagataaattgtaatatgttcatataaaatactgcataaataagtgaaatttataaatgtactaacgaatgaatcttgaaaacagagttgggagataaaagcaagctgttgaagaacatggtcagtatcctctcacttatgtaagttaaaaactccaaagaacattatctatattggtaatggcatagacatgtgtggtaaaatcataaaaatattaactaaaagttctatacgcttcagggatattggttagtataataagggcaggaagctggatagcattgggggtgagacaggtgggttggtgggttaatgtttggttactttagtttatgttaagtaacattttttttttaaaggaaggatctgggaataaatttttggttaaaatacatagttatttggctagacttgattgttgggggtctggggttcatccactatttctaaggttggttgacggttaaaattttgttg

SEQ ID NO: 585287 - DNA, 417 bp, Homo sapiens
catacccttagtcgttttcgttatagcactgagttaggcacctggccagaggcggacatgcaccacatcgatcgagataatacccatggccgctatgtcttgtgtcattgatgagatcctgctcaagtatgtcaagctggatgcctggattcgggattggaaaaaccgggtacggcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacgtatgaacaacagtgca

SEQ ID NO: 585288 - DNA, 591 bp, Homo sapiens
taggtgaaagctgagtcacgggagctgggtgggaggaggcgtgtacagcaagcagtgaaggggcaggaggtaggcacaccatgcaggcaggggcagggctgcagccagaaggccacagagggggcgggaggccagagggcgaggtgtgcttggtgcatggaggtcaggcccctgctgggagtgcaggtgcagagggcagctgatgaagcaggtccccccgccagatgccaaagacacagtgacgccaggggaagaggagctggcacaaggtcaaggtcgagatcttgccgaggtggctctgacaacccagtctccatctcagccttttttttgtttgttttggagacggagtcttgctctgtcacccaaagctagagtgccgtggtaccatcacagttcaccgcaatctccaagtcccagggtcgagcaatcctcctgctttgggctcctgagcagctgggactacaggcagcacgcgaccaggcccaggcatatatatatatttgggtaagtaggtctgtcccggtcgttagtagagtcaatgtcgtgactatgtgtgccaggctgctcttaagctcctgtgttggagca

SEQ ID NO: 585289 - DNA, 827 bp, Homo sapiens
ccacgcgtcgcggacgcgtgggtcgacccacgcgtcggagggaatcactggtgctatagaaattgagatgcccccccaggccagcaaatgttccttttgttcaaagtctatttttattccttgatatttttctttttttttttttttttttgggggatggggactggtggattttttactaaagggtggcttatttaaccttggggagggagagctgtggtggcgggctccagcccaggcccgtggtttcatctttccacccttctctccacctggcctcgggcttctacagggcctctggtctccgacctctctcctctcgaaaccctcctccacatgttggcacgcccatcctccgggtcccatcctagtctggtcctggctgtcctctggtcccggggtttcaagagacaaatttcccaaagcacaaacgcaggttttcccccctagggtgtggggaggaacgcaacaaagacctctggtactctattattgggatggttcgtatacaatatattccggacagatggttttccgacaatccatttatggaactggccgggaaacattaaccggcccagtggtggccaaaatgtggacccaaggaaaagcaaaccaacgcaccacaaaccaaacaaacaccaaaagacacaaaacgaggggcggcggcgccccgctaccatacgaagtaacccaccgcgcgagggggcgccccacaggctctaggagggacaacacccagcagacgttcttgtgactcagaccagcggggggcaccccacagaagacacaccgagcacacaagacaacgccacagcacgacggcc

SEQ ID NO: 585290 - DNA, 169 bp, Homo sapiens
ttgggttttttaaaaaaaaaggatgggattggatttcccgagggggggaaaatttttttggccccgcccaagggccccccagggaggggcccggtttgggttttgctttgtagggtgttttgcagggattggccggggcctttgttttaaaaaaaaaccctttttccta

SEQ ID NO: 585291 - DNA, 1580 bp, Homo sapiens
  misc_feature (171)..(171): n is a, c, g, or t
  misc_feature (404)..(404): n is a, c, g, or t
  misc_feature (571)..(571): n is a, c, g, or t
  misc_feature (832)..(832): n is a, c, g, or t
  misc_feature (1114)..(1114): n is a, c, g, or t
tgcctcatccgcatcatatatttcgtttgctgtgtgcgtgttggttagtctgtattagttccacctgtttcttcggcccttctgtttttggggttgtcaccacgagtttgggtgtgtgttcttgccatcttttgttgggtgtcgctttttcgcccccagatgatccttctnctccactctatatggaggggcgcccacagacccctggcggggcaagtacctcttaaagtgtcgttttaatcccttctttggcggtgtgtgttaaccaaccccctagaagggaataacttcatttttcggtggggtctacacactctgggtcggtgagaccaccccacatctcgctgacccacgcttgatgtcggcccctgggagattgtcttttcccccgcccttgtttattngtgtccgccccgccctcctttgtatagccaccaatatcatactgccccccctttttccagagcgtgtggcgccgtcttcgtgttgcggcgacgcttgtttgccaagagccgagcaaattttagtggggagaaagtagtattgaagaagatgggcgccactatgttgngggggccgccttctcgtacagaatttcacacaagaagagttggtggttttgttatgaaaaattgtcaactttcaaccgcgccccccttggggggccgtttatattaaccccccctcgggtttcggacggccctcaactggtgagaacacccgcggcgggtgtgtcctcttctcacagctatgtggggttgttttctgttgtcaaagcacgcccttcgtcttggtctttcgctcctctgagaaggcccaccatctggttgtngctcgtttgtgaagatttgttagatggttaaacctcttcttttaggacttcgtcgtctcacgacccgcctcgggctcgtcttctcggtgaaccccacacacacagggggccacaccactctctcaaaaagagccccccaacagggtgaacacacagaggtgtgagataaaaacttcttgtggggtgtcccacagacactcccacggtgtgtggtgtctgcgcacactgtgtctctgtttctgtccccacagtttcacagcctctcccgccacaaggtggccntgtggggaagaacctgtgagagcacagagatgttttcacatatttggcccctgggccacacatgggctgagaaaggccacaggccctctcacaagtgcaccctgttgaaccctcttggcgattctcccacagcacgctttttcccacagagagagaggcacagataggggcctctccaccacacccccgggtttcttcctcgctcgccttccttgcctctgcttgcacagctgccacaggcactttctctgagaggggcacaaccttggaggaaagggccacgggaagcactgggaattttaaattgtttcactcacaccctttccccgctggcacaagaaaccacgtcacgtccttctttcacggtcgttctttctggagttttctggtgaatggaccacagaagaaatctttttacagatttccaattatgttccaccaataaaaattgccttttttattttga

SEQ ID NO: 585292 - DNA, 824 bp, Homo sapiens
cacagtggctcacgtctgtaaccccagcaatttggaaggccaaggtgggtgggtcacttgaggccaggagttccagaccagcctgggcaacatggtaaaacccgtctctactaaaaatataaaaattagccaggcatggtgacatgcacctgtagtcccagctactcgggaggctgagacaggaggatcacctgaggccaggaggttgagactgcagtaagctacgatggcaccactgcactcgagcctgagcgacagaatgagaccctatctcttttttgtttttaaaacagagtcccaccctttcgcccaggctggagtgcagtgtcacaatctcggctcactgcaacctctgcttcccaggtccaagtgattcttgtgcctcagtctcccaagtagctgggatgacaagtgcattgccacggtgcctggcctgagaccctgtctcaaagtaaacccaagggctctgcgggatttaaggagggtgtaaagtaaagggtgcctggagggacggctggggtgccacctgattgcccggacttttacggaaggcaaatcacagttggacgtacacgctcgggatccgacaacgagctctgtccacatcggtgacaaccgattttttcactacaaatccaaacctcagcccggacacatccggtatgccctgtaaccacactatctagaggggaacaaggaaaatccttcacccccagaatgcattgtatacccgatttcggcctgccaccatccggtaaccaatggatctttctcaaaacaaacatcacatgtctgcgcgcccaaagagttacctatttgggcgc

SEQ ID NO: 585293 - DNA, 247 bp, Homo sapiens
atttttaatttttttttttgggcctaggctgggtggggcctctacaggttcattctttcccccttaaataggggcccttttcaggattttccctcttcccccttataaattatgctaaagcccccaagcccctttttgggggtcataaaagggtgggggtcccaaaaggcctttgtgtgatgggtccctttatgtggggtttccccccctgctggattttccgttttttattaaaagaacccaatga

SEQ ID NO: 585294 - DNA, 135 bp, Homo sapiens
atgtggctacagaggcgcgatctctgatatgctggatgactcttgaaatgaagcctttgcctttgttacacatttggctttacaatcttcattgacaaatagttcggcaaagagtagaggagcacggccacgaag

SEQ ID NO: 585295 - DNA, 111 bp, Homo sapiens
atcaaagctaaaatttatttggtgcatactcctcttgatatcaggtatgttcgcatatacctttccctcctatgcggattattatccatgtgaggtattttacaggccttt

SEQ ID NO: 585296 - DNA, 127 bp, Homo sapiens
tcccgatggcattccatgcagtagttcatggacggcttccattgctgtatgaccgaagcaggtgatgtgcaatgatcctgtacagccagtgtggggatgtgatgagtggccctgggccagacaaccc

SEQ ID NO: 585297 - DNA, 513 bp, Homo sapiens
caattggcggtgagcatcgcacttatctgctttattttttgcaaggctgcataatttttgtatgtaactatttttcagaacaagtcatcgaggttctctaaataaataaaattatgacgattcatttggaaaaaataaatattttaaaaatctgttgtagatagactataatacagatgaagagaccaaaatgaatttgtcccagatcaaactaaacaagaaggcacatgtttatctggaactaagtatttgttcctgttgatgtttttgtacactagatctgagtgtctgatagacaggtggatggatagatgggcggacggacagatgggtggatggacagacaggcggagggatggatgaatgcacagataggcagacagaaagataattggttaactacaagacatcttgttgttatatatattttgttgtatatatttacatgtaacaataatagctctatttcaaaattctagtgtaaaggataagaattaaaaggtggctgggcac

SEQ ID NO: 585298 - DNA, 155 bp, Homo sapiens
tgggaaattgaagcggagcaggcggagtgcagacaggcccatcttgcctagtccaagtacagaagctcattactttatcagtgcaacgatgcacccacaaagtaaagagtttgttatataaccccaaacgggtaaatctcgaggtctgctatcct

SEQ ID NO: 585299 - DNA, 297 bp, Homo sapiens
gaggacttccgaatagctacaaaatgagggaatgtcacagagaaggcaggtggacacatggttgacaaagcgatagttgtgtgatggaagttgtcacagtgaccatcttaactaacccaccaaggtagcatcctgctaccaagaaaaagataatggcctcttagacatggtcaatgtggtagaacgggtgggtgcacagatggcagtaacaggggtctataggccagtgcgagtttaaacaaattgcattcagccagaggcaaagattacaaacaagctcatttggtagctattcgg

SEQ ID NO: 585300 - DNA, 265 bp, Homo sapiens
cgctgacatcttccttatagacttagaaagagaagacccacgagatatttagtcccctatctcccaaccatgccataataaaaaaataaaaatatttgctggcttggtggcaagcacctgtatcccagctactttagaggctgaggcaggagaatcacttgaactgggaggcggaggtttcagtgagccaagattgcacccctgcacttcagcctgggcaacagaatgagactctgtctcaaaaaagggaaaaaaaagaaagaag

SEQ ID NO: 585301 - DNA, 681 bp, Homo sapiens
agcggagggggtggtggcgagcgtgcgggagggcggctcggagcggaccatgcagtcctgtgagcgatgcagccagctcgctgagcaggtcagagctatggcgtgcccctcatccagccagaccggcggcgagaggaggccgcacgagcagatggcggaatgacctgcagtacctgcgagaaggtctcgtggagacatcttcagctagggtagagctagagccggagcgaggtgcgggccatcggagagaaggtctccttggcccaggccaacgatggagaagatcaagggcagcgacggaaggccatcaagggtgtcgtccagagacaagtaccctgatccagggagcctgcaggaatagtggctccagcttcacgggcgcccaggaacctgggctgctgaagacgcccccgacactgggatccgagagcaagcaccgtcccctggacgagctgggccgcgtgctaggagaagctgaaggactatccatgtgtgcgtgagcaccaagccggagcccgaggacggatgcgagaagagggacgttgggggctcttcccagacgatgtcagttctgtcagctccttgctgctcttcaataacaccgagaacctgtagaagaagtatgtcttcctggaccccctggctaggtgcttgtagccacagagccatgtgatgctgggg

SEQ ID NO: 585302 - DNA, 413 bp, Homo sapiens
gtatctagcggatcccttgctctgaacttagggatcgaagagataaagacagaagacaaagagataggaagaaagacagctgggcccgggggacactgccaccaaagcgcggagacagacaggtagtggccccgagtgcctggaggcgctgctatttattgtagtcaaggcaagggggcagggtaaggagtgccagtcatctccaatgatcgataggtcacgcgagtcacgtgtccactggacagggggcctttccctttgtggtagccgaggtggagagggaggacagcaaacgtcagcgtttcttctatgcacttatcagaaagatcgaagactgtggtactcctactagttctgctactgctgtcttctaagaacctaagttcggagccaggcctaagttcagagccagg

SEQ ID NO: 585303 - DNA, 365 bp, Homo sapiens
atgatagggcgtgagtgtgtgcatctgtaacaccttctcttaacatgttgagactctaggtactcacagttctaacctgtgagcagttgatggacatggagaaagcgtgcttgctatgaacaatatcataagtaagaccagacagcccagaggtgtatatgaataagttgaatacttgactgtaaggaagggcaggcttggacttcttgtggactctctggagggaggggcatggagcactcggcagtggtggtgtctgggttacttgatggccagagcatgtcgtgctctcgctagagccatcctcctgatgcatggcatttcagcaggacattaatcctaagcacagggcttccaatggaatg

SEQ ID NO: 585304 - DNA, 338 bp, Homo sapiens
tgggaatcacaagggtttatcccctaaaaaaagatatgtaaaaaagatcctttccggcccataaataaaggctgggattttccaacctgatgtatatattagccagttttaggaggttagtccccttcattccagagcaaggcttgtgaaacagcccctttttttataaagtcagttagaaggacttccttaccaatgactattaaaatgttttacttaaaaaccagttttgtattctgtcaaggcaaaaataagacaggttgacccttaatcaggtaacaaaatattttgtagattacatattgatttttcaaaaattaaaaatgtttttcaaccta

SEQ ID NO: 585305 - DNA, 311 bp, Homo sapiens
aagggatttttagcccttgatcccctttgcttgcgaaaggtggggaactgctccctgacagcttctctgtaacctgcagtaccagtgggtcgttcttgattttgttttcaataggggcaattttttggcattgaggacttttccccctacaacagtaacccccttttttgaaaagcaaaacttataatacctcctgggattgtgagctagtcattcagcctgtgtaaccatgtggaaataaaaattggcgccccatgtattatatgggccacttttgcttttagtaataaacttgattgtaggaatgtgga

SEQ ID NO: 585306 - DNA, 267 bp, Homo sapiens
aggggcccccgggggccccggttttttattggggggtcccccccccccccccttttgggtttttttagcccccccccccgggggggggggggttttttttttttaaccccccccccccccccccttttttgggggttttttcgggggggggggggggccccccccccgggggttttttccccccccctttgggggggggggtttggtcctggttgggttttttcccccccccttttttttttttagggggttttttttttttttgga

SEQ ID NO: 585307 - DNA, 431 bp, Homo sapiens
  misc_feature (13)..(13): n is a, c, g, or t
  misc_feature (90)..(90): n is a, c, g, or t
  misc_feature (160)..(160): n is a, c, g, or t
  misc_feature (185)..(185): n is a, c, g, or t
  misc_feature (194)..(194): n is a, c, g, or t
  misc_feature (215)..(215): n is a, c, g, or t
  misc_feature (238)..(238): n is a, c, g, or t
  misc_feature (288)..(288): n is a, c, g, or t
  misc_feature (290)..(290): n is a, c, g, or t
  misc_feature (301)..(301): n is a, c, g, or t
aaagccaaagccnggccccacccacatagccattaggccgggttttgcccctaatccagggtgcctactgtaagaccgtggcatttgccnttgtggataggtaaatttactatgtttttctggcaaatgaccctgaatgtatccgaggaagggaagcccnacttttcaaattccacctaaaggcnccctaaggntcagtgccaaaaatccctganccactgcccatgtagaaaagagnctgtgtgttattgcccaactttacatttatccagagaatgagtcaaaatnanaatgatatttnaagtctgactgaaaatagcaattatattagagaagaaataatgaaccaaatccccaaaaatgaacataaaacttaaagtataataataataaaatttaaaaaaaaaatcacagtttaacaaaaaaaaaaa

SEQ ID NO: 585308 - DNA, 145 bp, Homo sapiens
gcgctagcggcatatgaacgagaagccctgtgtgcactggctctagcaacccccccagagccagctcgggagggccccacctagggcctagctccgaaaccgcacaaaacgcgctgctaggacgttcacttaatgccgctagcgc

SEQ ID NO: 585309 - DNA, 335 bp, Homo sapiens
accctgggcacttctttggctcagaagtctacgagtcggcatggatgagatgacctttcacatctgtgagtttctttcaagagaacacgatcctgctgaatgacctgtttctactctccaagctgctctcattttacaagactgacctaataatggaaccatctagtagtgttcaaggaaggacctttgtctcaaacagctccccagctatgtttgacttctcgccacatggacacgcagttctatacggaaaagcgaatgctttgcttttacccaggtgtcacctggttcccaccctcccttccccaatcctgtcccagggctaaggtctcccg

SEQ ID NO: 585310 - DNA, 255 bp, Homo sapiens
catacttgggggagtctgtcatcggtcgtgggtttgcctggagtgtttcacgtacccccatgtcctgtagacttctttctccagtcaagcattagggcactgccttaggaggaccgccggagagtgggtcagcaggggggccccgcatgctcatgacatccaatagccccatggtggggatagggtggggctcacccccctccccagtttgattatgtctgcaattaaatttggtgaaatgaagtcattttcgga

SEQ ID NO: 585311 - DNA, 120 bp, Homo sapiens
ctagttttagaacgtttcaagtagcattaacactttttccccaatgaagcaaataaatccacattgtacttaccatttactgggcactacagtgccaaaacactatgctatttaaacagg

SEQ ID NO: 585312 - DNA, 877 bp, Homo sapiens
aatagttgtcaacgtcctatttcattccctgcttcagaggacctctttaatctgttgatttaggtccctgttcgtaagaaaagcaagactgaaaaggtcgtgaataccgcccctgcatgaacaacaccaggagcacgcgctaaataatccgaggaaagtgcctcctctgtgaaaccggagtatagagatggaaacaggatataagaaggattgagaatcatataatactagggagcttgaaacacctatgcgcgagtgatacaactgagggtactattagacgcgcgtggaaaataccaggaggttgagagagttaacaagaagggcgcacgctggattgtgccacaaaatctgaatgtactgaagtaagtgcagaagacaaattgtcacaggatagagagaagaggggaggaccgaaacttaaagaggagaaacatgagaggatctagagggccggtccaggagatacaatctatgcataataggaatagctgaagacctgaggagagagcaagtggagctgaactccaatataggatctacttgaaaaaatccttcccggattgcagaacgaatctagatctatggatggcaaggctcattaggatacctttaagtgcactgacagaaagcggtctctaaacgtatccgggcgaagtattgaatctcacaggacgacacgtgtacaaggggtcccgtcagagaacgcggttacttacacagggcaaaggcggctggctcagaattttgcggcattctaatgccagaaagaggggacaaatctcaggggtcggcactcttggaccaataatgctcgcacttatcttagggagcggcacttcattcacggccaatacgcaaccccctgggagtccga

SEQ ID NO: 585313 - DNA, 651 bp, Homo sapiens
gggaccacccagaccctggtagaattgtttctctctcctgcattgtaccaaccttttcagtctgggcttctcccaaaacccatcactggcatgagctgtaactccaggtggtggattggtgccaaagcctcaatccctagcccttctccaaggtggcaggtttccagtccatgctcagagatcaggctctgggacccctgactggggggtggccttcatgcactagccacttccgcaggtgctgactcccgcactccctggcattgtttgcagacaagggcttggtgatgtgaccctcatccccatggtgcgcgctgtgccagtgttccagtggccctgtccacttgaagcctaggtagcccctcaccccatcagtgccgagtccttgtgcctacctccagtttcctccaggctcaatgcgactctggatctagctgtgcttctccgagtggcacgcgtgcacgcgcgaggatgcctgggacaagcgttaagcaggctcaaatggcaataggggcccgtagtgggcccagcgcggtcatgggctcgtctaagcacaagcgggaggacgcgcggtgttgatccagcctgccaggacgctccactgtagggatctagcaggcacagagatgtctcgatgcagggagccctaca

SEQ ID NO: 585314 - DNA, 1060 bp, Homo sapiens
actccaccaccggccagcccaccaggtctcaacacgatcaccatcaccaccagcaagcagcaacagcagcagcagcagcgaccagcagcatcacggaaactctgggtcccccatccttcctggagacatttcccacacgccatctggaggtgcggatagacatccgcaacacggcaacacccttagctgccactgatcatgccacgtccgcatggaggtcatctgagggcccatacccagacagggcccagacaacacgcgtgccgcccacactcagcagaccacggtgatccatacagacacaacgcaaggcacccaaatgggcccgttccagtgtcatcatattcacatcatatacaaacgtcgtatccttctgtccgacattctccaaggggtccataacaccagtgtatcacaaccaccgttccacctttttccacagaggacccatcaaaggagtgcagacccaatagcccatattcaccaagcggttgaccataccgagatcagccgaccatcattcgagactagcccatgtaatccaacgaggtcaataggcccaaccacgatagaagccttaccgcatccggccaacggccaagggcattacaaaaacacgaggcggacaatcacaccaccacatgggaacacgcaacgaacccgaggaaacggacaacgcgaagacgcccccacgaacacaccaggacggacacccaacaaaggaaaaagcgaccaacaacaaaaaccacgagaaaatagagaaaaacaccaagcgagaaaacggaaccaaacgaacctgccaatccacgaaagaacggagggagacaccgacgcagcacggacgaccaaaacaagcaacgaaaaccaagcgaaccagacattggcaacgggcacccaagtgggaaaacagaaccaacacacacagggcgaccgaacccacacgcagacagcgacgacaaaagtggagccaaccgagacacaaggcctcgcaagcaaaacacaagaaggaccggaggcaacacggatggacacccaccaaccaacaaatgcagaggacgca

SEQ ID NO: 585315 - DNA, 315 bp, Homo sapiens
  misc_feature (299)..(299): n is a, c, g, or t
cacgagcgccaagtagactgaatggccttaagaatttagcctcccattccccactgagcagtaggtggatttgaactagaacagtattaggagaaaatgatttgctggaaattcttattgaagtaacacccagaacattctctaatattctggctgcagaaattggtactagtattcgttgcaagataaagccttcctcagggctggtaactatttgtgaagaagcacgaataaggcttgcttatatacaagcacaacgtaacattaagcagcaatgatttttatacgtctggcacacncgtaaactgtggtttt

SEQ ID NO: 585316 - DNA, 437 bp, Homo sapiens
acaccaaaatcgtgaattctcaaaagcaccatacaatatgtatagtatatagttctttgaaaagaagttagaatcacaaccaataccccatgaatagctttgtggctaatgcagcaccataatttgtaatggaactaagatgatgatgacgatatttcatgaaaacagagagatgttttgagcatatttatgtggtgaggtaagaaagaaaattaatcctatagcatctgaaagacctcactgggaagttggtatggatttttgtttgatttgtgcatacaaataggtatcacaacttgatctggaaaaaataagctgtgaaaattctcaaggaataagatgaaaataaatcaattattatcatttagctctgcaaagctttccatggctaacacagtaaatttaaataaagctctctttgtctccttcaaaaaaaa

SEQ ID NO: 585317 - DNA, 359 bp, Homo sapiens
ccggaactctggttggatgcgctggctcacgcatgcatcctagcactttgggaggacgagtcaggcggatcacaaggtcaggagttcgagaccagcctggcaacatggtgcaatcctgtctctactaaaaatacaaaaatcagccaagcacggtggcacacaccatattatctgagctactcaagaggctgaggcaggagactcgcttgaacccgagaggcagaggttgcactgagccaagatcacgccactgcactccagcctgggtgaaagagcgagactctacctcagaagaaaaagaaagaaagaaattcctctcccagagtaacacatacccctgtatccgaccaagagtgtcg

SEQ ID NO: 585318 - DNA, 531 bp, Homo sapiens
agcttgaaaggatagctcgagaggattaaatgctgtgctcaatctaagactatggcgcatctctcacctgtggtatactgtacgagtctcgtatcacgtagacttgggccgtcgtataaaaccactcccacacccaatccattcggcattctgcacaggagagatgtgttgaatatgcagacctaattgtataggtttaatgtcttaactgtctttccctttcttttaggatgaaaagcaaaagcctagacttggcccaagggtgctgcctagttttcccatctgtgctgcttcaacttcagctcatgccacccattcctgccacttatggtttccagccacactgccttctcccgggtcctccctcttcagtgtcttgcccaggattcccactacctggaatccatcccacctcctaccacacagcttatctgcttcttatccttcagatgtcaactccttttctgtgaccccagagaagctctttgtgtcctccatggtgggccagctcccgctacacaccctctcaag

SEQ ID NO: 585319 - DNA, 1548 bp, Homo sapiens
gccaagccagaacatctctggccccaagactcatcctcaaagtggccaatctctgattgtcatacgatgatgcaactatcttaaatcctcgtcgggtctgtgcgtagcgtcccggttgctcctcttcatctgagtgtttggttgtttgctcagtgccttctgtgctccttggtgccttgcagtcgcactcacggtgtagatatcactgaatgagcactgagggcacccccggatctgtgctttgccatccagccttgccgaggctggtgaccgttgctgttgcctgttcgttcagtctctcggactccatagctgggacggatgccccagtgtcatatcgcctcgtattctgatggcgtctacgttcgcagtcaatccctacatcagcatgtcgctgacttctcttcgcatgccgtctttcggcatctcctgccttgggtctcggcgagaggatttaggcctggctttcggtccattggtcctcccctatgttaaattgtaaaccccacttgcgaactagaaagggcctcccactgtgataggctttcacagccggcagcgctgcgttgccagggaataccaacctttgtatgtcaagccacaatgagggggcttccgacaccagtgggtcatccaaccgtacactattttccgagggggctatccccacgggtgggatagaaggcgcggacggcgcccttttattccccccggccgatggaacccaaggcattggtggacccgggaaacaggaggcggttcattcccggtttagattctgcctgtcgattatcttgtaggcttgggggtgcacaggtcttctcggtccgttctcccccggggacaggctccgtcttctggcagccatttggatttgcgtgcttcgagggcgtcccctatcccatttcgtgtggcaaccccatgtggtgcgcccttggctaaacctgaatgggaggcctccaactctaattttcgttccccctaagaggggtgatacccggttccaccaaatttgacctttttgggcgcgttctgcgcatttgacatcaacatgcggcaccttacagccaggaaccactcctttggtgagcaagcgagacacagttaggtgggcgcaaactcgatcctattatcgaatcgatcgtctagaagaggtgtgagccccccttccgcgctggaaatctcgcaaaagggcgggcgaacctgtccaaacagcttaaatcgccccataggaaaccttccacgcgccaatcagaaggaactctcctattgtgaatggccagctttttacgggggcaacctgcgcgcgatgttcatcggaacttttctctgcacaacatttcgaggatcgcatattccttggcgaaatcacaccccccgtgaagtgtaaagccaaggcgataagcgacttcaaatatgcacccaggttggggcaactctgcggcgcacatctggagctgagcccgacactctagggcgtgaagccaagatccttcgagagcactgtgtcacagagtctgctacttcgaccagcaacgacgctctacc

SEQ ID NO: 585320 - DNA, 804 bp, Homo sapiens
ctaaacatgactttgaaaaccaggctaatttacttttgttatactgacaagaaccaagcatggtctcaataatacaaataattacagatgtcctttattaatgaaaattgtgtacaaccttctttgggattaataacgtagaaaaatgtatacccacttgtggaagttatagagaaggaacaaaacttaactcctggtctgcccaagattctgctttcctagtggactggaatgtgttagtactcagaaaagtatgcatggggattaggcgtatgcaacaaaggggttgtaggaagtgagagaatgatagctagggtatcctctttttgtttctcctgccttatattaaatagaaagaaagtgtttttagcagtaaaaagcaccttgtgcttttgctagaggggcaaataataacggcatttctaccaaaagatttttctggttaaggctaatatctttttgttaacatttttcttttttaacttgtcttgtgtggggaataaatgaacgggtggtgaaacggtatcctgggaattcctggtgacgacaattaaatgccagtgttttataaccgctcagtgattaagatatacattagttaatggacgacgccggcctgtttcaaaacttcagagcagtggaccttagaggtaggcatccaggttaaaggcctaaaactgatgatcctcttaaacttcggctattaaatatgcttgcaaccagaacaggatactcttaaaggttattttcgacaggaacctggtttcttcagtcggctttccaaaacttttggggattatcaaa

SEQ ID NO: 585321 - DNA, 236 bp, Homo sapiens
ccagaaccctggatcctggcgagctgaagtacgtgcacagggttcctaccaccaaggaggagctgtgaggcgtgttagggtctacgatgcgatcagatctgcagatacatatcaagtgcttcaagagacacctgcagggaggcaggatgttgacagttcatttcatcctatttgatgcgctcctttctttccccattgttctcttacattagacagcagggatgcaccgctggtgg

SEQ ID NO: 585322 - DNA, 907 bp, Homo sapiens
  misc_feature (329)..(329): n is a, c, g, or t
gctggcttctgactgaactggattcgagatatcagatgtgtgaagctgaatgatggtcagttcgatgcattgtcctgtgatttgggcagtctatgcgcctgtagaggttcctagacaggtatagctttaggagcgccatccaaagttgggacaagtgtgagaagctggtcttccgctcgatagttgatgccctgtcgtcaattctatacgtcgtaactgatggtatgcagcgttggcactggcctatcctgtaagtcgtagtagttgcagtatggcagctgtgacacagatgacgtaacgagactagttcgtagcagcgttcaagacgncctgttgggtgcaagtgtcccacttcgatgcaatgaggtacgggtccgacccaggccttgggaaacgagtcacttgacaagaaatctttcagattggagttagtgtgagacccgtcgtaaccgtctgagtttccactatttcccacggtggtgcatcgctcatagacgacaccaggggtagagggggacaccggttgattcccgacaaaagagaggaataggcataggaattggggacaacgatacatatcgtcaatatttagaacaaccaaaggtagaggaacttcttactagggtgaccaaccaagagtaagcgcagagatggaggccacaggaaagggaagccgaaaagcggttaggctaaagagagaagacattggcacaacagcggaaacgttgggcgacacacacaaaaaggtgacactagaagaccacgggagaagatccgatccgccgaaacactaggcacccacaaaggagacacggagaaaacaagggcgcaaagaggaccactagctgaacggaaaatacgaacaggcaggagatcaataaagcgaacaacgaagccgatacacagg

SEQ ID NO: 585323 - DNA, 146 bp, Homo sapiens
ccgtaacactgcctgtactacggtcatcacagtactacgcagggtccttcattgccaagagaagcctgggaagacgtgacaactaaatgcagtgtggaggtcctggtgggatcctggcacagagggatgtctggaacacactatgg

SEQ ID NO: 585324 - DNA, 685 bp, Homo sapiens
  misc_feature (325)..(325): n is a, c, g, or t
  misc_feature (456)..(456): n is a, c, g, or t
  misc_feature (515)..(516): n is a, c, g, or t
  misc_feature (549)..(549): n is a, c, g, or t
cattaggctaggtacgaggcatgggtgttgctcggttcttcgacagcatgtgtctggatgtcttcacacagtggctgccactgtccaatttcgtgccaccccgaccctcgcccgccccatctgactcgccagcgtccccggatgaggacctgcaggcctggaacgtctccctgccgcccaccgctgggccagaaatgtggactgtcggcaccctccctgccgcgcctggtacgggagcccgtccgctgcacctgctctgcgcagggcaccggcttctcctgccccagcagtgtgggcgggcacccgccccagatgcgggtggtcncaggcgacatctgaccgacatcaccggcacaatgtctctgagtacctgctcttcacctccgaccgcttccgactgcaccggtatggggccatcacctttggaaacgtcctgaagtccatcccagcctcatntggcaccagggccccacccatggtgcggaagatcgcggtgcgcagggctgcccaggttnnctacaacaacaagggctatcacagcatgcccanctacctcaacagcctcaacaacgccatcctgcgtgccaacctgcccaagagcaagggcaacccggcggcttacggcatcaccgtcaccaaccaccccatgatgtagcgcgagccgactcctcggtacaggtgggcg

SEQ ID NO: 585325 - DNA, 320 bp, Homo sapiens
aggacgaagccgccacatacagttcgcacgcgctgtgattcggagcttcagcgggaaggagtgtcccatatacaggctcattcccaaagccctggggcaagcctgatctccaagtatactctacgggagctgcacctgtcattctgccacaagggcttttaggagggaccccgattactagggggacccaccccttaccttgcagggcccccataccccggctataaactacgggataccgaggctccgaatatcgtaatacataggtcataagctagtattcctagtgtagaaaattgttatacccgctaaacccaagt

SEQ ID NO: 585326 - DNA, 241 bp, Homo sapiens
catcgccaaatcaggcgctggccagggcagatccaagaagtaagcagtcgagtgctcaagctgctggtgtacgaacaaaggccccaagagagctacctccccctcagactccagcgatcgacgctgtgctgggctctcaagagcccagcgatcgagccttctccacccgcagaggtgaaaggctggtaattcgcgtaccgtccttatcgtcgcgggccttcatacccgccgcgcaaagttt

SEQ ID NO: 585327 - DNA, 886 bp, Homo sapiens
cttgactatatttagaggtcttttgcctcttttccccttaacaaggatttcttatggtggtttcagtttcattgcataaaggtatgagagggaacaaaaaacataaagctgagaatcttgagagagctcatctaccctgtctgtggtcagactcaaatgagagttaaaaaacaaagaacacaaaactctgtatgccggagtaccatccgggagtgaatctcaagaaggtagggggtagagctggacagggtcccggtgtacccacggggtatccgtcagaggtaagggagaggagcaggatggacacgagtggtcgcacaacagtcatcgagtatccactggagatacacaggatagggttcccggccacgagatacttaaacacaattacagttcgccccaagctggcatctcggaccaaattcacataaaacaatgggacaggagtgcttggagtgcgggggcaccaggctggtaatcccagcacacggggcacgctaaggcggggggatcactgaggttcacggacgtccgaaaccagccgggccccacagggtgaaacccgtctccacgcaacacagatcacacaatacagcgggccgtgggggcagggcgcctaattaaatacccagctataacactgtaaggcttgtgtgcacggaagataataccttatcccccgggaagggcgtcgtattaacagtgaaactaggaaaatcgtgccaacggtattcaagcttggttgtattgattgactaccttaattcaataattattcttgggttaagtagttctacgcttcaattttaacatgccaactaatcgtgccgaactccataggcaaccagagtttacgcctttcgaaattctttatggtggcaaacca

SEQ ID NO: 585328 - DNA, 342 bp, Homo sapiens
cttttgcctgttgctgctggcagaagacaaacttaccatgtccctgtgacacgtaacccatcagcactaacattataaacacgagaattttcacacggagtctctctctcttccaaagaccacaatccccacgctccgacctgtgttgggaaagcggtggatggattgaaataggtagcgccaattcactgaaacctttctaaagcctgagcaagagaaaccagccagatcagtgtctcagtgcacctcccaaccctaacactaaatcaagtccatctatacagaaaaactaatcaaaatgggtcctaaataaacctacttctggctacatgtgaaaaaaaa

SEQ ID NO: 585329 - DNA, 193 bp, Homo sapiens
tcatagacaaggcgtcatcacgtgtcaacagtgctcctctgcgattggtgcttctgtggtgtctatctgccacaaatccaagaatctacacacccagatctggtttgttacagtcttcagtaattacagtctacacgatgtatttgacatggtcagctatgaccaatgaaccagaaacaaaatgaaccatgtg

SEQ ID NO: 585330 - DNA, 935 bp, Homo sapiens
tgcaacaaatacctcctttgatcctaatcatagttttttgtgtgattttgcttttttggattgtcctctcccatgagattgtaggctccaggagagagaactgtaaatatgtgtgtgaatatgtatatgtacatctgtttgtatccatggctatcagtataaccatttgcacatagttgtctctcaataaaagtttgttgaataaatggatgaaggaagtggtgttttactttgggaatattttcataactctccaggaggaggcattgcttttattcagtggttccatctatctattgcttcacacccatcacacaaagaatatgccagtttgaaaaatacagcctagttttgtgtgtttggctactttgggccactcccagattttccaaaggtacacttgcattcacctttatggttagaggcactttcttagaatctgagtttaagaaacggtatgctattttaattacagtaagtactttatcaaggtcagttgtcttagaatgtggatttatatgacatagtctctaatacattctgtttggcatgtattacagggaaaaaccaaacagtcctgtttgcagccaaagattgcaagatggtggtaggtgtgtagttagagcacgagactttctttgctcacatgcataggtcagttctcttctttcctgtcttgtcagttctcttggatgagcaactgtgtttggtcatgggggcaaggcactgaccttggagctcatgtgcaggtcactgtgggccatagcaagtctgcctgaacttttttttccccgtctgttgatctgtgcattcttgcttatgcttgagctttttttcagtttgtttttaatctttgcttcctcaagttaacataagtagcagggtagaatgatctgccacatgaaagtcatttctgtctcagtggtcttgggcct

SEQ ID NO: 585331 - DNA, 174 bp, Homo sapiens
  misc_feature (128)..(128): n is a, c, g, or t
ctcatgtgagatcatcagattgaggctggatgagcagtccgatatttggtggtagcattcagatctggtccgaacaaaagctttcatggctgtgatatgagtgtccgacatcgtcggtctttaagggnccagtgcacatcattcccgctgcatccttcggtcagagcattgtga

SEQ ID NO: 585332 - DNA, 1215 bp, Homo sapiens
  misc_feature (144)..(144): n is a, c, g, or t
  misc_feature (558)..(558): n is a, c, g, or t
  misc_feature (825)..(825): n is a, c, g, or t
ggcttacacagtatggccggcgacattagctagcgctcgctctactctctctaacgggaaagcagcgggaactacaagagactgaactgtatctgcctctatttccaaaagactcacgttcaactttcgctcacacaaagccgnggaaaactccttgatctaggtcctcttattttaaaaaacagttagtataaaactgatagcaataaaaaacaaaggaagcctgaagcttgagttaacactagcttggtaaccaactccgcagtcgcgcgggggacatgacgggtgggcacgtaagaggtttaactttaagatggcatctatgctggtgcgctgtggtgaggatatgctaacgctgtatgtcttcaacgtgatgagataggagaaagtctagctcgatccatatctaatcacgaaagggagctacccggcagaagaacctgtcgtgagctaggggtttaggggtatagcccgcgcggcaaaactttagactctcggaggacaataacccgatgaggagatactaggggagatcgtgtcgcgaaagtaatagcgcanaagatatcgtagcagatggcggcacgatcacgtttatatcgccacatggcatacgcttgccaaggggtatctagttcatatggacagctggtggaaaccaaaagagagcctggcacgacacgccaagtcgcacatgccttgtatggttcacttctccaagattgcaagaacgttaagaaccactggggtatagaggtacccttacacgaatgcaatgaagtcggtattcgcacagtaatcccgagaaaggagcactcactatgtcgngggatcaaccacgaacccactcccttgtgacttctgagaaactggacaactctgagggttttcccccaccttggtttcggaaaaggacttatgggacgtaaacggggggactttaaaccatgtcgggggcggttttataggaaacgcttcccaacatttttgccaagcagaagggcgtttgccctcttgaaagttctgccgtcggtcaaagagaacaactgtggccagactgacaacacggccgcgttttcattccaacacagagagagggcgttacacccccgaacacccagggggaaagttcttcccccaggcggacaacgcgcacacactcagggaacggttctcacgcttcacacgttgggcgacaacgtgtgaattcgccccgca

SEQ ID NO: 585333 - DNA, 388 bp, Homo sapiens
  misc_feature (34)..(34): n is a, c, g, or t
  misc_feature (38)..(38): n is a, c, g, or t
  misc_feature (40)..(40): n is a, c, g, or t
  misc_feature (60)..(60): n is a, c, g, or t
  misc_feature (66)..(66): n is a, c, g, or t
  misc_feature (70)..(70): n is a, c, g, or t
  misc_feature (73)..(73): n is a, c, g, or t
  misc_feature (82)..(82): n is a, c, g, or t
  misc_feature (87)..(87): n is a, c, g, or t
  misc_feature (91)..(91): n is a, c, g, or t
  misc_feature (102)..(102): n is a, c, g, or t
  misc_feature (105)..(105): n is a, c, g, or t
  misc_feature (110)..(110): n is a, c, g, or t
  misc_feature (128)..(128): n is a, c, g, or t
  misc_feature (131)..(132): n is a, c, g, or t
  misc_feature (154)..(155): n is a, c, g, or t
  misc_feature (169)..(169): n is a, c, g, or t
  misc_feature (194)..(195): n is a, c, g, or t
  misc_feature (252)..(252): n is a, c, g, or t
  misc_feature (294)..(294): n is a, c, g, or t
  misc_feature (297)..(297): n is a, c, g, or t
  misc_feature (321)..(321): n is a, c, g, or t
  misc_feature (368)..(368): n is a, c, g, or t
  misc_feature (374)..(374): n is a, c, g, or t
  misc_feature (385)..(385): n is a, c, g, or t
ggaaacccttttctcttggttctcattctctctnaccngnccaccacataagatgtcctntttgancttncgntatcattgntgagncctntccagtcacgnggnactgntgcagtccattaaacctnttnnttcttcataaattcacccagtnntgcaggtatgtctntatcagcagcgtgaaaatggactanntacagcgttcaactggttggatgaggttcagccacattatggagggtaatttgcctntactcaaagtctactgatttaaattttaatcacatctaaaanatncctttatagcaacatctagactgnctgtttgaacaaatgactgggtaccatagcccagccaaggatcatanaaattnaccatcaccantat

SEQ ID NO: 585334 - DNA, 765 bp, Homo sapiens
  misc_feature (144)..(144): n is a, c, g, or t
ggcttacacagtatggccggcgacattagctagcgctcgctctactctctctaacgggaaagcagcgggaactacaagagactgaactgtatctgcctctatttccaaaagactcacgttcaactttcgctcacacaaagccgnggaaaattttagttagtccttctcttctaaacacaaagttaactatacacaattatagcgaaatagaaaggaaaggatcctgaatttatagttagcccagtctggaacagtccgcagaggtgggggagatagcggggggcgacgaacaagggtgtaaactcttacgtatagatgtcttcttggtgggtagtgatgggtatggtccagcataagatctcgagcggagtagatgggcgaacgctgggacaattttattgttctgaacgggagtcgtagtaattcctggcagggagggggtttgggtttcatcaccgagcatggcaggccggggtaagcaataccaagggattgctgggggaatcggttcgatctaatcgcgaagaatactgaggtggggacatcacttgtggtaagggatgtggacaaggggttcaatgtctatgaaggtgtggagagaaaagatggagaagtcagaaaggtttatggatacgccatgtgagagttaccatgtttgtgtcgtcaagggaaacgttgtcattttggaaagaatgtgtgttaaccacccttctgggttggaaaagtttggttttccctggtggaagcgtgctagggcatacgggg

SEQ ID NO: 585335 - DNA, 251 bp, Homo sapiens
cggcgcagctcttggacctgagcctccttggacctgcgctctcttcttccacggccttcttcagtcaccgtcacctcctgtctccctcttggtcccttagctcctgctgagtggctgtgctgtccagtggcggccgcagctcctggagagaactccagcagcacagccttgtgtttccactgtatgtccggaaaaaggttgggacaagccagtggagtgccagttctaggaagctgtttctaggggggata

SEQ ID NO: 585336 - DNA, 435 bp, Homo sapiens
catctaacattaggatgagagactaatatattttcagatactttcagcggacggcgcactctgtatccatgctatgaaatgacctaatctcaagtgatcgacgaatttgaataaagattgagcacatacttatgaataatgagaaccgccatcacagatcatgatgtgattctatacgctagattggcacagtagggaagcagagcacacacagatgacatgcccgccagacggatactgaggaccctgattgagagtacagagaatcgcgtgatatagagatctgatgaatgagcctggtcctgcacagaggggagatcgctatgatactttctctgcgctggatgcactggacttagtctgctcaggctgttacatgaatgtaccaggctgtatggcccatatacatcggatatgtatctcatgcgtccttgg

SEQ ID NO: 585337 - DNA, 644 bp, Homo sapiens
ctctaaggactcccctttcttcgtcatattctctccacccataagggacagcaaacttagtcaataaatgtgtgttctgactactccactgacccaccattcccccatctttccccctctgttcaggcctccctattacgtgatacacaaccacttgaatttaggccaattaataaacctacaatggcctggtgtttaagtgaaaggaggagtcatatgcttcttacttgaaatcaaaagctagaaatgactaagcttagtgaggaaggcatatcaaaagcaaacataagccaaaagttagacttcttgctctaaacagccaaattgtgaatgcaaaggaaaagttattgaaggaaattgaaagtgctactctaatgaacacatgaatgataagaaagtggcagccttagtgctgagagaaagttttagtggtctgaatggaaggtcataccaaccacaacattcctttaagccaaagccgtcagaagaagaccctaactctcttcatttctctgaacactgtgagagaggtgaggaaactgcagaagaaaagtttgaagctagcagaggttggtttgtgaggttgaaggaaagaagtgtctccgtaatgtaaaagtgcaagctgaagcagcaagtgctaatgt

SEQ ID NO: 585338 - DNA, 199 bp, Homo sapiens
ctgctctgagattggtctctgcgagatgattactatatcccagagacattggaaactgctgacatttacataggtctggtcagcacatggtggatgcggatattctataattcccagaagtcacacagctcctctgtatgagacccagtggcgccatttaacagaacaggatgagaatctaagatatattattaataaa

SEQ ID NO: 585339 - DNA, 454 bp, Homo sapiens
  misc_feature (327)..(327): n is a, c, g, or t
acagtgaatttttaatgtatccacgagaccattatgcattgttttgtgctcaactagtgaatagtatttaaagcattttgaatgaagcgtattttataagcatttaatatttatgctctctagaatggaacacagaaaacaaaccttataagttctgattaaattaatctgaaccataataatatatatattatacctttattaattacactatagatatttatttatcttcaatttctctatattacgtttttatctattttcctactactataatatcttattttcacatactattttctctatcattattattttattaaattntaaatccctcttaatgtaattatacatcaataatactatctcacatataattaccctcttactttatatctcagcaattatgtatatttattactcatctttatatttattttataattattccccg

SEQ ID NO: 585340 - DNA, 239 bp, Homo sapiens
  misc_feature (28)..(28): n is a, c, g, or t
  misc_feature (47)..(47): n is a, c, g, or t
  misc_feature (56)..(56): n is a, c, g, or t
  misc_feature (206)..(206): n is a, c, g, or t
gttattttgagagcaaagtttgcctcanctgtccaatagagactgtnttgcatgtnaaaagttcatcatcaggagctgaaagaattgaaagtaaaatgaaactatcttgtgtgcctcgtaggaatacaacctggacgtagtgtccattactaattaaagccaatgtgtattgtactttcacagtgagacaggccctgctctttgtnctctatatttatttacatgcacttaatcctcac

SEQ ID NO: 585341 - DNA, 835 bp, Homo sapiens
gttcttgttccagaagggacaacaaaggggtccacagcggaggacactggcggagaggctggagcaaggtggggccactgtaaagaggaacgtgaagcgcggagttagagaagacagcaggaagccctccagtggagaagcggatctgctcgatgccactgtcaacaaggccctggcacgaaagaggtccacatgctcacgagtttcctaacggtgaaagaattgtaaagaagggaggaagaaataccgccagtgcctgtgctcaggacaaagaacgaagtttctcgagtggactagcaaaagcccatgaggccccaccacgcaccccagagcccaaagtgggaagagcagcagacaagcgtgttagcaccatggtgggggtacaacttaccgggagaccctgcaagaagaagaaacacactcttggtcatgttcatacagccccttggtagcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccaccagctttccaactactagccagctatgggaagttcgcagaaaagtatgacagcgaccgcacagaattgggatctaccaataatattcgagccctcacgggagggagaccatgaaagactagggaaaaacgaaggaagagttataattcctgcctcagaaaaagcattctccattacactgtgaatgatacctgttttgttgtttctgaatttccacatactccgagggaattttaata

SEQ ID NO: 585342 - DNA, 125 bp, Homo sapiens
ggggctgctcccatgcagacaggatcacctaacagagatggaagccagggcatggatggggctttggccctcgaggttggacccagctttttgccacctcccctccggcagtagcttctcatcca

SEQ ID NO: 585343 - DNA, 245 bp, Homo sapiens
  misc_feature (22)..(22): n is a, c, g, or t
  misc_feature (45)..(45): n is a, c, g, or t
  misc_feature (67)..(67): n is a, c, g, or t
  misc_feature (78)..(78): n is a, c, g, or t
  misc_feature (87)..(87): n is a, c, g, or t
  misc_feature (104)..(104): n is a, c, g, or t
  misc_feature (119)..(119): n is a, c, g, or t
  misc_feature (127)..(127): n is a, c, g, or t
  misc_feature (133)..(133): n is a, c, g, or t
  misc_feature (169)..(169): n is a, c, g, or t
  misc_feature (195)..(195): n is a, c, g, or t
  misc_feature (218)..(218): n is a, c, g, or t
atctgagatcactctactgttntacattcactctgctacaaagcnatagacaggcacaaacactgcnagaatacattnacttcctgnataaaacaaaccttttnaatatcattgaaatnaatggttncatttngcattaaactacataccattgaacttctctaacatnaaaggactaaaaacaagcattagaanatatttacaaactatctttaaanttctacaggtctctcctcctcctcctg

SEQ ID NO: 585344 - DNA, 144 bp, Homo sapiens
aaagatgccagacactctcaccagtcgatacctacaagaagtggaaactcaccagaatggatgggaactggaggcggggctccagcgcggaggttgcaggaacatatccgaacacattctggatgaaccctcagtacctgatca

SEQ ID NO: 585345 - DNA, 943 bp, Homo sapiens
  misc_feature (241)..(241): n is a, c, g, or t
aagttatgtaaataacttcgtcttgtgtaactaaatactgcatcgcgcgtgtatcactatggttctccgaccggccatattggcgccccgcattcttacaccattaatgttctgcccgtgctgaatttcctgttttccctctcgcgcgctttgtgtattctggctgcccccccctgggccgacgaagccctcttaggtctgtaattaaaatccgctcccgcttctatagtactgcccccgncttcgttgatggtaccccccgccccaaatgggtttggcgacaagaggacctcgagagtgatggcgtatactaaaatttcagacccccaccgcggggggcggaaccttccgtggcactacctgggaaccgttggttttcttttgaccacgcgctgatgtgacctactatccgtagtagaaaattcaaggtacgcccatgtttaactgtttgcagttcccaagattcgcggtggatgagcgcgtagacacacgccgctcgggtcaccctccctcccccgcctccacaggttactgcgaccccgttttttgcacgcccggagcaaatgtttccctttgctcgcggtggtgggccactgcttttctttccccccgcctccaaggtccgagccgcaggcgtccccccctcgctgcagacagaaccagttaatctttcttctcccgagattctagtcatttctaatatgaatatactccgcaaagtacataactctcttaggtgtaatctttccacacttaacaggttcaagaaaattatcctttaagcccctggtttgatgcattttttggtttatcaatttggccgaatattattttccatataaaaaatacccccctatggtttatatatatgctcatgcaaaaaatctatggctaattcccgcccgggagtgcttataaaaaaacatggccccaacacatgaca

SEQ ID NO: 585346 - DNA, 341 bp, Homo sapiens
agctcaaatccatcacagtcgagagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaa

SEQ ID NO: 585347 - DNA, 331 bp, Homo sapiens
gccgactactactactactactaaatccgcggccggtcgacaagaatagtaattttctatagaaattgctgtaatatgaaaaacccaagtatctaaatgagattattagttgacataagctccgataaaggtacagaaatgaaaatatgcaatgcctaattctactgatcagattagagcaatttctaatctgatcagtagaattaggcattgcatatttctactgatcagattagagcaatttctatagaaaattactattctttgctcacaacacagtttaaagcaatgtaaacacatccctattgctacgtcgacgcggccgcgaatt

SEQ ID NO: 585348 - DNA, 398 bp, Homo sapiens
cactcagtatagcagaacagagcagaaagccaccgccacacagcagcagcgggaggacgttttacagcagcagcaggcccagacccagcagtttcatggcagtacatccagcacaccagcaaccagcaatggctcagttccctgtggtgtcccaaggaggctctcaacagaagctaatgcagaatttctaccagcagcagcagcatgcatgcaacaacagcaacagcaacagcgggtcacagccctgcatcaacaacagctgatgactcagcaggctgccttgcagcacaagcccactatggcagaaggacagcagccccagccacagccagctgcagccccacagccagcccctgcccaggagccagcgcacgaatcaagccccaagtaagaccacc

SEQ ID NO: 585349 - DNA, 247 bp, Homo sapiens
accccgtggtatgggacacgctgaaacccacattccgctgtgcccctggagcagcctcttcaccacgctgctcttcccagctcccgaaagcccgctcagcaccacaggcctcgggcccgacatgcctcactgcctctctagccccgcctccacctgcgctggcctgtcgcgaccgcagggagcgttcagcacagtgccctcccagcccgtcttctcccgctgcgtcaccagcgccccgcagaacgcg

SEQ ID NO: 585350 - DNA, 347 bp, Homo sapiens
actggatgtggagagatactataagaacatccatgataatgaagtcatagagagcatgcattgactgaagagagtctccaccgaagaactataacacataataggacctacaacacttagatcaactcttgcctataggatgctcaggctctgtgatcctctaaccttactgatatactagtcgatccactgtgtggaactggggcaataacaaataaagggggccactgaatggtctgactgctatccatcttgctggtgataataatccaatggctgtgaatagagcagaaaataaaattgcatctttattgaccaagagccaaattaaagaaaggaaaacctcc

SEQ ID NO: 585351 - DNA, 1354 bp, Homo sapiens
tgggggggaacctgccccaatggggcacaccaggtttttggggcacccagtgggaaaaatcaggggtgtggactgtggccaacaggcccacagcagtcgtcactatcatcctaaagggagcattaagagagtcacagacgagacgcccttggcgacacgcacataggagagagcctacaatcatgcaccggcaacctcacgacaagggtcatacaagtgtccccggacacagcagaccttcagaaacgcgccgggtgaacaagaaaaacacacagagtcgacccgtggttcacccaacgcggtgccacagggggggcacaaaccatccgacgagacacgtgcatcgtacactaacaagcaccgcgagaagccgcccacaaaggggcgatggtgagagttccactccgggggagacacccatgtgtagcgaagagactgggcgatacacaccaggaaccgtgcacaggcagagggctcactctcgccacgtggtgcaaaacccaggaggctccagtcgacctccctcgaaacagcgcaccggccctatgcccacaatgggccacaaaatcccctgggagccttccctgcgccagacatagaagtgagggagccacggtgaacactcacaacagatgggaaccaccaacagtcgacgggggcagaccccacaaccaaaaagaggggaacacccatcgtgctcacaccactacgaggggagacaaccgcagtacgagggaccaggaaaatataccgcgacccccctgcacaacagtgacagccagcggcaaggagcaaacctgcgatggacgaactaacctactaaccacccataaacaaagaggaccacagatgaacaacaatccacgtgacaaggggaaaccaaacgtccacaatggaagaaccctggagacacaaactaccctacgaggcgggccaccccaacagttccaccacaaaaaaaagagtcgctgagacacaagacactcaaggaggagacatcccacattgaccaaccaccaagagcattgggagagagcgcaagcggtagaataacacacccaacacgtaggggagaacaagctccctgggcacaaacaacacgccacgacgcacacgaagagcgcgaattgactagtgtgacaacagatcgggtgaggagatagaacaaacgcctgcggcgcgccggcggagggattaacacgtcgagcaattagaccaacgagaaggcgacgatgcaacaggcgatacaaccgccggggggatctgacaatgtaccgccccaaccgctcggggtgacgcggacccgaccaaaatggaagacgaggcggccacccgggatagcagacacaacaca

SEQ ID NO: 585352 - DNA, 319 bp, Homo sapiens
  misc_feature (10)..(10): n is a, c, g, or t
aattctcccnctagagcccagtggggagtatggccccaccaacaacttgatttgggcccagtgaaacggattttttacttcttgactccataattggtgagaatgaatgtgctgttttaagccacccagcatgaggtcatttgcttctgcagctgcaggaatctcatgcagatttctgcgcacctctatgttctctcccctcagtccttcatctgccatgatggccatcctcactctggactccctcactcctcaccctggactccctcactcctcaccctggacaccctcactcctctgcaaggaaccgggtaccgag

SEQ ID NO: 585353 - DNA, 345 bp, Homo sapiens
  misc_feature (61)..(61): n is a, c, g, or t
ggaatcccttgctggctgggagtacatcatccgtgctcagaatcccaaactccccgcagtncactcctcattggggggtctggttaatctcacgcccaggattagtcatccagttgctcaggggacgtcgcctctgcttgtccgcttccggccttggacatcgtcgcctccagtacctgtgtggatcctcggcgacgttttcttggggcgtatgtgacctcttcgaccgcgggacatgaagacggcgcacgagtgggactggcgcgcgctcgcctgcggagcggacctgggaaggcgagaccgcaggcgcagtacccggtgccgcccaggtgatgcatgcgcacc

SEQ ID NO: 585354 - DNA, 145 bp, Homo sapiens
  misc_feature (9)..(9): n is a, c, g, or t
aaggatccnccgcactagcgaacgacaacaccagtatgggtgttcgacgagcattaacagccggagccacattacccaccccggagaataaggctgctgtgtgggagaaaatttttgcagtagatggcgatgttgctagtaactg

SEQ ID NO: 585355 - DNA, 842 bp, Homo sapiens
tgcctgatccacacactttttacttgtatagatagattatttggcttggacataaaagccaagccacccatttgctttccaatccaagaaagaacagtgtatagttttggtacccagagactatgatttagtacttcgacttgtcagcgttgccttgtccagtgaactttagatacatgatttttcttgcattgggtctttgtacttcgtattccataatgcgatccgtcgttttgataagtatcttctcaagccttgttccattgtgatattatcaagagtgtctttcatcttgttatagtttctcagtgggctcaggtactttcctaaattgtattaaattccttgccccctggtgtagcttcctaaggcatcataaagctaattcgcacgtatgggaacacattcaactatcggcacatgcaaatggatcatcgtagtaattaacctcgataactatacacaagttctcctttcccacctgttcaacatacatacaaacatagatacaagacggcctgccgcgaatttatcctcagagaaaagcctgttattatatgtatcaccaaaatattattaaccgtcccaagatgaggtggccccctacaaaaatgggctctgttgtgtaaagggtccccccccctatataatgaggggggcaatttacttatagtagagaagcccctcttttttgctgggctagtgaaagcgctcaccaattattatgaagcacttttctatttctatgagccccaagatgggatactgtcccctcccatttatataaatacgcccgcgtggacccaaaggatattgttgtaaccaaataattgtaacgccct

SEQ ID NO: 585356 - DNA, 1285 bp, Homo sapiens
  misc_feature (204)..(204): n is a, c, g, or t
  misc_feature (291)..(291): n is a, c, g, or t
cagagtttcactctgtcgcccaggcgggagtgctagcagggtatactattagcttctttcccggtgctaatgcagccaggctagcacagcaaagggagagaagcagaagcaactcaaaatttataaaactttctattgtggggtgtttcaaagaatcgggaataaatatgttaaggtggaaaattcagaatttcgctcagtggnctatgtgtaagagaaaacccataggaaaagtgggtgacacaacttgtgggcagaaaaaagaaaagtgaggaaactttaactcgaggncttaaaccacgagccagaagaaataccgagtgttccagaacacccaaatagagtgcataagaaagtctcagtgttctcgtgtgtgtcagtggagtttcacatctcgggataaaaaagatgtgacacatgtgtcctgtgcaccacacctctcttgtgacacacacatgtgtctcacagtatatatctcagagaatctcacaaagaggggctctgcggagacgtgtgtgatacccctgtggcaggggtctcatctctcaggttaccatgtagtaagaaaaaagtgtatatatacgaggaaagtgccccagaactctgtggtgtcccacaagtgggccagagaacttccacacggtgaaaatctctttaacacacacgtgcgtcgtgttacccccacgtcggtgtgggagagcggcgcgtggtgtattaaattaatcccattggtgaacgccggtgtgtatacatcacaagataccgcggtgtggtgagaagccccatgagaaaacaccagcccccccacgtagtgggctcttggggggagaagtcttcttcatgtggagcagaacaaacagatgcgggtattggcgcgcggacccccaaaagggtttctccagagttggacaatatacctcatatccaacgtagagaggggacccaacgagcgttgtttagtgccgttgtcacacctagtggcaactcgtaggttgctccgggggaaaagcactctcatgttgtgacagcactttctgtcgtttcccacaaagaaacttcccatgttccgccagttattaccccgttgttggaagaacacacccatgtttgtggaagttggcgtataatacgtcccttcccaaaaagcgtggcccatgtggcgacaccatatcagtgcgactttcttccacacgaggggtgaccccaagggggacaaagcaacggcggggtctcttaagcgcccaaacagatcttccctgtgtgtgggagaatgactacaacacac

SEQ ID NO: 585357 - DNA, 201 bp, Homo sapiens
gtctgctatcccttatggctggctgcacattcaatccgggggcattaattgattgtgcttgaattcctgagaatatctctatttgtaggaggggttttttcttttaacggtctgttgatgacaattactttatgggtgtgatgcacctgatggtagccaaggcaatctagtgggggaagttcgtgaaagaaacctatttct

SEQ ID NO: 585358 - DNA, 113 bp, Homo sapiens
tgcagattaggagataggctgtgatagttacctccatggtactcttcagaattcagttaattggattcaggcagccacaggcatcaagaacatgcctccttggttgcctctgg

SEQ ID NO: 585359 - DNA, 790 bp, Homo sapiens
aacttgactgataatcaatacacttggactgataagttggagggtgaggtacatctaatgctgggctgcgtgaatgagcgcgcaaatttgaaagtcggcagtgtgttttatctggattcttgatggctgagctggaagacagcagattggaatgaaagtttatagtttctcgtgtgacagatcagactgaaatccctgctactgaacgcccacactaagtgctctggctagatgcccggagtgagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttctggataggattgttcagaaatgtcgaagggacgtggctgtggcatcaataacagtccggtctcctttgtcaactggaacacaggagatccctctggtgaacggcaatgattgtgtagctttacatgcgtcttctgggttcggagtaatattcactgttcttcctacaaaggctctacttgtacaccgaccaagacattcacttgatgctaaacctactcatgaattacttactaacaaaagcttgacacaaggcaagatggacccttctaaaccggtcttccaacgtggccggagtagtcatcatcgtgatcctcctggatttaaacggggtggctggctggacgccctattcttttata

SEQ ID NO: 585360 - DNA, 567 bp, Homo sapiens
ccagccaaagacagccttagctttgaggacttcctggatctcatcagtgtgttcagtgacacagccacgccagacatcaagtcccattatgccttccgcatctttgactttgatgatgacggaaccttgacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttttactggtgagttgtggccaaggtcaagcctgtgttgccagtgtgggccaagttggtccagagtggagatggacctgttcagcctcacacagggcaggggcggccctgatggtcagggcctgtctttgtgtgtgttgtcattgctcggttcgtgttgtattaagcatgtaataaaggtttagggttgg

SEQ ID NO: 585361 - DNA, 252 bp, Homo sapiens
ctgtgatttctgtgccctctgcaggatctatatctacgcttctttggtcattttcgctgttccttcttctgcctctgtctccgcgcgtcagctgtggacactccctcatgttttcccgagtgtggcttcgtcatgttctgttttgcctccccagcaaccttacctcctcccatggcttcaactacctttcacaacatctatctccctatactttgaattaagcttttacctgctcaagaaattttagaaact

SEQ ID NO: 585362 - DNA, 331 bp, Homo sapiens
cacgaggagcttcattgaatgctactacattacagcatcgatattaaccttgcatggtaaatgtgagcttacagattgctattcatttcctttttcaaacttatctacggacaaagaagaaactcagggttgatactgaagaatggtttgctaccattgaagcaatgctttcacaaagttttgatgcttgtcagtggttacttgaatattttattaattctgaaggacgataaatgataccgcttttcttactggagtgcaatgtgacagaagtacgacttgctgtgggcaccattctggagaaaaccctaaacagtgccttgttttatca

SEQ ID NO: 585363 - DNA, 732 bp, Homo sapiens
gaaggtggaaggagcagacttgctgagtcttctggccttcgtcttcctttcgtgctggagcttcctgccctcgaacatcagactccaagttcttcaggttttgaactcttggacttacaccagcggcttgccacatggtctcaggccttcaactacagactgaaggataccctgttggcttccctacttttgcggttttgggactcagactggcttccttgctcctcagtttgcagttggcctatcgtgggacttcaccttgtgatcatgacatctccaagaacttcgttcactgaagtcttaaacccctcacagtgacccatgaggattggaatcagcttctttcaaactcttactattgttgatattttgatcgcttcctatgaatcgtgaatattttaatgacatctaaaatgtgactcctggccgggcacagtggttcacgcctataatcccagcaccttggtaggtcaaggcgagaggatcatttgaggttagaagtttgagaccaacctgaccaacatggtgaaaccctgtctctactaaaaatagtaaaaattagctgggcgtggtggagaatgcctgtaatttgacgctatatgggatactcagccaggagaatcgcttgaacctgggaggtggagattgcagtgagccgagatcgcgccactgcactccagcctgggtaacaaagtgagactccacctcaaaataaaatactccaatacaata

SEQ ID NO: 585364 - DNA, 131 bp, Homo sapiens
atttacaaaataccagttttttaaaattttggccaaattatgggtggttgatttaaaaacttttccaagaagaagaaaagcatggggtcgtaatttaaagaacccaataaaaacttcttttttttttttta

SEQ ID NO: 585365 - DNA, 619 bp, Homo sapiens
gttttaaaaggagctgtttaacgaaaatgtgatgtgcccgaaccggtcaaaaatttgtaaggttaccgttgaaccaattgaatgtctagattggtttttaaaaggtttcactttaaaataaagtgaagaatagtaggtttccagttgtaggttcaactccctataataagttcaacaaggtatggttgtgtaaataaaagacactggaattttgtggcgtccatgcttaaaaagttagaaacgagtgtttcatcatcatatacaaaaccatggcaggttgtaatgtagatttatggcaagtggttaaggataacccgtagtacagcaagtaaggacagattatggtctgttattagaataattgttgagagtaagagcacttgtgtatgtaaagatgagtagcacatatagtggtgtgcaatgtcagaatgaagtttcagatgatctccagcgaactatgttggaggcaggaagatgctcttgttgtattcttaacagtaagtaccaaaaggagtagacctctcacgtcattttcgtattaataagtcctgtctctatattagaattggattgtcttgcacccagctggttgaaggctggcagtataaatatatcctgg

SEQ ID NO: 585366 - DNA, 830 bp, Homo sapiens
gcgaccgacccgaacacttcttgcttgttgctctcgggagcggcttgtcctgtgtgctatcgctgggcctgtcctaatcgataacttattccggatcccgctgctgtacgtatctcgtcgacgcgtcagtgtcgcgttcatgtcagtgggctacgtggattaatctcagtgggtgaggttcggagagagacaggcctgcgatgtccgtatcgaagcgaggagcacgccggggcacgctcgctgaggtgaaggcaggccgacggggccgccgatgatttggaaccggaaggggacaggaatttccgaggcagccggagcacaggcgtttctcagaatgagcctgcggaaacttgagcgaagtaatacataccgagaagctagcgcagggttctaaaaccatcagacgaggatgttgtgtcttgagcacttcgggggcctagtagggggctgtcgctcgctgggggcctagtaggagcgaggtgcctcctacgacgggcattggccttggtatcggctctgaacggagggagtcttacgctccgtgcgtgcgccagggagactgcggctgcgctgagagactcgacggcaggagaaagggtgggatcagcaaggtcaccgctagggggcagagagtcgaggattgacgaggcctatgccttggagagaggcacggttgcgttggcctatggtgtccaggaggaatagctggtgttaggaaggtgggaaacggggaggaattcctcgtggacgaagcggaacaccggccaagatggacgtgatcgaacccccccttattattacttaaaggccacccttagttgatgcgccag

SEQ ID NO: 585367 - DNA, 517 bp, Homo sapiens
  misc_feature (242)..(242): n is a, c, g, or t
  misc_feature (249)..(249): n is a, c, g, or t
  misc_feature (258)..(258): n is a, c, g, or t
  misc_feature (267)..(267): n is a, c, g, or t
  misc_feature (280)..(280): n is a, c, g, or t
  misc_feature (282)..(282): n is a, c, g, or t
  misc_feature (284)..(284): n is a, c, g, or t
  misc_feature (335)..(337): n is a, c, g, or t
  misc_feature (339)..(339): n is a, c, g, or t
  misc_feature (343)..(343): n is a, c, g, or t
  misc_feature (349)..(349): n is a, c, g, or t
ggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaactctcaganaggcaanacaccaatnttgtcgganaacggtattaggnananaccaagatagaaaatgaaaatattgtcaagagtttcagatagaaaatgaannncnagcnaagacnagtattggagaagtatagaagatagaaaaatataaagccaaaaattggataaaatagcactgaacaaatgaggaaattacttggtaaccattttattttaagagacccatcaatttaatttctgatggtgcagaagttagaaggtaaagctgagaagactgacgggtg

SEQ ID NO: 585368 - DNA, 1031 bp, Homo sapiens
  misc_feature (12)..(12): n is a, c, g, or t
  misc_feature (104)..(104): n is a, c, g, or t
  misc_feature (137)..(137): n is a, c, g, or t
  misc_feature (144)..(144): n is a, c, g, or t
  misc_feature (152)..(152): n is a, c, g, or t
  misc_feature (185)..(185): n is a, c, g, or t
  misc_feature (187)..(187): n is a, c, g, or t
  misc_feature (196)..(196): n is a, c, g, or t
  misc_feature (199)..(199): n is a, c, g, or t
  misc_feature (211)..(212): n is a, c, g, or t
  misc_feature (214)..(214): n is a, c, g, or t
  misc_feature (219)..(220): n is a, c, g, or t
  misc_feature (222)..(222): n is a, c, g, or t
  misc_feature (225)..(225): n is a, c, g, or t
  misc_feature (233)..(233): n is a, c, g, or t
  misc_feature (244)..(245): n is a, c, g, or t
  misc_feature (250)..(250): n is a, c, g, or t
  misc_feature (256)..(256): n is a, c, g, or t
  misc_feature (274)..(274): n is a, c, g, or t
  misc_feature (283)..(283): n is a, c, g, or t
  misc_feature (286)..(286): n is a, c, g, or t
  misc_feature (289)..(289): n is a, c, g, or t
  misc_feature (292)..(292): n is a, c, g, or t
  misc_feature (323)..(323): n is a, c, g, or t
  misc_feature (330)..(330): n is a, c, g, or t
  misc_feature (344)..(344): n is a, c, g, or t
  misc_feature (368)..(368): n is a, c, g, or t
  misc_feature (370)..(373): n is a, c, g, or t
  misc_feature (392)..(392): n is a, c, g, or t
  misc_feature (398)..(398): n is a, c, g, or t
  misc_feature (404)..(404): n is a, c, g, or t
  misc_feature (416)..(416): n is a, c, g, or t
  misc_feature (419)..(419): n is a, c, g, or t
  misc_feature (423)..(423): n is a, c, g, or t
  misc_feature (426)..(426): n is a, c, g, or t
  misc_feature (435)..(436): n is a, c, g, or t
  misc_feature (460)..(460): n is a, c, g, or t
  misc_feature (591)..(591): n is a, c, g, or t
  misc_feature (667)..(667): n is a, c, g, or t
  misc_feature (777)..(777): n is a, c, g, or t
  misc_feature (975)..(975): n is a, c, g, or t
ctaatatcaacntattggtcaataaaacttgtgccttaaagtcttttacagtattttttgaaaattaacttttttttaactgcatatatgggtcttcacttcanttttcagtgaagacaacttatttggatatcagngtgtcancacttganaagaccagtggaggatttggatagtagcgagcngngtttgaatngcntgaagagaatgnngngaatnngnagngcagaggnaattgtgcganngcgtnaatacntggaattgcaatagtgcngtaagtgcngantcnctnacaagaccatgtataaaccaaggagtgttcngtatttnccagtgccaaaacngaatcaataaaaaaagagcgccantnnnnagatgaagtatttaaaggntttgcntttggnccctcagatttnccnttcntcnctagaggcnntgactccgcaggcctctgactccncgtgcctgcatcccctctgagtgcttccaggatgaggactgtgtcccaattacgatagtgacgagctgggaaaatatctgaatgcatgcgcgtgaccaaaataaacaaccttgggttcaggtttgccagtnattttcttcagaagttcatagaggtggacagcgttcccttgggagtaccagccaggtttatccagagatggcagtncctcctgctcctcatcattctcgagtgtacggaaaggtctctgacttggtaagtgggagaagaaaccaggcttcaatgcatttgtaatcacaatgtcaaaaaggtctgtnaaatcattcccaagaatatattcgcagagaagtctacagttatcactgtgagaactggtaattaacagaagaattttcccagcattctttagctgtggaagccattttttcacagattcaggacaactatgttaatatctgcctggatctctttttatttctgggaaatatattccacagttttccttaaaagctganattttataattgtgtgtatagcagcactatatacttccaaaatcaaatgtgttttg

SEQ ID NO: 585369 - DNA, 529 bp, Homo sapiens
cgggggggggtgcacactttcccccgataaccaccgaccaaaaaaagggactcttgaaccagaacaagctggggttctcaaaaggttcggggtccaaccgctcaccctgcatgcaaaaagacgcccgctctcccagacagagggtcaaaacacgggcccccgcgaccattgttaagctcttgtatcacacgcgcaaggggctaaaagggcagtgggagggttttacgccgtgttaagcagcttttgtaaaaaaggggtgccagccccccattaagaacccctggtccctaaggagggtaccactccgggtcaagaaagctgggccgccttatgcttatcacaccaccggtgaaggccgcgcaccctcccgtgagactaagagaaaggccctggggttcctccgcccattcctctgtttttgttagcccatgatggaagtcatacccgctgtgtaaggagcataaatttccttcatcgtctcgccccttttgtaggggcccccttttttaaaaaaaaaaaggattcttgg

SEQ ID NO: 585370 - DNA, 409 bp, Homo sapiens
  misc_feature (99)..(100): n is a, c, g, or t
  misc_feature (102)..(102): n is a, c, g, or t
  misc_feature (108)..(108): n is a, c, g, or t
  misc_feature (234)..(234): n is a, c, g, or t
  misc_feature (243)..(243): n is a, c, g, or t
  misc_feature (293)..(293): n is a, c, g, or t
  misc_feature (347)..(347): n is a, c, g, or t
  misc_feature (361)..(361): n is a, c, g, or t
  misc_feature (409)..(409): n is a, c, g, or t
ttttttgtctcatcagtctgcaactttattctttgtacagtttgggtgaagtaagagcaaaggctttcactcactcccaccctcattccaggaattttnngnaaaganctcccaagatttgcaaggattcccatggcacttgagcacaagctgcactacgtttgttttccaaaatgaagttagagacccggtaaaggatgaccttagaagtgactgggggtgaaaggcacctgncctggggantggggaaaggaaaggttcccccaccttgcccacaaggaaagcaagccganaagcttgaaaacttgaactggtttccatggcatgttctggtctggacatcagancttcctctgacttngctctgccccccaaactaagtttggctggtgactcataaagggctggn

SEQ ID NO: 585371 - DNA, 229 bp, Homo sapiens
  misc_feature (19)..(19): n is a, c, g, or t
  misc_feature (27)..(27): n is a, c, g, or t
  misc_feature (47)..(47): n is a, c, g, or t
  misc_feature (56)..(56): n is a, c, g, or t
  misc_feature (149)..(149): n is a, c, g, or t
  misc_feature (184)..(184): n is a, c, g, or t
  misc_feature (213)..(213): n is a, c, g, or t
gaaccacgcctttcgcctncggaggcngggggcttcctcacctactncaacctcanctccgggggggagctgatgaagtccaagtactcagacatcaccatcatgtttgaggagacgcaggtgcccgcgctgctggaggccggcttccngatggagaacatccgtacggaggtggatggcgctngtcccaccggccgactgccgctactacgncttcccacagatggat

SEQ ID NO: 585372 - DNA, 1373 bp, Homo sapiens
  misc_feature (1079)..(1079): n is a, c, g, or t
cactggctcagctgacaacagctgtacgtctctgggactgtgaaacagtgaaagcagctggaccttactcaagcaccaattcggctagtccggacctagcggctctatgactattgggggcaagcatcatcgatgttctccagcggaccaagccagactggcgctaccaaggtgcatttcgtgacgcttcacaagacactgcggcgatcccgatgccagcatatgaccaaacaagtggagaccctacatagcaagatccacatatggcaactagagctactaatacatccaccacgatgctagtcaagcggcgacgcccatgagaggagaagttgcagtcatacgcctgggcccatgcagacgtgcgcagcagcatcaaaacccagctattcagtggcccagaagctcataggcaggagcgctcgtaacgcgctgcacactcgctccaagcgcaatcatctcacgcgggaccatgactcaacccgaaccaatcccaggcttaatccgcaggggaacccagttgaccgcgcaatgggttacatgggtggacacctgctcggcttcacacacgtggtcgcgtccatcgagcgatgtcgcctaggccatactctcagggatgttccccacaataacacttctctattgtaagacatacttcctagtaaccaggacccatgtcacccacggtacagagaaaaagccgtatgccgtgagagcagacgccatcagccagcgccgtggcccccaccgccaatgcgcacctcgtcgaagccgtctaatgacacgcctacattgcgtgccggctcccccatgagacgcacgagtgctagggcacacccacgacgacacatgtccgcccatcacgaggaccactggttcaaccagccgcccgcagacacacactatacacaaactccacgcgcgaacgtcggccacccacacgcctctaactgacaagagctacgcctagccacttccctaatacttcccaccaccatctcagtaactcacatactagttaaattgacaatcgaactcaacactacttgactacacaatcctccatttcacgccatacngcagtcactacaccctcatacgacgcacaacaccacatatatttacaacaccccgtctatacctctcgcccctcatatcatacagtcctacaacactatacaactataagtccaccttcgcatcatgctacccaacataccactcgcatgacgctccaaccgctacacaacaactttagtcattaaccacactcttgacgtcatcttcaccatcagtacagtacatcgagcactgcctgatcacacatacttactcatcccacctcatagcttacagcagccatctataactga

SEQ ID NO: 585373 - DNA, 427 bp, Homo sapiens
tattacattagtatattacgttatttattatgatcctagttgatggcctaaataaacacctttttctttaaaaaaaaaaaaaaaaaaaaaaaaaaaaaaaaaaaagaaaaaaaaaaataaaaaaaaaaagggggggggacgtagatatccgggggggacagatcctaagttgcaccgcgcttctagggacaccaaactggggccccctagagtggggcggctcttataaatacgcgcaagggagatggggcgccggttgttaaaaaaaacgcccgggcggggggaaaacaccgcgccacagcggggacacacttttgggagaaaaggaccccaaacatctggggggggcggaacaaacagagggcgaacgaatcctccacgccaggagtcttttaaagcctctcccagagaaaatataaaattcttg

SEQ ID NO: 585374 - DNA, 199 bp, Homo sapiens
atacaagaaatatgtatgagctgatcaaaaagagttgggttggaggagaaggaaatgatggaagtggagtgatctcagagctccatgttagcaactcatgggagtgtggagccggtccatctgatctgtcagcccaccctggacaggacaatacaggcctacggaggtcatggaggagctacgccgagctcgggcgaag

SEQ ID NO: 585375 - DNA, 438 bp, Homo sapiens
gggtcacccagcgtcgataaaggacgcgcaaagatgctcacatctcccccttctccttgggcgggatcatccagcatgatgttcgacaatggcagcatctacaagcctgaagtgcttgatatcacagaggaaactctgcattctcgcgtcctggagggtgtccgcaatgttgccagtgtctgtctgcagatgggttacccaactgtggcatcagaaccccattctatcatcaacgggtacaaacgagtcctggcctagtgtgtggagacggatgacaccttcccacttgctgagaaggtcaaggccttcttggctgatccatctgcctttgtggctgctgcccctgtggctgctgccaccacagctgctcctgctgctagtgcagccccagctaaggttgaagccaaggaagagtcggaggagtcggacgaggatatg

SEQ ID NO: 585376 - DNA, 200 bp, Homo sapiens
acagctcccccgagggacgcgagcgcctgttcttaatgtaggggcccatcgcgtggcaaatagcgcgggtgacaaagccccacacacctggtgcccctgcgcgggctgtagataggatgtaagaatagaggggacacacgctgaaccggcgctacaaaagtggggtaacgcgcccccaacgccccatcaatgaacacaaa

SEQ ID NO: 585377 - DNA, 833 bp, Homo sapiens
  misc_feature (124)..(124): n is a, c, g, or t
gtgataatcaacaatatgcaatattgatggtaccagagtatcttgtatgttgggtcatgatctccaataagtgctgctatacatgtcgcttgacatgtagatacttaatccatcgcctcgatangcagaaatatgctatctcttctgtagacaccattgtaaccctcaaccactctgctatagacgccaagtatagtagctcttagtgtctccattgtaagactaaagagcagtgttgtgattttagacccagacagagaggagttagcttctgaattcgtaaatatgtgttccccattcctcatattcgagcctctcctctccgggttgcctcctgccagcagcatccatggtttcatttgacaccgtttttgaaattatccaggacaagtctgtaaaatcagagatacgtacaaaatgtcatactcaactctctacctgtttgatcattcttctcccccttatctaaatttgtagctaatctctgataatgtaagattgcttgattctgcattctctagctgtaggctgtgagggacttccagggattacatggaacaaaactggtgttcttaggtacactgggtgtagagtacctgaagtctgccttttccatttagtgacccttctcgaggaaaatttgctttccctcataacttattgtagtctctcttaaccatcttactatattggcaacgacattgctctggcctggacatttgaaggacccgatacggaaatggaaagtcaacccaattggctgaattgtcaccttcacttctggaactccgatgaagtgtgccactacgaatctaagcttggtcctggcatag

SEQ ID NO: 585378 - DNA, 267 bp, Homo sapiens
gggggggggtttttgcccccccccccagcgcttggggaatccccttggggggggtggttgacatccccccgtttgggcgttgcatggaggggggggccggcctttcccatccccggggggcaggggtttctgccccaggagctgctcccggagcctgggcgggttgcctgggaacgggcccgggccctgttctgggggcccgccccacgggggcccacggttttttttaaaaaaggccccggttttggtttgggttggggcccggga

SEQ ID NO: 585379 - DNA, 834 bp, Homo sapiens
aaacataaattattttgccggcagacatctctctatacaatattattattttctttttccatcgatttttttcgagaacgcccgctgaaatgtgcacacttaaaactaataaagaggttccgggattagttcatcaactttagagcaaacatgcacatctctgaaagccaacaagaattcttcagaatgctggatgaaaaaattgaaaagtatttatttatgaatctctaagctatgatggatatcactcaacagaagataatgaagaaggcgttaaattcattactattatttatcagcagatcccactttgacatggaccctctgagagaataattgtgtcatgttctaagccaccattaaaagactatctgaggccaccaatgctaaaaatatatatggataatgaattaaaatgagagctgaatttatcgcgtcccctgtacgctcaagaacgtgtactcgttcgaggtgaaaaataaacactcggtcctctcttggtctaacggcggatttctgctgtcggcttcatttcccgtggatcattctttgcatctcattcattgcctcgtccgtcgctcatctctttgctcccatatccctgctcccaatctccctttggccgctacccccaccccctccatccttgtcgcaccctacatctaatcgcccctctgcattccacggatcccaaatcagcctgcatcctaccaaaagtcatatgtgcaacttgcgtaccccgctttctttttttgaccgcgacaattttccctaattcatgtctttgcactatgaattactcccttttccatcatctcttgcccactctccctg

SEQ ID NO: 585380 - DNA, 1041 bp, Homo sapiens
aaactcccccgggcagcaggaatgacacccttgtatgcaggcagcgtctgcaccaacatgggtatctgggcctccccaggcccagcactgccccgacagcggggtcaagagaacctactctgaggtgtatccaggcagcagtatctgcaaggaggccagtatgaaaccagaacgccagtttggcccagccctgggaggcacctgccctccccttctaacctgtggcacaggcatgaccattgaggcatgtggcatgcaccagtccctgctccgagacatggacccacgggacttgcattataagactacccgataccattaccgagctaccgccaattccccacatgcagggaaacccacggaaacacatgaaaccaaggcaagtagcgaccactcaaaagtgtcaccaaaacaagacggtgcaagttccactattatagccgtgatctcaagccaaaactcaactcactagacaactcagaatcgcgcctcatgcgacgacgggccatgagaagaagtagcaggcaggacgcatacccgagcggcaagcgacagggggagtaggcacactgaaaaacccaaacagacaagcagaacaacatgagactggacacgaccacatgataaacccggaagagaacaccagcgagaaggaacactgcagaaacaaaggcaggaacaggagaagaagacaaaagagataccaccaaaaagacagaagaataacgagcaacaggcacaccagagaagagaagaactgcaacgaccgcaacgaaagagagggaacacgagaacaaaacgcacacgaagcctgtgtgagccgacaaacacacaaacacgaaacatgcaagacaacacaagctgagaaagacagccacgacagggcaaagagcagacacagacacgcagagagaggacaagagacgaacacggccaccagaccgccccagagcaggacacgagggagcagcacggaaccgcacgacaaagcagcagagaaacagaacagacacagacgaacgaacacaaagtgacgaagaa

SEQ ID NO: 585381 - DNA, 182 bp, Homo sapiens
caataggaaatgcatgcccacttcttggtctcgggaatgtgttatggtcaacaggtccatggagatcagagcgctgctgcttcctgggctgctccagagcatgcaaacctgctcgtggggccacttcagcctctcttctggggtccgggtctggggtggcatcgataaacaccgggtagcgg

SEQ ID NO: 585382 - DNA, 855 bp, Homo sapiens
tggtgttttcgagcttgaattctcacctgtgatttttttttttaaatgttgttctcatgacttgattttcctcataagccaatgtattggtaggttaacgggatttattttaagggagtgggtaattcctctccctttttggattaagtgggtctcagctatggtgctatccagtaggtatctctcaggtgtcaaggtcccgtagctaaatgccatggttcattataattattatttggtaatcacatttgtaagcttgaattggggcttgtacctgcatctttggtattctggtacatctgggttacttaaacttggggaggtccaattgggttcagtcatgttatgtctacttggtagttaagtagacttcatcaactatggtctattggggtatgagaagtttcacttccaaacatggtgtaacaatcggatgtttggctttgggacttcatttggacattaagttggaaagtaacatttattccaaatttctcggaatcctggtatttggaccatttccactcgtaaattggtaatatacctggctgtgaacatccttgaataaagatgacaagaaaccaacaacacacaaaacaaaacaaaaaaacaaaaacaacaaacaaaaaaaaacagggggccacagtaaataaacaacccagcaagcacccaccacggaggcacccacgcatagagagaaagaagccacaaaaagatgagaataacagaaaacatacacaaaaaaacgagcaacaaaaacaggcaacatcaaatggcgagaaaaacaacgtgagtagaaaatgacaccacaacaacccagagcaaaaaacataagccaaagcaaaaggacaacaa

SEQ ID NO: 585383 - DNA, 112 bp, Homo sapiens
ccaggaattcgagactagcctgggcacatagtgaaaccctcgtctctacaaaaaatacggaaaatactgacatgggctgcttcagtgtgattggggcttaagggacccttgg

SEQ ID NO: 585384 - DNA, 406 bp, Homo sapiens
agcactgccagcctcatagacatcatccttagtatagtactgagacaggaacagacggaccagattagaatgcatagaaagagaagcgacacagcaccatcatcctctgacttacttagaggagcagcagtcgcccctatatactcccgacgatactctcagtgcagagggcacaaatcgagtaatctctgccttggacttagagatctgtggctatggcactgatggttgctgtgactttcttctcaatggtggctgcacttgtatcatccgccttggatcgctgaatcaagttgggtggggcacttaaaaccccagggtatgacaagggaactggtgagaacagcccagggggggcagatccacggggaggcaccaaaggtgggcgcatcatgccaggacgagg

SEQ ID NO: 585385 - DNA, 181 bp, Homo sapiens
taaaaaggttttttttgggcccccccccccccccccccccccgggggtttttttttcccccccctaagccccggggggggggttttttttttgggggggccccggggggggttttttcccccgggggggttttccccctttttggttttttttttttatttttttttttttccccccccca

SEQ ID NO: 585386 - DNA, 1636 bp, Homo sapiens
gggacgtgttcgtgaactgcacgggcagtcctggggggtcagtgtcaagatctagcacagggatcgtctggtgcgaatgcgggtgacccggggcaccctacgaacgtttcggcgtcgaccatgtcttgccccacttgtgcgggtagtatggtacctttcgtatggttgtttcccgcactttcttcgtgcaatcactgtgcctgcgttgtttgttctgttttattcggtttagtttctgtgaaacccatgatcgtggtttcctgtgtcccaagtgactgtgtggcaggcgtgcccggctctggcagggactgtgtggtgtacgcggggaccggtcccaggccccgtgccccgccgggctcagcctcccaagtgcgctcgcgcttgcctgtgtcccgggcttgtctgtgaagtgctgcctgaagatcgttgccaccttccgaccgtacctcatcaggggtgttctggggacaccatgatctcgtggattgttcatagtcgttgtagctgcagccgggaacacaccgccgctccggagacagggccagctcccctacgaccctagcgcaccatccagccctgccgcggcccctctcctctcattccgtgcatctgtcccgccttcgtccatcagggagcagcgtgacttcagcgagtcccgcgagcacctggctagacagttaacaagcacgtccttccagcctgagccagcgcaggtttgggagggggcttcctggccccccccacggtgtccagcccctcctctcttccgcgcctatctcccaccttccctccgtagaacattctcttccctctccgcaggctcaatgaatcgaatgaatgtgaacttcttcatctgtgaaaaatcttgtattggttttccatttggagcgtgttagggggcttctgttcgagttgggcgagagagcgatggcatgccgtggggagtactggaggagccctcgcggcaagcagggtggggggggactttgggggcgtgccgggcccatcatctctacgcctgtactagtggtctcagatgctgttgtcttatcaaaaatggggatccttccagtgtggagccgagccagagaagatagcgagagtctaaatctctggccaaacaaagaaaaagacagaatatacgaacatgtggaaaaggaagaagggacaaggcagcggaactttagtaaaggtgatattgtataatattaaaagggggaagatggggaacccgcaaaaggatcgagaagcggggctgagcagaaggaataaagaaaaggggtgtatataccacaaaccagggcaccaagagattaacaaacaacactgcacaaacaggaaagacacaaaacgaaccacagggaacgagaaaaaggaaggaagagagggacaagcacaagacaccaagcgtagtatggaggacccgtgccaagggaaaggaaacagtcagagcagggaacgggaccaacagggagagagaggccaaagcacagacacaagacgaggacccagcacagaggaagagatacgcagaacacgacgacagaaacagaggagcacacacagaacaaagacaaaaacaaaaaccgagaaaggaggggagcacggaaaggcaaggagagcaccaacattagac

SEQ ID NO: 585387 - DNA, 80 bp, Homo sapiens
gcccccgattgggttgtgactgccggcaacagatttcgagctcctggacctacaaggtggtgttgggcaagtacgaccgt

SEQ ID NO: 585388 - DNA, 97 bp, Homo sapiens
  misc_feature (14)..(14): n is a, c, g, or t
  misc_feature (20)..(20): n is a, c, g, or t
  misc_feature (33)..(34): n is a, c, g, or t
  misc_feature (47)..(47): n is a, c, g, or t
acgctagtcgagcnggtgtnaatcggccgaggnnagatggcggggangaagaatgttctgtcgtctctcgcagtttacgcggaagattcagagcccg

SEQ ID NO: 585389 - DNA, 158 bp, Homo sapiens
agagcggctcctacaaatttgccactccaggagggatcacggagcaagcgctgcatttgtcagcgctcattagcaacccacagacagcaggtcagcgctcactagcaacccacagacagcaggtaaaaagatgggcctgagctttcatatactcgggc

SEQ ID NO: 585390 - DNA, 355 bp, Homo sapiens
tagcgatctagaggatccttaaaagccatttctaccaaagatacataaattagccaggcctgggggcatgcacctgtagtcccagctacttgggaggctgaggtgggaggatctgggagaattgcttgagcccaggaggtggaggttgcagtgagccaagatagtaccactgcactccaccctgggtgacagagtcagagccctatctccaaaaaaaaaaagaaaaagacaaagatgctaaagcagtttcaattggagctggagctaaaaagcagataccagtgaaaattaggcaacccttacaatatttgaagaaaaaaagataggaccaattgagaaatggcgctatgggggt

SEQ ID NO: 585391 - DNA, 100 bp, Homo sapiens
atcgtcggtaaatacgggaacgctatggggcctcactccggaaaatggtcaagaaaattgagatcagccagcacgccaagtacacttgctctttctgtgg

SEQ ID NO: 585392 - DNA, 428 bp, Homo sapiens
actgcgatatcttactaagctcagataatttgaaacataacatctatcttctcctgaacagaaaagaaaaaaagaaaagcaaactagattatttagagttttggaaaactagaacttaagaattgtccagagttagaaataacaggaattacgagtgtgtgtgtgcagatggttcatgtacttagcctctcaaagtaaaaaacagctgtgaaatgatctagtaataaaatttaaattttcgcattaataactcacttccaaaaacatctgcaaagggcattaagggacaggggataaatgtgatcgacaaatacaaattcatatagttaatgctgagctaccattcacttagtgacctggcagattttaaatctctgcagaaacgactatccggccagacgtggtagctcatgcttgtaatcccagca

SEQ ID NO: 585393 - DNA, 184 bp, Homo sapiens
  misc_feature (176)..(176): n is a, c, g, or t
ctccgcttccaggtccaccattctcctgcctcagcctcccgagtagctgggactacaggtgcccaccaccacacccgcctaattttttgtagttttggtggagacggggtttcacttgtgtttggccagtgatggcctcaaatctccttgacctctgtgatccacctctcctcggncctcccaa

SEQ ID NO: 585394 - DNA, 1462 bp, Homo sapiens
tggaagcttctcacatctttatgggaaaggcacagctaagcccacccttgatacagcattttccatttctctctgtagagactcagacgattgtgaacacgagaataagcgtgacttatattacagacacagggtggtggggtgtgtgcttttttttaaaaacactttgtgtctttttttttttttaattatctccccttttctataaaagacaagcattgttattacgtggaaaaaagaaaaaaattatttatattaaaatataaaacccaaagacaccatttttagatcccctctcattcttttaattgggagaagggggaggggagaactccggggtgtcggcccacccttacaccctgggtctcaccatcccagacctacagacatagaacacgcgagcaccagcggaagccaccccccattatgggtgggacaaagaggagaagaagggcacccagggaggacacaataagaaaaggaggatagtgggaacaaaagcacaaaaggagggacaagaatgaggcggagcaaggggtgggacgaggtggggcagccaatataccccggggggacacccccgcgggaacacaaaggaagagaaaaaaaaccagcggagcgtgcccccaagcgaaccggtgcaaaaccagggggcgacaaaaataacacataaagactactacacatagcgaaggaaacccacggaggtagaaacaaagggcggcaagaggagcgccacaaagcagaaaaacaagagggaacagagtaatacacaaaatcgtacgtcacacaaaaaccagtgggaggaaaaaaaggaggaccccaaaaggagagaaaacgaaaaagcaaccaacacgacaaaaaagggaactaagagagccaacccaatgagggaaacccacgggggactcaccccaaactcttacgacacccacaacaagcgacgacttaacaccatgagaccactcacacagtgtatcaagggcacgagaggaaaacaccaacacaaaaacccaaggaccatgcacgaggcgacagctcacgaatagaacagcaagaacgcgaggaaaaatggaagagaacagcaagaagacaagcaccaaaagaggagacactaaaaaagaatagaaagcgaggccaccacccgcaacagacgacgacccaccaaaaaaaaacaaagagggggcagaatgacagcgagcactccaccacgaaagcccccgagcgtgtgcagcagacgaaaaaaaaaagacccacagaaacaaggaaacacggcccacgagagagaggaggcgcgagagcagcgcaccgacagaagaggaggagagagaagcgccggcgagcgaacacacacgaacagccacccagcaaagcagcacacagaaaacagacagaacaagggcaaacaacgagcaagcccacagaaagcagaccgccgtaaccacgagacatcaccaagcac

SEQ ID NO: 585395 - DNA, 233 bp, Homo sapiens
cgagataatggagagatgccagcccggtatgagtggggcaagggctcacatgggccaggtgcatgccgatgctcgcaggcctgctgctgccgatgctcactgctcctgcccacctcgttcccgctgccacacccctccctgggtcaccgtgagacaagcatctctaaatcagttgggtcacagccttctggatagtttggagtaggccatgggtacagctggtgtcaggacag

SEQ ID NO: 585396 - DNA, 166 bp, Homo sapiens
actctagacgatccctcagcaccttgaggatggaagagggagacggagaaggacgaagggttgggagacggacagacgaggacgtggggagggaaagaaaaatgctaaagggcaggaaaagggacagtctcattttcttgtcttatttcatatgacataggtaact

SEQ ID NO: 585397 - DNA, 1531 bp, Homo sapiens
  misc_feature (1)..(1): n is a, c, g, or t
nttttagttattggggggggccgcccctctttttgttagtatgggcggcctccttgtgtgttttcctctcgtgggatactatttgcctggtgtccttggttcacacacacagatgccgcccctctctgtgtggttaaagagtccgctcccttagaagatgactcctacctaggcgcctggtgtctcgccccgtaagacacacatttgtggtttttttcattcttagtcccccacttatgtggtaatatccttctcggctcctcttctggggtataaccctcctcattatgctgccagacgaaagttttattggtgtccccataaagagccgtttgtcgttttccccaccagaggggagcacaccaagagtgactattttatatgcctcttgtggagatattccttctctctctgtgttggggggggccacaatacctggggggcgccatccaacgaggagaaggactcttcctcctccacaagacctctctgtgtggtatagataagcccccccccatgaggggaacacctcttgtgaagtcctcctggtggttggtgaacaccagaaagattcctctccgttggtgacctcccctctaaacggaccctactattcctcaagagtatgatgtctcctcgcgcaaattacttcgctcacagatacttcggtgtagaggtcccccctcttccccacagagataatataatagtgggaaaagaactttgtgtgagaacccggcgggaatagatgaacacccctccagcatgtttatataatatctcacagcgtctctcagagccccggcagcgctcgggagagacacagtcccacgcagattccctctggcgggtgccgcgcttgtgcacacacctcgttgcttgcccatcatttctctttccgcgggcaacatctcttgtgagagaggttctctgtacacagagagctcttatagggcgtggttgttggagacttcgcccctctccccctctgggcctctctcacaggtctctctctctgtcacactcggtctgtgtgtggctcagagaggtggggcgctcttgtgtgtcacactgtgtccctcttgcttgcactctgtccacacaccctctcaccactcttctccccgcgcctctcggctccccactcttgggcgccacaccctctctaaagtttgagagacacaggagaaattctctccacacaccacacggcttttccacagagaacttccacagaccacgcacacccacagagagtgtagagctcggagagtgggtgtccccacatagccttctccacgcacagccctcttccctcttgcacaggagagggtggaagttccctcgggtcaatgcccttcccctgccacagcttctgggctttcaagaagataaaggcacttttcctctgggcacagcctttaacctggccatcctaatttggttttaagactccctgtgagaaagctttcccgcacccttaacccccgtgaggccgtgaaaaagaaagttaataaaactataaaacctg

SEQ ID NO: 585398 - DNA, 114 bp, Homo sapiens
cggaggttgagagggacactctggcacagtgacctggggagctgtgaggcaaggaagctccagtgatgaaagcaacctgtaggctggaagccgagaacaaacttgcttgccttt

SEQ ID NO: 585399 - DNA, 538 bp, Homo sapiens
  misc_feature (244)..(244): n is a, c, g, or t
  misc_feature (253)..(253): n is a, c, g, or t
  misc_feature (521)..(521): n is a, c, g, or t
  misc_feature (535)..(535): n is a, c, g, or t
tggactcactcagttcaccaataaatgtcatatcgcttttgctgcactagaagctgtttgtttccaaacccgagagattttggatgccatgaatcgcgactgtggaattccactcagtcatttacaggtagatggaggaatgaccagcaataaaattcttatgcagctacaagcagacattctgtatattccagtagtgaaaccctccatgcctgaaacaactgcactaggcgctgcatggcantgggggctnaagagggggttggtgtgtggagtcttgaacctgaggatttgtcagcatgtcacaatggagcggtttgaacctcagatcaatgctgaagaaagcgaaatccgttactccacatggaagaaagctgtgatgaagtcaattggttgggttacaactcagtctccagaaagtggtatcccataaataataccacctcacggatttccaagatgcaagctttttaatgtggatatgaaaatcctgacctattccggtctcatagtataatgangctattcctagacnccg

SEQ ID NO: 585400 - DNA, 261 bp, Homo sapiens
  misc_feature (113)..(113): n is a, c, g, or t
  misc_feature (136)..(136): n is a, c, g, or t
caacgatggtcctcagctgtgtctcgaagcagccctggtctgtacgttgaaggatctaacaatgattataatttctgtaactataacaatgattacaatttggcaggtaaagnactcctttgttctgtcctcctgntgatgagattacctctgcttttgatggttgtgttaccggagatttggacagtcatggattctttctgggccctggaaagaatccatgactgtccaaatctccggtaacacaacgggtaccgagct

SEQ ID NO: 585401 - DNA, 208 bp, Homo sapiens
ccctatggtctatgagtgctgagtggtggcttcctcccatcctcccatctcagcggttccatggctgctcccttcggcactgtgctggtttccagccctcccttcctgggtgtgtggaaattgtagacagacctctattttacagaagtttgatggttccctagatagaagtacttgagacagagcaccataccctgatccccttggc

SEQ ID NO: 585402 - DNA, 120 bp, Homo sapiens
tacactctcgctactgtatcctagggttcgtaggtagggttcgtaggtagggttcaaaggtaggactagtaggtaggactagtaggtaggggtcgtcgttaggagacgtaggtaggatta

SEQ ID NO: 585403 - DNA, 389 bp, Homo sapiens
  misc_feature (13)..(13): n is a, c, g, or t
  misc_feature (143)..(143): n is a, c, g, or t
  misc_feature (152)..(152): n is a, c, g, or t
  misc_feature (183)..(183): n is a, c, g, or t
  misc_feature (215)..(215): n is a, c, g, or t
  misc_feature (277)..(277): n is a, c, g, or t
  misc_feature (330)..(330): n is a, c, g, or t
  misc_feature (357)..(357): n is a, c, g, or t
taaaaatgcggcnacagccttaacactttctgcccccattacttcccaatacaaattggtttaaaaacaggtggttaaacatggtgggttgatatgtgggacagtttttaaaaaatcagaatgggctgggtgtggtggctcanacctgtaancccagcactttgggaggcctagaggcagatnacgaggtcaggagttcaagaccagcctcctgnccaatatggtggaaccctgtctctactaaaaatacaaaaattagctgactgtggtggcgtanacctgtagtcccagctacttgggaggctgaagcaggagaatcgcttgagcccnggaggttgaagttgcagtgagccaagnatctgccactgcactccagcctgggcgacaga

SEQ ID NO: 585404 - DNA, 1761 bp, Homo sapiens
  misc_feature (1743)..(1743): n is a, c, g, or t
tgggaggggaaaaacaaaaggtatttatccacaggccaggtctaaaaaggcacacggcagggtccccgggtggtaactcagcaccagatagggaaaaaagggtgcctaaagggcagccccacccaaagccgtgcgtgcggggcgtgcgggtgaggctccccagtgaattccagcgcagtcttctctcctcagcgggggacagctggggtagaggtttctcatacccttcaacagaacaagcgggattcctataaccatattaacattctcagcggatagtgacagaagaaagagaggaccagaaatcgtgatttaagcgtgattgggtcccttcatttctaacaccacagtgtactcttacagtcctcatattcctagaggaattttaacaccatatctctctatactttccgcgtgggttctcacacatcttctttaacaacacacaccgtgtggcggccacggacgcggtgtgcacaacgtctcgccatcagggggggccacaactagcacaactataggacgaaatctataccccacggcggtgggggggcgtggcaccaccgacgagagacacccataacaaactcacgataggacattcaagagacgtgtgagaaacagagcacccccccatatacatataaaacaggaggggccgcgagcaacgaggccaggggggctacaacacgcggggacacggactacacccatcacgcgggggggaagcaccacaaaaatcgcgagaggacaacaaccatcccgaccgacacgtttaaccacactctccctacacttcatacataaagcccgccatcacagcagacacgtggcgtcagcagcaaaacaaccaccaacttgactcctccaccaccaaaaaaacgagggggagacgctccccaaacagaccgcctggggtacacacgagcatctagtgggcctcgctacgcccatcctacagggggccacacgggcgggtcatcagcgcgactcaaacaaccagctcgcgggggcacagaacaaaagggtgcgggactacagcatccacaccagaatggaccgccacaacaggggaacccactcaggaccaaacgagcacagcgggccacacaataacggcataggaacagacggataagaccaaacaagcacggtgttccccccacactatgggccgcgtcgagcacgggggaaacacccagcgaagaggcctccacacacaggccggcgagtcgtcaactagcacgagtgggcacacctcgcgaccgtggtcaccaacatcctgggaggaacaactaacccaggacccacgcaaccaacaagagtcgtggcccacgcgtccactaacatccccgagcaccacgtgagataccagaacagatacaggaaccgtagggcatatgagcacacacgcacccgccaccaacacacgaccacacccacacacacagcagagagcaacaccacagcaaagcggaacccaaaaaacagagagggcaacccaggacaccgcaaccagacacaaaaccacgacacacacgagcacaccggaacaccacacagaccaagagcaagcagactcagaaaccacagcaggcccacagagcaacctcatgaagcaacgaggacacacagatcaaatgcagcacacacaaccatcacttgagccaccacaatcagcgatcacgcaagccaacacacaaagacacaacacagatgaagcatgaaccgcacatcgagcantcgacagcaaacacaacg

SEQ ID NO: 585405 - DNA, 126 bp, Homo sapiens
acatagagtacacatcttagtaatatattaagtgaatgtaaatggtggttaaaattacattacgtgaaattcatcttccaactctaagttaagcttgggagatacatgttagtggttaactgttaa

SEQ ID NO: 585406 - DNA, 196 bp, Homo sapiens
  misc_feature (34)..(34): n is a, c, g, or t
  misc_feature (55)..(55): n is a, c, g, or t
gtttatctgataatctaacaatctaaaattagtnctaagaccctttaggttgtgnagcataaacacatacccaaaagagaatgaaacagacatttattcatgtgtcgtctgccctcttccatccccacacacacacacatgcatacacacacacacacagccacacacacagagaatatactgtaaagagagagag

SEQ ID NO: 585407 - DNA, 522 bp, Homo sapiens
  misc_feature (21)..(21): n is a, c, g, or t
agttaagtcgggaacgcatgnacagagtggcaaaagttgcattgcccaatgtacatattctaagccgaggtcaaacaaggcaatgctttgccttcttgtttcaactctcatactataaacaagcatcgttttcacagtctgttcagtgctacgtttttcacatttttctgcttttttgttggtgatttggctgtttaaaatggcccgcaagcatagtgttaaaatgctatctagtgttcccaagcacaagaaggctgtgatgtgccttggggaaaaaaatacctgtgtatataaacttccttcagttatgagttacagtgttcttgactgtgagttccgtgttaatagaccaacagtgtatattaaaaataaagttgcccttaagccggatgcggtggctcacacctgcaatcccttcactttgggaggccgaggcaggtggatcacttgaggttaggagtttgagaccagcctgggcaacatggtgaaaccctgtctcgacaaaaaatacaaaaaactagc

SEQ ID NO: 585408 - DNA, 800 bp, Homo sapiens
gcttgtccagagtgtggtgtcttgtgctgagggtcacattgagctgcaggttgaatccgggtgctttaggatcagcaccatggggaagacttgcgaccaaatcaggaattaaagacctgccccttgggacagcctgtttccccaaaccaagaaccagaataagaaactggtggcagaaactaacctggatttccacccgtctgtcagaaggcaaagtgcagcggctaaagaggagggcgatatctctgttgtggcgaattgggccaccagcgttgtgtacccacgtcccttgggcccaaaaaatcgtggggtccaccaagatcttggtgattgacgcaaagctgggggcttggaaagcgccacttgtcccccgggggaacagattcttggaaagtgggggtggcatatcctccccttttttcctttctttgtccctccaatccttttcctccccccaggggatgtgtacaaaagcgggggggggcccctttgtgtaccccaggttggattccccaaaaccccccgaaggggtactctcctttaataatgttcagttggactttaacccttgtgctattaaccaaaaataggatagcaagcatactgcagtatcattaaacaaacaaacaaaacttattttgtgggggggccgccgtcgtacagcccctcctgaaaaaagaggttttttctagcaaccccaaacttttgtgtggggccgccgcggcgccccccactgtgaatgatatattgtacacacgtttgaacaaaactcgtgtccccagagaaagcaccctcggggc

SEQ ID NO: 585409 - DNA, 328 bp, Homo sapiens
  misc_feature (134)..(134): n is a, c, g, or t
atccaaagggggttgttctatggcaaggcagggggcgggggttcaccaaaggtgctcagtggggaagctttctgagccaggagaaggaagttcacaggttaatcgctcagttaaggtggggcaggaacaaatcnacaatggtggaatgtcatcagttaaggcaggaaccggcccttttcacttcttttgtgattcttcacttgcttcaggccatctggatgtatacatgcaggtcacaggggatatgatggctttgcttgggctcagaggtctgacacacatcactaagcttactctatggattcgcctcaaattctttcgtcgacgc

SEQ ID NO: 585410 - DNA, 157 bp, Homo sapiens
ttattgctaggatgaggatggatagtataggcagacctcctattgtaggacggatcggagaattgtggtaggcgaatagcgaaaatatcattcgggcttgatgtggggaggggtgtataaggggtgctagggtataatgtctggtcgctagagtctg

SEQ ID NO: 585411 - DNA, 275 bp, Homo sapiens
gactggtatgagatggtatctcattgtaacctctatctgcatttctctaatcctcagtgatactgagtttttcacatgcttgctggccacatgtcttcttttgtaaagtatctgttcatgtcctatgcccactatttaatggagttgtttttgtcttataaatttaagtaccttgtagatgctggatactagacctttgtcagatacatagatagcaaatattatctcacaatactataggtcgtatggttaaaacagaaagtttctactgctaa

SEQ ID NO: 585412 - DNA, 728 bp, Homo sapiens
  misc_feature (624)..(624): n is a, c, g, or t
aaaaaggggggttttttgtttttttccaggaatcccgcccttttaaagattaaaaaaaccaggttcttccccctgcttttaaaattcttttccgccaaaaaattttgggggaaggctttttttttgcaagggcctgttttaaactaaaaaacgggttaacataaaggttccaaatttaaagcccttttaagggttcattttcaaaataatttttccttcctggggcccccaaaaaaaaaaagattcccccccccttggaaattaagtttttaaatttccaaaaaccctcttttaaaacaggggggaataatttccacccgggcttttttcaaggctttctttttttcaaaacttccgggaatttttggagatttcttggtggaagggggccttattggaaaaaaacccttgtcttcccagggaagtttcccttggaaaatttttttccggggaataaaaaacggggggggttccccctttttttcccaaaaagttaaatgcccgggcccgggggggttttttttggaggggggggggttgccccggatcccgcctcttttgattttttgaggagggcttttttgggggcccttaatttttctttaatgtccccccgggaattgntttggggggggtgaacttttcttttttttcccgaaaagctctcccgccggaaaattttcgggggggggcccttccatataggggtttttcccccaggtttttta

SEQ ID NO: 585413 - DNA, 161 bp, Homo sapiens
tctagagcttaatgacctttgtactcttctgctctcactcactgggttggggtctagcgtcaaagacatacgatgccacatgagaccgacgcaaccaactatggcatatgtcccatcccacatccaaccccaactctcacttggatcccttcctatccctg

SEQ ID NO: 585414 - DNA, 130 bp, Homo sapiens
tcaccgtcttcattctctaccagttgactttgctggttaatttcttcatccttgtccatcaagctgtttgtataattatagcaatttcttcttcacactttcttccttcagcatcagtaaaatttcttat

SEQ ID NO: 585415 - DNA, 601 bp, Homo sapiens
  misc_feature (169)..(169): n is a, c, g, or t
  misc_feature (219)..(219): n is a, c, g, or t
  misc_feature (235)..(235): n is a, c, g, or t
ggtcatcatcctcaggaagacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcncacagccacggatcctggagatgacaaggaagagaaccggcgctcgggcngctgcccacacaccgncggaggggtagcttcagctctgagaactactggcgcaagtcatacgagtcctcagaggactgctctgaggcagcaggcagccctgcccgaaaggtgaagatgcggcggcactgagtctacccgacgcctcctgggaactctggctcatccttacgtagttgcccctcctttagtaccgagggtgatagtaaacagttcattggggggttacagtaaaaaggtaaataatagattctatatattttaccttggtattgttgccatgttaaggctgaagaatagaataggccaggacctaggttctcatattcttggtattcctcctggatggaaaggctgtgggaatcaataggggacagaggctga

SEQ ID NO: 585416 - DNA, 204 bp, Homo sapiens
gagcaagcaggccttcggactcaggctccaggcgagaaattgtggctgcgtgagatcacccttcccggttttccaatgcgtcccgtagtcttcgctcattccgtcgaaacacattttttcgttccgcgttccaccagacggcatgagcttaaaagtcaaacccgctagcggaactgcgattgtccttgcttgaaaactctgcgt

SEQ ID NO: 585417 - DNA, 790 bp, Homo sapiens
  misc_feature (378)..(378): n is a, c, g, or t
  misc_feature (457)..(458): n is a, c, g, or t
  misc_feature (474)..(474): n is a, c, g, or t
  misc_feature (499)..(499): n is a, c, g, or t
  misc_feature (504)..(504): n is a, c, g, or t
  misc_feature (528)..(528): n is a, c, g, or t
  misc_feature (540)..(540): n is a, c, g, or t
gccaggtattgaaagtgccgagatccgtgcagtctgtgccgtccggtgaggggcatgcatttgagctgactgtttcgtgccaggtgtgctgcccaaaggaatcctgaatggagatctcatcagccaggatgcctagcccccgtgtcccagcggttgtgccgagcacgtgtgctacccaagaccgagtcactgtgcagtctggttcatgtatcagatagctgaagggtgtgctcggtggacgatactgactcgaatgtgtcgtctggctgataccaatcagcctggtcagtgagtacagtcacccagacttatcattgcctggtcaagaagcaggccttgggcagtgttcctgctgatcgtgggcatcttgctggtgtngatggctgtggtccttgcatctctgatatataggcgcagacttatgaagcaagacttctccgtaccccagttgccacannagcagcagtcactggntgcgtctaccccgcatcttctgctnctgtnccattggtgagaatagccccctcntcagtgggcagnaggtctgagtactctcatatgatgctgtgattttcctggagttgacagaaacacctatatttcccccagtcttccctgggagactactattaactgacatacaattactccaggagtcctgaaagagaccaggacatacagaaacgcacaggaaacaaagacgagaaacacggggtgacatatcagagagggtacagggacgtaagaattgaggaacgggggagaaagcacgccgagcgggctgaaagag

SEQ ID NO: 585418 - DNA, 1278 bp, Homo sapiens
ctccttcaggccgcacacctcccaactgaagcaagagtcatacactgtcgagaacatcaagcaggatcagatgaaatctcaaaaggaaatagaaagaccgacgaggcagcaaaacaggactccctttctcctctccctgcccccatcctccttgtcaccccagcagtcccgcccagataccctcccactgaaaagtcttcactactacagcaaggagcctcccttcaaggggactggataatcaaaaatcaaaagcctgttcttccccaagagcaaagcaaggaaattctaacacctcttcaccaacccttccatatcagtgcatgcccccatacctactccttcgcccttgtttctcctccccccatctattcatctcactaaaggacataacctcaaactgtcgtatatgctctgttacttcctcccaaggggccctctgccctctcctcatccttacataccagctcagaggaacactcccaggggagcactggcaagtaaacttcacccacatgcctcccgtcaaaaaatctaaatatcttcttaccctcgtagacactttttcaggttgagtagaagcatttcctaccccttcagaaaaagctgcagaagtctctcaaattctcatatcagaaattatccctagatttggtctcccgagccccatacaatcagacaatgggcctagcttcatctcccaaattacccaacaggtctccccatcccttggcgttcagtggcgcctccatatcccatatcagccccagtcatctggagaagtcgagagggcaaacggaattctcacaactcagttaaccaaactcacacttgagatcaaaaaaccatgggacctcccttttgcccataggcactgggagagcattaggaggccagtccaaaagcaccctccttcctcagtccatttgagttaatatacggacgccctttcctcttacaaaacaggcccccttctaactctcagctagggagaatacctcccaacagtctccctcatgaggctatctcctctgccaacaagccgacccaggccctcccaaaaccccacgaaggggttctccaatcccaaataggacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttc

SEQ ID NO: 585419 - DNA, 478 bp, Homo sapiens
tatccaaacaccaggaaaggtcctccctcaaaaaagcatatctccatcttctctctatgctgtagtctaaacccacgcgtgttgaatcgaactggggacgacgcgggcactgctccctcgagcgtggtgtagttagtcagtggacctttgctcaatacgaaatccttagctaccgattggtccgagaacacggttttccccccaatttccaacgcaccttcccttagctcctgctctcagagctaggcacagtgggcacaggtcccctcccgtctgtcctctcccagcaactgtgccctggagggctccacaatggcccccgtgtctctcgggcaccacccatatagcagtcccagagggcccatctgtaaaggatcgagcttgtgtgtggtgtcgtggtcacatctcccgcttccccccatcctgtgtctgggcacagttcacatcaggacagcgtccattgtgctctcagtctgcc

SEQ ID NO: 585420 - DNA, 146 bp, Homo sapiens
tccacgtatatgtacactatagaatgtagaggtgaggtgcaggagcaggtcatggtgataaaagaaaaacctcagccggattaaatttaaaggagtttcattgagcaatgaactatttgtgaatcgggcagcccccagaatcacag

SEQ ID NO: 585421 - DNA, 467 bp, Homo sapiens
  misc_feature (419)..(419): n is a, c, g, or t
aattgataaaacactcactgacattgcctgccgtagtccttggaattccaggttttctgccatttactatcaaggccacacttaatcaagggtcaagccttgacaaaatggcattgagagacatgattcgtaaccctttgtattccccaaactgctttttctttcgtggaaagactagatcgtaaggaaactcatttgcagggcaccctcgggcagccagtccctgtgctaagagctaacattctgaatctcactttgtctgcacattgatgggaggccttcttagtcctgtttgatatgggagggagttgaggtcaaagagcaagtaagaacagaggcagaatttgaaccccagcattccagcaggcaatgtgtctttattcattttctgatgcttataacagaatacctgaaactgngtaatttataaagataaggaatgtatttcttatggttatagaggctga

SEQ ID NO: 585422 - DNA, 598 bp, Homo sapiens
  misc_feature (242)..(242): n is a, c, g, or t
  misc_feature (276)..(276): n is a, c, g, or t
  misc_feature (318)..(318): n is a, c, g, or t
  misc_feature (323)..(323): n is a, c, g, or t
  misc_feature (340)..(340): n is a, c, g, or t
  misc_feature (390)..(391): n is a, c, g, or t
  misc_feature (403)..(403): n is a, c, g, or t
  misc_feature (410)..(411): n is a, c, g, or t
  misc_feature (422)..(422): n is a, c, g, or t
  misc_feature (458)..(458): n is a, c, g, or t
  misc_feature (525)..(525): n is a, c, g, or t
  misc_feature (552)..(552): n is a, c, g, or t
  misc_feature (574)..(574): n is a, c, g, or t
  misc_feature (586)..(586): n is a, c, g, or t
gagagagagagaggggcggggggtaacctctttacttcccctaggtgaagacagaaagaaggggagaagcaagccgggggtgactgggtgggcagcgtgccttacgcaacggcggggggggggggaaacgggggaaacaaagaacgaataaagttaactggttttgggaacccaataaaaaaagggaaaaacacagcagtctctttcctttggcccttgttagcgggaagggcacgacctcnttccttagagagggggggttgttacgaacggccntagacgcggacgcatttccaccttgggcccatttgcccatgnttagntttaccccagcgttganttgccttagatgtcatgaagaccaggggtatttccccaagatattccctnntttcccaggtgnagccctnnccctccgaganaaaaccgatggggagggcaacattagcagccaacanctaattgcgccccctagcaaggtccctcggtagctgagacccccctgagaacttggctaacccctgncccccccaagttttgggcctggattgnaagacccaagctgagcccaggntggttcaagccnaccccccgagtt

SEQ ID NO: 585423 - DNA, 431 bp, Homo sapiens
  misc_feature (51)..(51): n is a, c, g, or t
  misc_feature (74)..(74): n is a, c, g, or t
aggaaattcggcaacgaagagaacaacaacaccacccatgcccggctaaanttttttccttatttttggtgganatggggttttaacatgttggccgggctggtcctcagactcctgacttcggatgattctccctgccttggcctccccagggtgctgggattgcaggtgggagccactgtgtccggcccatttttgttcactttaaaacttatacccaggcttggtggctcctgcctgtagtcccggcattttggggggccgagccgggtggatcacttgaggtcgggagtttcagaccagtctggccggcatggtgaggccctgtctttaccaaaaaatacaacaattagccgggtgtggtggtgcgcgcctgtggtcccagctgcttgggaggctgacacagggggatcgctttaaaatctgtctca

SEQ ID NO: 585424 - DNA, 503 bp, Homo sapiens
  misc_feature (9)..(9): n is a, c, g, or t
  misc_feature (40)..(40): n is a, c, g, or t
cccgttttncctaaattccaaaaaaaatagctgggcccgntgccgggcgcctgtggtcccagctacttggaggctgaagcaggagcatggcgtgaacctgggaggcagagcttgcagtgagctgagatcgcaccactgtactccagcctgggtgactgagcgagactccatctcaaacaaaaaaagaaagaaattgccttatgtcaaaaattagcaattttatgctgggcatggtggctcacgcctgtaatcccagcactttgggaggctgaggtaggtggatcatgaggtcaggagatcgagaccatcctggctaacatggtgaaaccctgtctttactaaaaatgcaaaaaattagttgggcatggtggcgggcgcctgtggtcccggctgctcgggaggctgaggcaggagaatggcgtggacccgggaggcagagcttgcagtgagctgagatcacgccactgcactccaacctgggtgacagagcgagactccatctc

SEQ ID NO: 585425 - DNA, 377 bp, Homo sapiens
ccattccagtaaggagttgcaggaaggggaggatgccattcttttctcccccgttctttcccccaggactggcaggccacgctgatgggtatgggggtgagcagagaacaggtgggctgtgggctgcttctcctggaaaaacagtagtatctgcaggatagggtacagtcttgggacgttagagctgagacaaccactgtgccactatctgcactccatggtcttaccccagatcggagtagcactgtggtgatgtgctagaggtctcaacaccgacatctcagaaaattttgtctgctgacagagcttggggagcagagagctcaccctttttcagttttagagaattaatccctctctctctctcttcattgttc

SEQ ID NO: 585426 - DNA, 386 bp, Homo sapiens
gccatctccgggactccaaacgccccaggtctcttgtgctgtatagctgcctgggcctgcaggatgttccacgggatcccagctactcctggtgttggagcccctgggaacaagccggagctgtattgaggaagtaaagctctacaagaatgctcgggagcgggagaagtatgacaacatggcagagctctttgccgtggtgaagacgatgcaggccctggagaaggcgtacatcaaggactgtgtcacccccaatgagtacactgcagcctgctccaggctccttggtccagttacaaagctgccttccgacagttccaaggcttcagagattcagctccatttgattgaattttgccgaaagttcagactgggactgcccactt

SEQ ID NO: 585427 - DNA, 466 bp, Homo sapiens
  misc_feature (447)..(447): n is a, c, g, or t
ggaaaataaatgcccaactccaacccactctagccattcagtccacctgtgcagggtgggaactgagacacatctgtgaagttcacagtccagaggcacaggctacctaaagaacagatacctaattgtgaaattatagaacacttccccaccccaacaccataccaccacattactaaaggctaatcaacagcagttccttttaaccagtgcctcatgtccagctataaagaaaaaattacaagacatattgaaaggcaaaaatgtagtttgaagagacagagaaagcctgagaaccagcctaaaatatgtcagggatggtggaattattaggctggaaatttaaaacaactattattaacatgcttagggctgtaatggataaagtagacagcatgcaagaacagatgggcaatgtaagcagaggggatggaaaatcccaagganagaaccaaaaattaaatgc

SEQ ID NO: 585428 - DNA, 202 bp, Homo sapiens
  misc_feature (96)..(96): n is a, c, g, or t
  misc_feature (101)..(101): n is a, c, g, or t
  misc_feature (136)..(136): n is a, c, g, or t
  misc_feature (139)..(139): n is a, c, g, or t
gtcaaaagacatttacccttaatatcagacaacatttatattttagcgaagaaacaagttctcgggtggggaatctatgtttcactcagatttatntgtgngggggaaaaaagcctttctgtgtaaaatatctaanttnatataagaaaatgttagaaaaaaatatggggagtgtatataaaactcgcttcatcgcatgggg

SEQ ID NO: 585429 - DNA, 191 bp, Homo sapiens
actgtgtaagcggctctccacctgtgatgtgcgccaagagggcaaacctatagcaccaagggtgcgctcaccgcgcgccgtgagggccctcctcctcagcagcaagccccgcctccgcctcccgcggtccaggctccgggccggaacacctgcatcttcagcagctcctcctccaccaggcgcttcgcagt

SEQ ID NO: 585430 - DNA, 1017 bp, Homo sapiens
  misc_feature (105)..(105): n is a, c, g, or t
gagccggcagcagcagtaacagcagcggcagtagggggagcaggtgctggaccagagccctcctccagaaacccctgcgtccgccacggcccaggtaggacacanccccgcgatcctcccaggtccgccagcgcgtacaacctccggctcgctcgcgccgtcttgatccactcccgtccctcgccatcccgaacgataagtacctcgacacacacagctcgcccacccatccgccatcctacaacccccaccacatcatacaacccccccccccacccccctcacccctcccacccacacaccctacccctcccacaccaaccccacccaccccccacccccctcccccaccaccatccaccacccacccccaacatactacaccacgacccccatccatcccaatcattacaccacccccccactcccccacacactcccctaccctactcatgatccatcactatctctcacatcaccaatatctcaccaccccacccgcaaccacatactcaccacctaccaccacccccctccaccccttaccctccccccctctcctccactcatccacactcaataccatcaaacaaacctacaccctctcccacctccacccccctgccccacacctccccccccacacccccctttccccctccccctctcctcccccaccacctccacacaaccaactaccccaacccaccccccatccctacaacatcatacctacaacctcaaccccaccaaccacctctcacctcactctcccccccctactcaccctccccccaccaaccaaacacccccccccacataccaccccagcccccacaccaccccacaacacacccacaacccactcctcccactttagcacctacctcaccccacacaccaacgcgactctcctcaccctgcataactcaatcaactcccccccatttctacctacttcatttcccactcactaactcccaccatcccccacccattccacctcacacaccatct

SEQ ID NO: 585431 - DNA, 221 bp, Homo sapiens
gaaggaaaatacatgtacatgtacagccaacttccttgagggttcgttcttttgcatcagggtgtctcaaactgatgcccttaaaacacctgtaagagaatcatccaggcggcttgcttgctctgcatgcaggccctttagaatcagactcagaatccctggggctggagctcaaaatgaaatgacatttcaacgagtttgtcatcatgtgagagagatag

SEQ ID NO: 585432 - DNA, 280 bp, Homo sapiens
  misc_feature (33)..(33): n is a, c, g, or t
  misc_feature (115)..(115): n is a, c, g, or t
  misc_feature (159)..(159): n is a, c, g, or t
  misc_feature (164)..(164): n is a, c, g, or t
  misc_feature (236)..(236): n is a, c, g, or t
  misc_feature (251)..(251): n is a, c, g, or t
  misc_feature (267)..(267): n is a, c, g, or t
  misc_feature (278)..(278): n is a, c, g, or t
cggcacgagcacaccccctcagcccccattctncaggaagaaaacagtatgataatcaggaaattatttctctttggctctgaatcgatttgcctacaaacagattcatcttccntactttgtctcattagtctaaaggtaaattaatttttcattccntgagnacattaaaggcaggggtctagactaggggttaggagccctgaactgcatccagcctttgataatagctgctngtgggaagtcccctnccttctctgggtcctnagtctccactnct

SEQ ID NO: 585433 - DNA, 217 bp, Homo sapiens
  misc_feature (38)..(38): n is a, c, g, or t
  misc_feature (201)..(201): n is a, c, g, or t
accctctcactggtgcgctgatgcttctatggggtgtnaggctactatgggtgtaattatactctctctacaggttttctagtgtcaagagcgtcctcttggactacagttaattacaagggattagagggtctgtgggcaattaaagtgaactaagatctatcttggacaaccagctatcaccaggctcggtaggtttgnggtaccgagtctcgaa

SEQ ID NO: 585434 - DNA, 989 bp, Homo sapiens
agaggatcacgtaacgaagctgaacacccactaaacggatatgagcctgaatacatatatcagccaatgctgtggagggagatcttcaattatgcccgccaatcaccggaacagggcttatgatctatagaagccaggcgtgggcagagacactatgctctacgtttacccgaacatggcgcgtctggacggcgcatccttatactaggcactcgagtggggtaagagagtataggatccgacgttgggtaaagtacgttccccggcgttcagtcgcccaatgactttctatactcgcatgctgtaaatagtgctagtgctcagcctgtccgtctgcttatgtcccataaatcgcttgctgacggatgagagggagcaactatgactggtaccttctgccacagggctggcttaggcggaggaggggccaaggtctttgtcgtagccagctgtccgaaatgcccaagtgcttccggggctccgcgggccatgtctactctggtgcgaccggtggcccccttcttgttcttcctccaagtgccctcgggttggggagactcgctacccgcctggacgtccgttctaccaaccgtgtgtgggactgatagtgccgctcgttcctgcttgcgttccagtgggacatttcctgctaggaatccgtttggtcatgcggcttgcggcgggttgtcatggggctttcccaaaacacacaacgggacacaccagcgggacagcagaggacccatacgaaagagcacggcgagggggggcctggtaaggaggcagcccaggggcaggtggcaccatgcatcgaaagctacagaagaaatttcgccggaaaaagcgcgagtgactcagaaagcagggctagaaagaaaaaaaagaggcgtggggcagttcaaaagatcggagcggtaggcaacacaatggtagggaagaagcagaagaagaccacaaacgggaggggcaaagaagaagagaaacaacaa

SEQ ID NO: 585435 - DNA, 384 bp, Homo sapiens
gccttgctgcgcgagcacttgcggcgccgagcaccagatcgacgtgtatcttcgacttcgctttccgttggccggatcgaccaggatgtacttgttcatccgctgagccggtcagcgtgccgtcgtagtgcgcacccgacctcctgcagcccttgcgtctcgtccgccttggggttttgcatcatctggcaggagaaggtataggggcccatgtcgcgacgcttctgcgccagcgcttcacgggcgagcagaaccggtttgccatcgatctggccgttgtcagtcgcggtatagattcgtgggatcgcagtcccgcgcctcagcaccacgcgatacgtgtcattgaagtgatagcgcgtgccagcgaaccgccggacgccacct

SEQ ID NO: 585436 - DNA, 117 bp, Homo sapiens
cctgttggttgacgtagggtataatgactctgtcaggtatgattgttaagatatagggctgttaattgtcagttcagtgttttaatctgacgcaggcttatgcggaggagaactgtt

SEQ ID NO: 585437 - DNA, 913 bp, Homo sapiens
  misc_feature (9)..(9): n is a, c, g, or t
attctccantgtgaaggataagagaaaggaagtagcggcggggagaagtggaagtgtacgtggtcgttcgggttcccgctgtcgtcaccccgtggcttatttgcagccacactgggttgtttccacatgtggtgcacacccaggggctgtcatatgtgccgtatctttctggggcgacttttgttctgtatcccgctgcttttgggacgttccacacgattttttaagtgatatggtgttccaattggactagctagtcctggttttcaattgtactggtctacggtgggtcaaaattaggctgtgcgctcagcccatgggtatctctgccatttgaatctctttaagttcttcccccctccgattttaaaacgaactttccacccttcttcctataaccacccccgtttttactcgtcctttactccccctagtcctttttaagaaacttccaagacacacccctatatacttgcaacaccaatcccccacattcttggtcgcgcccccccttttttacaaaatatactagatgtgggccaatactgcccacaaggttttttgacccgcgacagataaattttccgtgtgaacgcaagtattcagcaggtacccacatcttcacaaaggtgctgctccctattgttctagaatggcataatgctgcaatgcgcgttctttccctgttctggcaatccatcccgcgtcgatctttcttataagtccgtcaagaatctttttattatgcatgcacattgtctcatcatatacagacaaacctattggagacagtattcaacgcttgtgccccacgtatgcaatcactcatccttgtatctacaccctttgttacagtaataatcttagcaatatagttttacaataaaacacaacaaaaaaacgtcccacatgc

SEQ ID NO: 585438 - DNA, 1240 bp, Homo sapiens
  misc_feature (901)..(901): n is a, c, g, or t
  misc_feature (993)..(993): n is a, c, g, or t
catgttcgtgggtcgttgatgactctatcttgcttgtagtatcttcctgcagtgtgcgtgctgctccgctgtctggtggttggtataccactgctatatggtgctagaggacggctggtgctctctctcaccggtatcaacaaagggggggaatagggaccttcctctgtgcgcagatgggacatcgggttcttccccagccccggataagggggaccaccctgtggccccaccgtacatcgtttacccccgggagagtttaatatttgtgtcgcgaatgcccccccgagacctttggacgtgaagctcttttcccggggacaatattggcctcaaaggtcaggaagggttcgtcaaaggagtgttcgtgcggggccacgttgctgggggacacgcgaagagggccgcccccacgagaagcacttggcttcaccagctcaggggatgtatcctggacccatcccaggcccaataagccccggctatgcccctgtattggattgccacacggctcacagttgcaagcacagtttgctgagctgataggtaaagattgatcccccttctggtaaaaagctggaagatggcccctaaaattcttgaaagtctggtgaatgctgcccattggttgaataatggttccctggcaaagcccacatgtgtgcttgaagaggccttcttcacgagctatatccacccctcttgggtccctttgcctgttcgtgataataggagaaccagaaccagattgcccgtgggtgtccatccaaagccagtggcaccaagaaagagctcgccgtggagacctggcacaagagtctcacaccgacagatctctgcgcccacgaataaagacctctcagaaaagagcgctgatagatagtagataatattatactcncgctgtagataacacctgtcgcctacacaccgcacagtctcttgaatactcagatgtgtgtggaagaacacaggtgcttccagaactgtttngtttccaattggcccatttaagatttagtagtaaaagactgggtaatgatacaccaatagccatcgtaaaaccttccagaaggaaaggagaatagttttgtggaccacttttggttttcttttttgccgtggtggccagttttaagttattagtttttaaaatccagtactttttaatggaaaccaaccttgacccaaaatcttgtccaccagaattttgagaccccatttaaaaagttaaatgaga

SEQ ID NO: 585439 - DNA, 170 bp, Homo sapiens
actacctagtgcgtgcgtcacccgatggaagattcgatggaatggacatgagccccctgatggcccatgcactatctttatcggtatgtgaactaaaggccgacaaagattatcactttaaggtggataatgatgaagatgagcaccagttatctttaaggacggtcagt

SEQ ID NO: 585440 - DNA, 1154 bp, Homo sapiens
gctctttcccatcttgcaagatggcgggtgacacacaacgttgacgaacgccacgactactacaacgacgacacgacaaccccgacacgtcaacgacacggttgactgctggtggcaatggtgacaaacacgggtaaccctcaacacgactacaacaccgcccaagacacggggaagccccattgcggccgcaaccctgtaccttgtcagacggacattggcaggtattcccgatctgccatgtacttccagacaacggaccatgtaccaacgacggaagtacctacagccgcataacatccaacggttgacacacacgacacacacgacaggacgacacggttctcgacaaatgttacaaaacccacgttggtgagtgaccaagaacggcgtgaacccgaggtggctataaacttcgaacacaatgcctcagcatcattatccttacatcgacagcatgtagcctcgaaacagcttgtatagcagccacaggaccaaacaaaacccatatcagatcagaacagtgacgaaaacactgcgagccaagaccattaacccccggagtaacaaccacaatatactgaatcacatccatcaacttggaaactgcaccaacaaggaagcaaacaaaggtgtgagataaaaccatgaacagacagacataggcataagtgagcaatcactatacattgatgacattggaacctactggatacctcaaatacggaattcaactcatacagcacgcacacgacaacacagaaaccatatggaacaatagaccacatatccaaccgaaacgatcggaaatccggacaatggtaaacaacaccagaaaaacagatctaactgacagactacatcacagtcacgacacacactgaggaagaccatgactcaaccacgacagctcacaccatcgaaacagaaaaaaacaaaaacgacctaccacaaaacaccaaattacaaacaaaatataaactccaaaataccaacaaatataaatatcataacaaacatgtaacttaaaccccaatacactaaaaatgaacattaaccaaaaaataacacaaatatatcaaatataatacacaataaatacaacaaccaacactctacaccctcacaaaaacaaaataaatagcacccaaaac

SEQ ID NO: 585441 - DNA, 202 bp, Homo sapiens
agagacagatacgaatcgagccggtaccgaatgaagcagtggaatcctttgggtatttcagatgaaaataatagtatgaaagttatgggctacatttggaatacactagaaaacactaacatcagaaaaagggctggacctttttctatttgaaaaccgggtggatcaacaatccacaaccctgtaacaaaaatcaaccccg

SEQ ID NO: 585442 - DNA, 464 bp, Homo sapiens
gagaaaactaattatgtactcagcacatacagtgtgtaagacctgaacaaggtgcttttcacaaacactatcttattaaatcctggcacaaactgtagtgtaggtattactaagttcaatttggagaaacagaaggagaggttcagagaggttaagtaatttgtccaagggcacacagctagcctagcagaatgatattttaaacctaggtagttgcatccagcctggttttattaaaccatgtggctacctcgaatatctttcatcaaaaagacacataaaagacagggagagaacagcaggcctcagaagttcccaggattgaaatctgtttattactacgaagtggccaatcacctctgcggggcaggccagcaaccctggcaccagctgggttctaaaaggccaaagctgccaggccatgccaagatgccacaatgaaaatgagcattgtttgggtcagc

SEQ ID NO: 585443 - DNA, 720 bp, Homo sapiens
tcggtcataataacacagggcgcttttttgtagccctccagtcttccctcgggaaacaccaccacctcccgtttggtggtccctctcctaatagaaaacaccccgcggctagtatgcacctcctctccgtcgtttttcttccattcgtgcccgcggggggcgagtggataaacatcattcttccacacccacgtaacaccatttcgttagcccacatctaccagctctcttcttattcggaaccccacctaatatagcagacgactgttggtgtccccacacacccgtggtggttgtctcgtcggcgcggagttcttctcgcgcgcgttcgtattctctcgtgcagcaccggcgtgtctcgctctctccgtccgtgtgccgcactcctccccctccaccctgcggtggcggtcttttaccacaactggttggggggcggcacatcctccccttcttccccgagcggggtggtgtgtttgttccgtcgaacatcacgacggtctcgttgtcggttggctccgtccggaggtacccagggagctgtcaccccccgcccagaggatgaccgccacagggtgcgctgagctgctgtgggtggtgccgggtgtactcctgtgtgatgacctcactgatgtgctggcccaggctgaccacccgacatggtgacctttgaccctgggacgtctggagcacgaactggacgaaggactggctatcaga

SEQ ID NO: 585444 - DNA, 198 bp, Homo sapiens
gaattccccccccccccccccccccgggagcctgaatcatatttttcatgtttggattgtgaaattgggataataaaatgtttcctctgttcccagattataaatttccccagtatacaggttgtgtgttattttgcatgtatagggaactacattattagggggaatgtatgtacatagaattgctgtattgcccgg

SEQ ID NO: 585445 - DNA, 149 bp, Homo sapiens
ctgctcgtgagtcggcatacacggtgttttggtgaagttggtgggcttgtcagtgatccatgtggcaaagtcagcgtccagtaggcctcccacatcatcaggctctccgccttcgtacatcttgtagagtggggttaccaaatctccac

SEQ ID NO: 585446 - DNA, 208 bp, Homo sapiens
  misc_feature (40)..(40): n is a, c, g, or t
  misc_feature (164)..(164): n is a, c, g, or t
  misc_feature (186)..(186): n is a, c, g, or t
tcgcttattgaatccacttgtgtccaacctccaggattgntttatcctaatgcacctgtatattcatttgggacttggcctgtcttgggcttccgtacctgcccctggtggaagttctctttctaacttcacgagaggaagagtgtcagcattcacatgctgtngaggctgggaggacttggttgncttttttgtttggatatccctc

SEQ ID NO: 585447 - DNA, 136 bp, Homo sapiens
  misc_feature (77)..(77): n is a, c, g, or t
tacctagaggatccaggcaaagctctaccatcagaattcgtgagaccattcctattacaagactccaggaagaccgncccatgattcagtcatctctaccaggtccttccacaacacatggactaacggagctaca

SEQ ID NO: 585448 - DNA, 239 bp, Homo sapiens
ggtccggtgatcgtgcagagtctgaaggccgactacagagcgaccaggttccggtgtgctggcgctggaagtctatctaggactgtagtcagtgggtggcaggggggcattgatcgtatgagtcgagggacagggatctcactgtatggtcatggtctgcgggccacaccttctaccagattacactcgtctttggctccctcggtgaggcagagcatggttagtgccaccggccacaa

SEQ ID NO: 585449 - DNA, 1077 bp, Homo sapiens
tatgagtctgaagactacgaggcgattataagactacatagatagtgatacacattagtgtctagacacattgatctcctatttcactatcatctacattggcatactcacttaacatactagtggagtctatgcctcttccctgaatgaacgaagtgttacgtcatgagtgacacttggggcattctgcataaactatatgtcaagttgatagcttcaatgaccagcactggtagttagaagcgttttcccatccttggcactaaacggaattacaacccttcttggtacctacatctccattctgtagtcatattttacacaaagacattactctgttgccactgtaacttgggtgcatcgccactacagtattggctatactctattcatgcgttctacgagctaatactaacacacgagctctaagtaacacaggtaaatagacatactagcattgttacatagcattggccaataggcgatcgcaaggtgcaaacatacttttacttcttttctcctaagcgattactcacgggcccattaactttggagacattacatactggtattattccccagggttaatttgaacagctataaattcatcatgtaaccattcgcatcattttctacaatattctatctggattcatatattttcctagatagaacaataagaataaacaaggggtcaattacatgatacggatgagcaacttcaaggcctaacttatcaaatcatattgctatatgcattgatactatcacataaagtaggaaccgcataccaccacagtaactaaacaggaaacatacttcgtggcacaccagagacgatagtcagcagcgacccaactgagacaccatgagctagccactagccacacattacacacacccgtagagggcaacgcacagggggaaaacaacgaccagacaagaccaaacgagcaccagtgagcaccaacaaacgatggtaccgtacagcactatagaatcaatgggatgatacaaaacgacacagacaaaacgcgcaacgcacagttcacacaactcaaccaccaccaccgagag

SEQ ID NO: 585450 - DNA, 222 bp, Homo sapiens
gccgtcatgttcggcagtgcactgcaggaggtcatgggcatcagagagagcgctaccccgagcgcagactgccctgggtgcagacactggctctctgagtgagtgtgctgagcgctcaacggtagaccagacagaagggcatcttcagtggtccctgtgtgacattgaagacggtgaattgccctgaatgctgcagagtggaccacgtggacaggtgcccac

SEQ ID NO: 585451 - DNA, 281 bp, Homo sapiens
atccggtggtcttcaagacacgagcgggggtgagaatgacgggcgaacagtctgtgagaaagaccagtcctgaggaaggagaaatttgctgcacgatcagtgccacagaagacctctcggaagaggagcaggaagagctaagaagagaacttgccaaggtagaagaagaaatccagactctgtctcaagtgttagcagcaaaagagaagcatctagcagagatcaagcggaaacttggaatccattctctgcaaggaacccacctctgcaaggaacccacg

SEQ ID NO: 585452 - DNA, 387 bp, Homo sapiens
catatgggccagcgggtctcaaactccggacctcaagtgatccacccgcctcagcctaccaaagggctggggattacaggtgtgaaccacggcgccgggccggcttcccttttaaatttaagctccagtttcagataaggtcttggctcatgaataagagcatatgcgggtagaagccaggtcacatctggaatgcttcgcggcttagaaatttcttcggccagataccctaaatcatctctctcaagttcaaagttctgcagatccccagagaaggggcacaaggcggccagtctcttggctaaagcgtagcaagagtgacctttactccagtgcccaatgaattcctaatctccatcggagacccggtctccacagggtaccgag

SEQ ID NO: 585453 - DNA, 383 bp, Homo sapiens
  misc_feature (3)..(3): n is a, c, g, or t
  misc_feature (16)..(16): n is a, c, g, or t
  misc_feature (47)..(47): n is a, c, g, or t
  misc_feature (67)..(68): n is a, c, g, or t
  misc_feature (95)..(95): n is a, c, g, or t
  misc_feature (119)..(119): n is a, c, g, or t
  misc_feature (228)..(228): n is a, c, g, or t
  misc_feature (325)..(325): n is a, c, g, or t
  misc_feature (328)..(328): n is a, c, g, or t
ttncctgttttatggnctggtcctggtttgttccctggagtccgcancgtggtctgtatagtgaagnngtcagattgaggaggctcagtctgtgnctgtaggatcctggtctgtagtcnaaaccggtccccatggcagtatgcctgggggtaggaggtcccaggaaggccctgcaggatcctggagaatacctgtccctctccctgcaacatcctccttttcctttgnttccctcctcaactaccgcaacatctggaaaaatctgcttatcctgggcttcaccaacttcattgcccatgccattcgccactgctaccagcctgtnganggatgagggagcccatcggacttctacctgtgctctctgctggccagcggaccga

SEQ ID NO: 585454 - DNA, 297 bp, Homo sapiens
ccgcctggtcgtatatggtcgagacagcctgactaccgtgtagaaaccctgtctctactaaaaaaaaaaaaaaaaaaaaaaaaatacaaattttagccaggcattggaggcacttgcgtgtaatcccggtattcaggaggctgagggcgaaacaatctcttgaactcaggaggtggtggttgccccattgcactccagcttgggcaacaggagcgaaccccgtctcaaaaacagagacaaaggtgttttaattattttccctgagaaactccaaaacgaacccggggggaccctcct

SEQ ID NO: 585455 - DNA, 107 bp, Homo sapiens
tacgtccggtcgcggcccttacgtgctacctcggtcttcctcgcacctgggctactacggcggtgcacacgactcagtctccaccactctacgtagcctgggttccc

SEQ ID NO: 585456 - DNA, 772 bp, Homo sapiens
ggaagatcagctccgacattggacagggcacccggatcccgaaacaagctttcaccgacgtggccacatggctccactgggccagggcctcgagggccgctatgtgagatggcctacaccgcgcaaactactatcgacacaggccagctaccgagatctattgccttgcatgggagatggcggagctgtcagaagggcatctgatatggcgagagccactggaccttcagccagacactctactaacgctgggacaagccttgatggaccattcctacgaacattcaaatcgacttgggccaagacgtgaccccggaacccacctgcacagcaccaggactggaccatctaccagcaagcaggaggcgcaggccatacggagagagcaacatgaccatcaatcgatagaatggacaacagcagcgcgacagacacatgcgccacagcgccactaatgcgccaatgccaagacaccaagcaacaaccacaatgccaagcacctccaagggcccgaggcatcaccgagagaacaagcatcacggacgtaggcatgtgaaaaccaacatccaccaacaaccatggctaacgacccacaccaggcgcatacacgccaaaccccacgccaccaacagcaacctgtggaacccacaaagagcagaaaccacctaagggccaagcacaagcccgcagtcccacagccacaccacaaagggcacaaacacacacagcatccgaggcaccccacgggacaacagacccaccgagtcgccaa

SEQ ID NO: 585457 - DNA, 656 bp, Homo sapiens
taggtcactcgcctacctgaagaaagtggcttatttggaggttgtaggtgctgttcggtattattgccatagctgttatcctagatatgcaatagattaaactcagtcaaatatccttcctaaaaacatgtcattccacttgtgaaagaaaacacaatgtgcatgtttcaatgatactgtgcggaaacacacctcatgatcatcttgtgggtttcttttgcccttactggatgactctcagaggacatgacttgacatagtaacattagtaaactgtctttatctttgattattcttttaatttttatttgagctgtttcaatagcataatgaaataaaattttgaattggccaataacatgctttataatcttccagtgaagagtctgatacaaatttactcttggcactgttgtagttccactaacaaatagcacttcagaccttatagaaccatatagatatggccaaggaatagcaggattcactattataatactaattgttaactcattatttaattgaacatttccaaagctctggaaaggcatgcatttgtaggtgcacatgctttaagatttctatccatctttcagagttgaatgtcataatgtttggtatttaattcttgataattcttaaccaacttttcctgt

SEQ ID NO: 585458 - DNA, 274 bp, Homo sapiens
gcacgagcacagcagagagcagccagacggagcattaaatctctcctctcaaagacacgagttgaccaagggggcctaaggccgaagagactgcggcagtattagagcaggagtgaaagcttatagaaacgcgctagagcagaactgacaggcagtacagtacacttggaagcagggccctgaggcattccctactacaccagggcagatatcatataggccctgcatgttccacagctgtaccagccgaacactacctaactactaagtacta

SEQ ID NO: 585459 - DNA, 420 bp, Homo sapiens
ataagcaattgctaagaggaaagtttatagcaagtaaagctcctacatcaaaaaagaagaaagggctctggcgtggtggcttaggcctgtagccccagcattgtgggagaccaaggtgggcggatcaactgaggtcaggagttccagaccagcctggccaacatggcaaaaccccgtcgtctactaaaaaaattagtccgggcatgtttcagggcgacggtaatcccgggcatacgtcaggaggctgaggtgggagaatcgttgggaacccaggaggcagaggctgcagggagctgagagtcgcagtcattgcactccagcctcggtgacagagcaagatggggtctccaaaaagaaaacgactcacaaacaagtaacctaatcttatacctcaaggttacatattacgggggggtaccg

SEQ ID NO: 585460 - DNA, 134 bp, Homo sapiens
cgcaagaaaaaaatcaaatttaaaagtcttatattgccgtttacgtaatttttgaaatttttaaaaaataagaaaagaccccctcttatttttcgacgaaaaatacgtgtgcaaaatttccatttgatccgatg

SEQ ID NO: 585461 - DNA, 910 bp, Homo sapiens
ttttgcgactatttgtgatttcattgtgtcgatgttctcgggtgcacagcgctcttttgttgttccgatgttggtgtttttctttgtttgggaaacgtttgttccgaggtccctctctatccgtggggggctccccccctgcgactttttttagtccccaagttgcacacctctgacattgggtacgcttcccgagcgctgttcaagtgacctggcaaacatttccgtcacgccggtgtttcgctcttccagacgagccccctcatttttccttggtacgctcttttatctccctcagggttcctcgaggtgctctctgaatcaggttccttatcaaaaaagaagtgtctccccccgcctgcaacagcgaccaattggtggaaaactagtgtggcggccattcgacgatgattattttcgccagcagttgtccttgcgggttttgtacattcacccccaaatcttctcaaggggggccatatcacaggaagacgcttccagtgacaccaccttcttgttgaaatttcgcttacatatgcctcctgactcccgccctcgtaggcctaccaccaaagtggggtgtccaccacacaggcttcgcacggaaccacggttgttgacaaacccgcgtcgttgaatacacagcggttcccggctggtcattccctgtgatgggtgctctaagcattagccccccacccatcctgttgtttttggtagtacgtaaccgtccacgaggccacaccgcattttagaggttttttaggagtagactcaaccatgaaaaggacatgatcccaggagacaggtggggttacgtgaactgtagtacggtggaaacaacctatgctcgccccgggcggccgcgtccctacacagcaaacaaaaggagatggaccgcaaacaaaac

SEQ ID NO: 585462 - DNA, 599 bp, Homo sapiens
agcggggaaaatcacttctatttaatacaatacaatcatgttcccaaattgcctaggctcataacaatacagtctcaatacaaatagacgtaagtacatctattgtttcttcattttaatgtcaaagagaccattccatctcctaacaaacaggtaagttacagaagtcgtccattgtactttgcatcagtctttccctgtattgaacaagtcttttggagaattcttagtttgagtttgggtatagcttacacactgaacattttgcgaagcatctaaaaaaatccacaattagtgcaaaaagaggggacactacttcaagtcattccttctataagaagactgagggttactaaatgccaattattaagcaaatatctagtttcctattggccttctgaaagacagcagatatcaaaatagtacactatgaggtttaacaaggttagaacaccacatgtactatcagctttattttacctgcaaaaatattttagctacactgtggaaaacaatacacttgagaatatcctccacatttctaagggcagatgcaagaatacttattcttttccttttaaatagaagacatgccataa

SEQ ID NO: 585463 - DNA, 155 bp, Homo sapiens
gactgtacttatcccggcgtgcgtcgataggtatgtacggaccggcgaggtacggcacctttacgaggaggaggacgccagcgagggtgtacggctaggaggaccaggtgggactaagagcggacgtgttacaggcgacggagagataggagaag

SEQ ID NO: 585464 - DNA, 231 bp, Homo sapiens
gcaatggacaggagagggaaaaaaacacgagacaccagcaggtgcgagccaggtgggacaggcgcacacgaggctgcagtgggagcccatggtcgacactatacaatgggcacagatgttttccaacgtatgagactcctaaggctaagtcgacgttctctccaatgcagaagacgcactcctcgatcgcgcctcggagacggggggtatctcaatcaggcaactcgcagt

SEQ ID NO: 585465 - DNA, 128 bp, Homo sapiens
aaaaaaaacaaccatcatattacctaatcggattagaaaaataaaattctcttttgtaccatattatcaaagagcaaggccaggccaatggctcacgcctgtaatcccagcacttagatgctggacga

SEQ ID NO: 585466 - DNA, 472 bp, Homo sapiens
caaacagttgtaaatatcagcttgagatggagtgctggtacagaatgtaagattacatttacatgtagaaaatggcagtttcagtgtacacaggtttggctctgctgccatcctaagtcatacctgtgttaatgaaatggtcttctcaactcagcattaggcaagacttaagtttttaccatagaaacattattcctactgctgtagttcagcgaaccgtccactgagatttatagcgaagttctaaggtatattttggctgtgtttgtttttaggactcatgttattttgaaataaatttatcatattagttggaagtgtgtctcttctagatctattttctttactacttatcagcataatcatttcaaatctcgggtagagattgaaaattgagcatttgatttcaatatactatatgaaaggccattacacagaatttactgcactgtttttgcaccattagcacaaa

SEQ ID NO: 585467 - DNA, 644 bp, Homo sapiens
gcatgctgtatctactggacaaactgaggcatcttcattatgcacccacgtatcggtatggcctcaggctacataggctatgtcctcaagtacggtcgactattaacttgccgggccttatacattacattctctctatgcggtcaactttactttgtgtcaggcacagtccgctgcttcactgatagtgctactcatgtcgacaaatctctccgtagcacgattttatggctctgaatcgatagttactctcgaatatcagtgtcctatacgtactgcacctgctagaactgcgctaatcggtatatctcagctcctgtaggaaagactctgccattgcgatcgaacctgacagtcttactactcacactgacacaatctatccatgatactcggactgatgtgagttctgacagtaatgcttgactcaccagacctcctaggctatcgagactattggacactagccagacgctatatagcacatctaacatcaaggcgaatgaactgcctatacaccacacactgctcagatccgcactgctttaggaggtgtacgtgcgctattgtataccatctagcctagatatactccatcatcacactgatgctgatcactcaccatatagtgttgcccatggccc

SEQ ID NO: 585468 - DNA, 964 bp, Homo sapiens
  misc_feature (83)..(83): n is a, c, g, or t
  misc_feature (492)..(492): n is a, c, g, or t
  misc_feature (964)..(964): n is a, c, g, or t
acacctctatcagctgtgcggtagaagcatggagcttggtcggcttggtgaagtttatctggcattgttgggtgtagtcactntgtgtctgtgagaagctgctagtcagacgaaatcgcgattaaatacaggcccctgatagaccagacctgagccgtggcatcagacagccctgcactatcggcgcagctggagagtcccttcgttagtgcaaccttgccagtaatcagatcgtatgcggaaccacagtatttccaaagtgggcgtccgcgaccgctgcttatatccgaattacctatctcatcaatccatatgcatcctccatcatcctatcgggctctccaatgatctcttgtcgccaaacccaagtgtccttcttccgctctgggaaagccaccccttctgtcatatatacgggctcacctatcccggcgtaatggtctcaatcgatcctcaaaaactcggtgctgggaagataccacaacctaaganagcgataaagtccgttattacctcatcctattacggctcggtttaattcacccgagtagggtagcacctacgagaaatcctcgactattttcactcctttgcaccaagatagacttctcctaacaatgagtccctgacgaacgcatcttccatcagtgggctcgaattcctgatcatacttgtttttcacacagttttcggctacagacctgtgtatctgtaacaaaaaacattgcatctaggaaaatcaaaacgttggaacagtatctcccaggatcaggatcgaaggaatcattgcgagggacacgtggcaaattctgcgtttaaaagagatttacctttttagattggtgcggaaaatgtcctaatgcctctttgcaagagccacaacaacaaatgtcagatacccagttttctggcacgtaggattaatctctctaaatggtttatctcacctttgcgggtacagaan

SEQ ID NO: 585469 - DNA, 438 bp, Homo sapiens
caggcagtgataaaggaggagaaaaatgtcaactgaccgtggggctgaggaggacatggatgaatgtgagcaggcgctggctgctgagcccaaggacaaggaccccttcgctcacctgcccaagagtacctttgtgtaggatggatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattg

SEQ ID NO: 585470 - DNA, 104 bp, Homo sapiens
ggtcaactctagaggacccttaccggcccaccagaccctccaatcctaataggtatttcggcttgaggttcactccctcctcagctgcacacgcagcgcggtat

SEQ ID NO: 585471 - DNA, 363 bp, Homo sapiens
cactctgtatacatacaggggtcctggcagacagccgttatacagagttctgacaacagcatatctagtctatgctctgtggcaattgtgataagctacatgttgcaggcactgggggaactcatgtcgtagctttcatcatgttactacaacagctggactttcctgcgtctgtgtcttgctggctaactatgcatgtatcgcgttgtggactacagtcagtgctggcagcggtggctcatatgacctgtttgcacatgtattcacaggctggtatgtaggcagaacttggttcccttgtaatacaggttggatgtctgagtcatagagtctgtgagacacagtgttcaacatgtattattg

SEQ ID NO: 585472 - DNA, 359 bp, Homo sapiens
  misc_feature (62)..(62): n is a, c, g, or t
  misc_feature (77)..(77): n is a, c, g, or t
  misc_feature (98)..(98): n is a, c, g, or t
  misc_feature (114)..(114): n is a, c, g, or t
  misc_feature (260)..(260): n is a, c, g, or t
  misc_feature (266)..(267): n is a, c, g, or t
  misc_feature (279)..(279): n is a, c, g, or t
  misc_feature (288)..(289): n is a, c, g, or t
  misc_feature (297)..(297): n is a, c, g, or t
caccatggtctgtctcctgccgacaagaccaacgtcaaggccgcctggggtaaggtcggcgngacacgctggcgagntatggtgtcggaggccctggnagaggtatgttcctgntccttccccaccaccaaggacctacttcccacacttcgtacctgagccacggctctgcccaggttaagggccacggcaaggaaggtggccgacgcgctgaccaacgccgtggccaacgtggacgacatgcccaacgcgctgtccgncctagnnacctgcacgggnacaagcttnngggtgganccggtaacttcaaggctcctaagccacctgcctctggtgaaccctggccgccaacctcccgc

SEQ ID NO: 585473 - DNA, 1148 bp, Homo sapiens
  misc_feature (85)..(85): n is a, c, g, or t
  misc_feature (244)..(244): n is a, c, g, or t
  misc_feature (361)..(361): n is a, c, g, or t
acgccggtgcagcgggggggcccgggggccctggtggccctgggatggggaaccgcggtggcttccgcggaggtttctggcagtnggcatcctggggcctggggtctgctggccttggactggggcctggggcctgatggcctgcggaggctcgctggagtgcaatggccgatggataagtgagtggatgccctggcaccaatgtttgggcctgcttgtgtcaatggacattgaagatcaagtnccttggaggagatctatctacttctcccttgccacattaaggaatacagaagatcgattgatttcttccttgggggcctctatcaagggatgacgttttggaagattatgccagtgnagaaagcagaccctgtgccgggccagcgcaccaggttcggggcattttgttggctatcgggggactacaatgggccacgtacggtcgtgggtgtaaagtgctccaaggaggtggcaacggccatccgtggggccaatcatcctggacaagctctccatcgtccccgtgcgcagaaggctactggggggaacaagatcggcaaagccccacattgtcccttgcaatggtgacagtgccgttgcggggctcttgtgctggtacggcctcatcccttgccacccggggcactgggcatcgtctccgaatcttgtgcctaaagaagcttgctcatgagtggtaggtatcgatcgactgggtacaacatcaggcccggggcttgaattgccagcttgggcaatttctggcaaggccacctttgattggcatttctaagaactaaaggtacttgacccagactctgggaaggagactggtttccacaagtttcctatcaggaggttcatgaccaactcgtaagaccaacagagttcgtgcagggactcaggtccagtgttgtacacaataggtgtttaattaagaaaacctagtgtgtatagggtgtagagaaagtagaaatgaagagaaaaaaatcgtagaggattattggtggaggaaaaaagaaagcagagagaaaaagttttacgccactttagagtgagatgcgcgtatgtttgatggagataggcagtgttgagttgtgaagcatggaagtgaaatgatgtagataagtgagtgaagtagaagtgtg

SEQ ID NO: 585474 - DNA, 479 bp, Homo sapiens
  misc_feature (5)..(5): n is a, c, g, or t
  misc_feature (14)..(14): n is a, c, g, or t
  misc_feature (29)..(29): n is a, c, g, or t
  misc_feature (44)..(44): n is a, c, g, or t
cttgnatttagcangccctgtcagagganttggaggcccatccnagcaggtcatgaacccacagggaagaggcactgttgcagctgctgctgttgctgctactgctagcattgcaggagccccaacccagtaacccgccaggacggggaactccacctccacctgtaggcagagcaaccccacctccaggcattatggctcctccacctggtatgagaccacccatgggcccacccattgggcttccccctgctcgtgggacacctataggcatgcctcctccaggaatgagaccccctccaccaggaattagaggcccacctcccccaggaatgcgcccaccaagaccctaagatacagttgataaatctcagcccttctcttcccctacaatgcttcttgtgaaattgtgtacctgcaagctttttgacccctcttactgcattaactatagataataaatacatagagcaattcaa

SEQ ID NO: 585475 - DNA, 881 bp, Homo sapiens
tggtacggccggaatcgtaggatcaagggcgggcagaagttggaaacatgcggctgtcggtcgctgcagcgatctcccatggggcgcgtattatcgaccagtatgggcctcgtgtcccgagtcccgcgatccactctgtatgcggaacattgctcacagggactggtgctggcacgaacgcatcgaggcacacatggtgcgctgtgtggacgaaattgaggggctacgcggtagaatgcatctatcgagcgtattgggaatgcatggtgagacactaacagaagcgagccatgctgcatggactgactatctggctcacagagaaggattggatcccaaagctgtttcaagtactgggccctcggtacaaagatcatagagctgggggctacatcacagaatgcgtgcatgatccctacaatcggcagtttggactcgtggccaatgatggcagtgactcgagtataacgggacattgccttccacccctgcctctgcctcgcagagaccagactatcttacactcctaaaacaggtgcttgcagggtttgcggcagggacctctaggcgaagctcgagtgaatgcaagcaaccgacagttcccacacaggtcaaacaccagggatttaactggatctgacgagtctgcaggccttaatcagtacgcatgatcacaggcctttggagcacttttactctctgagaagaactggagctacgagatgtaaaatggacagtcttgatggggttgagaaccttctgggggagccagatgaccctctcttgtgcacaatagatacaagtctccatactgaatatctattaactttattgagttttttccttcctgtggcgatttctggcagaatgcggacttattc

SEQ ID NO: 585476 - DNA, 116 bp, Homo sapiens
aagtcgctgcgctgttcctgttgatcggtggcgtgagctggtgagctctggtccctgcccggggctctctcgcgtcgcctgacggactgaccgcttggacctgggcgtcgtttacc

SEQ ID NO: 585477 - DNA, 638 bp, Homo sapiens
tacacaaagacaattatttaagacctttattaacaggtgcttgcgttggtggactttttggaaaaaatcaagtggtaaaccttttattacaaattaaaaatgaagttcttaaaaatctcaactggaccagatatgaaacaatttaaaaacctttaagggcgtatggagaaaaaccaggcttttttaaaaacacacgttggttattcaccaaaaagagacgtctttaggtaaaaataataaaaaccccatgctgcatagataatgcagatagtctctatttatcgttggtcaaggggcaaaaagcaagcacttaaggtcttcagcctccaatctttggtccattctcttatggcgtggaattctcatatttcttctggtgggatgactaacccggatgagtggtagagatggtaagccggcatttactcagccccgcccgtggttcagcctcggggagcggacgaaattctcagactgggtgagatcggcagtgctttgggtctcttgtgccactctagggggtataagggctatatcggggcgatctgcgtcggataatgtgaagtttgcggacggttaccgacgattaaggttggctgcgtgacctggggatctcatctccgtgaatattccttaac

SEQ ID NO: 585478 - DNA, 928 bp, Homo sapiens
gacccccagtcgagtccgtcgatccagctgccagcgcgtgcgccagcgccggacatcccggtctgggctgttaaacgtgagccctcggctcgcatcgccctgtcctgtgaaaaatgtgtggtgcttcggtgtggctttctatcatctgccttcccagtatcatgctctgccagtcttgtggttcatggccgaccgtcgacaatgcctggtggggtaggaggatgagtaattgaggcagatgtctgtcatgaatatgtgaccagacaaagaagagattgccacagtcatcaatggacaggtgttcacagagtactccggcgctgcagggcggtccgggccaccatgtatccgtctccagcaattctctctgcgtgtgatcgccttcgtctcatcgttccgagcgtccatctcgtatccggctgtaagctggggaggagaagtctcctgtcctaacctgtactatcagtccaagcgtacatgtcatgtctgctgatgtcatgactaggggggacttccataatatgacagaaggcgtgcaagaccattcacgaccatagaacgcgagaattctatcccgtgtacccgagagaaggcggctacgggttatttcctacatgctggcgttggggtggcatttcggactgcacctttcgatcagcggcatgactgttaccctagatagctgaaggaaagggcgcaagctagacgtcgccgggaggcccgggttggtatcctggcgtggcaggatatgaaatccacaattcagaataacccgtttgggcatattaactcattaatctctgagggtttcttctaagcaaaaacggtacgtggttgcctctaacaagggcgaaccataagagaaagaaacccaccaccccaaaaactagtccgcccacccccgagtttgtaaaatatctccccacca

SEQ ID NO: 585479 - DNA, 179 bp, Homo sapiens
tttggggaaaattttaaaaaaccgggggggttttttttccttttttaccccccggggggttttttgggaccggttgggaaaaaggggaaattttaaagggggggtttttttccccaaggggaaaatccccccgggtttaaaagggccaaaaggtttggttaaaaaattttaaaaaggtt

SEQ ID NO: 585480 - DNA, 695 bp, Homo sapiens
agagagagagagagagagagagagagagagagagagagagagatagagagagtgagagatagagagagagtccttgatctcccgacactcagacctctagttttgtgctctgctctctctgtcttcaactttcttctcatatgctgtttcctgtgtctattgctcattgtgagatgatggagttccagatcttgtcctctacctgaggtattgctgatcctctgtctgcttctctacctgtgtagtcgcagatctactgtctgcttatcacctcttacatcacgctgatctacagtcttcggatgtcatcctgcttgtagttgcactccaactctcttatgaccctcgtgtgtcatcagcaccccatctgattgacgctgctgcttagcattccaaccaaatgtgatacgcactgtgacttgtgaggcctcgatattgtcacatgacttcatgattccatatccgtcggttatatctcatgtctctagtcttcgaattgttcacgctgtatataattgcctcccctcttgggattgcttcgccaggatcctatcgaagaccaccttgctactccttgtctcactcgttacgattcccagttcttttccatgatgtggctgttccctcttaatcgtctggaattgttggtcttctgtctcaagcttgtcggcatgtttatcttatgttacgattct

SEQ ID NO: 585481 - DNA, 207 bp, Homo sapiens
  misc_feature (180)..(180): n is a, c, g, or t
gaatgaaaaaaaggggtacacttttactgtcaggtgggccacgaggaccctgccgttggccttccacacaaaaaaccatcgaccgcttggcgggtaaacccacccatgtcaatgtgtctgttgtcatggcggaggtggacggcacctgctatgaagccgcccgcctgttccccaccctgnaaaaaaccccagtttcccccaagcaaa

SEQ ID NO: 585482 - DNA, 326 bp, Homo sapiens
agacagttcattaaagcaattaactcggccaataccacccttgactcctaggctagaatgtgctagctgctggtcactcagagcctgctattatacctggggagacagacacaccaagaaacatagctagctgaggacattgtgtacacactacagctggaggacagaaacaagaggtttataacaatctacagaggacccagccaaacctacaaggtccagagaaagacggaatacacatgctactccaacagaatccaggcagcaagcgaggatggagaagggaccgacacagaaaactatacctacagaaaaactctgtctca

SEQ ID NO: 585483 - DNA, 215 bp, Homo sapiens
gaacgtccatagtgtcagatgatcacgtaacaccggcatgataagtgtagagtccttatagcattctccactcggcgtatgctgttcggccacttgcatcatcaatagagctgctttagccaacctgcaggcacggtcgggggaataaatactttcgtagtacaatacggggcactagaaagcaagacctaggcgaatagaacgcgtaggtggaa

SEQ ID NO: 585484 - DNA, 765 bp, Homo sapiens
  misc_feature (38)..(38): n is a, c, g, or t
  misc_feature (108)..(108): n is a, c, g, or t
  misc_feature (183)..(183): n is a, c, g, or t
  misc_feature (233)..(233): n is a, c, g, or t
  misc_feature (243)..(243): n is a, c, g, or t
  misc_feature (249)..(249): n is a, c, g, or t
  misc_feature (261)..(261): n is a, c, g, or t
  misc_feature (269)..(269): n is a, c, g, or t
  misc_feature (274)..(274): n is a, c, g, or t
  misc_feature (279)..(279): n is a, c, g, or t
  misc_feature (293)..(293): n is a, c, g, or t
  misc_feature (355)..(355): n is a, c, g, or t
  misc_feature (392)..(392): n is a, c, g, or t
  misc_feature (412)..(412): n is a, c, g, or t
  misc_feature (414)..(414): n is a, c, g, or t
  misc_feature (434)..(434): n is a, c, g, or t
  misc_feature (448)..(448): n is a, c, g, or t
  misc_feature (456)..(456): n is a, c, g, or t
  misc_feature (458)..(458): n is a, c, g, or t
  misc_feature (476)..(476): n is a, c, g, or t
  misc_feature (483)..(483): n is a, c, g, or t
  misc_feature (496)..(496): n is a, c, g, or t
  misc_feature (506)..(506): n is a, c, g, or t
  misc_feature (508)..(508): n is a, c, g, or t
  misc_feature (510)..(510): n is a, c, g, or t
  misc_feature (627)..(627): n is a, c, g, or t
  misc_feature (667)..(667): n is a, c, g, or t
  misc_feature (674)..(674): n is a, c, g, or t
  misc_feature (761)..(761): n is a, c, g, or t
tgaaaagaaaaataaatatctgaagaataagaatacanggcctgggtgcagtggctcatgcctgcaatcccagcactttgggaggcggaggcaggtggaccgcttgancccaggagttcgagaccagcctgggcaacacagtgagacccccctctttacaaaaaatacaaaaattagccaggngtggtggtgcacctgtagtcccagctacttgagaggctgaggtgggaggnccaccttgangcccanggaggtcggganggttacangtgangcccntgaatggcgccacntgcaccaccaaccgtgggcaacgggggcaaaacccgctgcgaaaaaaaaaaaaaaaaaaaanaagaagtggggtggggaagtggggcgtgagaccttanggtgccttggcatttggtangnctttgagtgggggccgccanaggccttggaacgncagcggtncncttcccaggccaggcccntccccgnccccacctggganggcctggggncncnccagtctcgcctgcccgcggctcccaggcggggcgctgcgtcacggaacccgcgccgggattagcgccctggcgcccgcctgcgccccgggctctgtcgggcgaggctggggtcacngcccattggggcctcttccgccggcccttagctggatccnagccggnacccgcgtggtgccgccacctcagtgatgtaccaagtcctcccatgccaagcggccccagacgcccagcacgaagctctcagatgtngcac

SEQ ID NO: 585485 - DNA, 102 bp, Homo sapiens
  misc_feature (79)..(79): n is a, c, g, or t
  misc_feature (95)..(95): n is a, c, g, or t
gagcggccgcctactactactactgctcgaattcaagcttctaacgatgtacggggacatggaaataaagcacccgatnctgccctgggcccctncaaaaaa

SEQ ID NO: 585486 - DNA, 387 bp, Homo sapiens
ctgtatttgtggtattcgataagaaaagttgaattgaaatttacaacgaacaatgggaaaaaattatcatgagttttgcatgtgcacttttcagagtacataagataatttatcaccttacgagaaaaattgaatcattaattatcaacgttaaaccggtcaatgagacaagagcatagtctaggatccagaaaatagtttgatgatgcaacagatgaaagacaattagaggagatatagagaatattcccgaaacgattcggtaatcgcagtggcctgattctgacggcccttgaaatatttagttagcagctgatgaaatttcaaaggcgcagatgagtatttgggcagcagatgacaggcctgaaatgtttaaacttagaacga

SEQ ID NO: 585487 - DNA, 164 bp, Homo sapiens
  misc_feature (73)..(73): n is a, c, g, or t
ctcagagagtctcctccagattgtgaaaaaaatgaaaacaaaatttgagcaaagctgactggagccctcaggnagcaaaacatcatctccaactgaatcctagccactggtttctcctcctggggcaatcaattcccaacaacaggttgttttggcctgaggag

SEQ ID NO: 585488 - DNA, 1020 bp, Homo sapiens
  misc_feature (51)..(51): n is a, c, g, or t
  misc_feature (61)..(61): n is a, c, g, or t
  misc_feature (74)..(74): n is a, c, g, or t
  misc_feature (94)..(95): n is a, c, g, or t
  misc_feature (103)..(103): n is a, c, g, or t
  misc_feature (105)..(105): n is a, c, g, or t
  misc_feature (107)..(107): n is a, c, g, or t
  misc_feature (109)..(109): n is a, c, g, or t
  misc_feature (111)..(111): n is a, c, g, or t
  misc_feature (120)..(120): n is a, c, g, or t
  misc_feature (126)..(126): n is a, c, g, or t
  misc_feature (132)..(132): n is a, c, g, or t
  misc_feature (134)..(134): n is a, c, g, or t
  misc_feature (140)..(140): n is a, c, g, or t
  misc_feature (144)..(144): n is a, c, g, or t
  misc_feature (148)..(148): n is a, c, g, or t
  misc_feature (150)..(150): n is a, c, g, or t
  misc_feature (152)..(152): n is a, c, g, or t
  misc_feature (154)..(154): n is a, c, g, or t
  misc_feature (156)..(156): n is a, c, g, or t
  misc_feature (241)..(241): n is a, c, g, or t
  misc_feature (296)..(296): n is a, c, g, or t
  misc_feature (299)..(299): n is a, c, g, or t
  misc_feature (310)..(310): n is a, c, g, or t
  misc_feature (335)..(335): n is a, c, g, or t
  misc_feature (457)..(457): n is a, c, g, or t
  misc_feature (508)..(508): n is a, c, g, or t
  misc_feature (530)..(530): n is a, c, g, or t
  misc_feature (553)..(553): n is a, c, g, or t
  misc_feature (555)..(555): n is a, c, g, or t
  misc_feature (557)..(557): n is a, c, g, or t
  misc_feature (717)..(717): n is a, c, g, or t
  misc_feature (724)..(724): n is a, c, g, or t
  misc_feature (780)..(780): n is a, c, g, or t
  misc_feature (864)..(864): n is a, c, g, or t
  misc_feature (871)..(871): n is a, c, g, or t
  misc_feature (891)..(892): n is a, c, g, or t
  misc_feature (908)..(908): n is a, c, g, or t
  misc_feature (916)..(917): n is a, c, g, or t
  misc_feature (921)..(922): n is a, c, g, or t
  misc_feature (924)..(927): n is a, c, g, or t
  misc_feature (943)..(945): n is a, c, g, or t
  misc_feature (954)..(954): n is a, c, g, or t
  misc_feature (960)..(960): n is a, c, g, or t
  misc_feature (981)..(981): n is a, c, g, or t
agcttactcagaaagtgagatgggaggatcctgagctcaggaggtgaaggntgcagtgaancgagatttgccantgcactgcagctggggtganntgcaagancntntntnaagcgaaancaaacnagacananacaaanacanatanananananacacacgaggtccaaatggtagcagggatccaaagggaacacagtatgtaggtcaaactggcagtaacagtgtacagcctttganaaactagaaatattagagtaggccaaacacacctccaaactgtaaggctgtgcanaancataaaaaatngcagccttccatctcctgcactggntgagtccatttacttgtgtacttgttctagtgagtggtgggactgtacatttttgaatagacctcaaaaatacttcatcctcccgctcttcacttggctttttaaacctctctgcagtaggncactgaaaacagcaagaacttcggggtgaacacccgtttatcctttaacanttttttctggcatggattctcncaaaaaggtgaactgaaaatttngncntacagttggccattgtaaaaaacatcagtttcctctcatacattccaagtaaaccaagtaaaataagtacacttgcataaaagaatttaaggagtgatagctctttctgttctgccattcccaacattcctgggggaaaggaaaaaaaatgagttaatantatttcnctgagcccaagatggaaacttggtttgacctaaaacatctgattaatataggctanctgatttcttaaaaattcgttgcattgaaggatattttgcatgtctgtaacacctgtcaatacttgtttgtattgatttctganattcttncagctgactacgtgtaattnncagatcagctttgcantagatccnngcgnncnnnnggcaaattctgtattnnnagtgatgtnacaaanccctttattgctgtctgaganagtgaaagattgtgtatttctattaaaacatttacaatc

SEQ ID NO: 585489 - DNA, 160 bp, Homo sapiens
cacaggagctgagccgaatctgtgacctacaccacagctcacggcaacgcgggatccttaacccactgagcaagggcaggcatcgaacccgcaacctcatgctccctagttggatccgttaacccatcgcgccacgacaggaactcctgcttactcttaa

SEQ ID NO: 585490 - DNA, 341 bp, Homo sapiens
  misc_feature (271)..(271): n is a, c, g, or t
  misc_feature (301)..(301): n is a, c, g, or t
gctcctcaacctcgggtggtctgcccgccttgacctcccggggtgctgggattgcaggcgtggggcaccatgcccagccccactgttaagattctaatgtaggccgggcacagtgactcatgcctgtaactcaagcactttgggagttcaaggcggccagattgcttgagcttttagaagtttgagaccagcctgggcaacgtggcaaaagcttgtttctataaaaaatataaaaacttagccagccttggtggcaccactgcagtcccanctattcaggaggctgaggcgagaggatggntgagctcaggaagtcaaggctgcagtgagctgtggtagtg

SEQ ID NO: 585491 - DNA, 475 bp, Homo sapiens
ggttcacaagtgggcttaaatattcggtgaacaacactatcaagggatgtgctgtcatccaggctttattagttctatcaactagagggcgggcagagcagatttagtgtaactcttcaggaccccaggattttcagaatggtaaatgaacatggcttcaaagtaaccagcggcgttaacccctcacaaggaattcagcttgtcctttgaagcttcgaagccaggaatgaacttctcgcgtagctagcaaagtcctagagagtatcttccaatataaggctgttttgtctacgttgaaaatcgggttttgtgagtgtagccatcttcatgaattacctcagctagatcttctaaagaactcgctgcagtttctacatcaaacacttgctgctttaccttgcacttttatgttatagagactctgtctttcctttttttttctttggagacagatctcaagagtccaggctggagt

SEQ ID NO: 585492 - DNA, 972 bp, Homo sapiens
ctggcggcgcccagcggagtaggggctgcgctatgcgggtttgctgaagctggctgcctctcccactccccttatatgggttgcaaatgctgcctgctagctgggaagacggtgggccgtggcggggacatggggcacctgcgtagctggactgagagcctgcgcccagcttacatctgaccccacccggccccggccctgacccgacgcgacccgatccgatccgatcccattccatcctgttcctcgtctcctccacgtctgacccgttgcccgggccgtggttctgccacaccaggccatccaaagctgaggtacgcatcctacggcctgggactcgccttcgctttagagatgtatggcctcttccctcccaaacatgccatcttcaaaagctggactcttggactgggcacctggccagcttgacactactaccaagactccacttccgtacttacccagcattcttcctcagagtactatggtagcgccgctgggttggagacctgctcattgtccgttgcaaattaatcccaggagccctaaacatatcgacaacgcttgagcaaacccacaagccgaggagccagaccgtagacacggactaacataccatagccctatccatggcacaggccagtgcaccctgggcagcgaccctgccgcgctgcggctggtgctcggcaacggccatgaaccaggagacaggacgcacaaagaacgtgctggtgacacccaacagggctcccatggagcgagcacaaggcagacgctacaagcgggcgaacacgggaaggcagagagcgcagaacctgggcacacggacgcagagcccaccgcagcctcgaacggaagccggggacggggcacacgagcggcacacacacggccacaggacccgacgaccacccgccaggccgccacacaccggagccaggggccacggcgcacaggcgcaggcgccggcaa

SEQ ID NO: 585493 - DNA, 412 bp, Homo sapiens
cgacgtggctttatgtgacacacatacccagaaataattgatggtggggtgtcagttgttggatctaaattattttatgagcgggtcagttgaagttgaggcgatctcctgttaagtgtgtgtatgtatgttcatggtactgaagcagatgacacaggcgtgactcctttcccctcccttgtgtgtgtgttttgtggctgatgtatatttatgtggctgtgaggccatctggtcctcgaggctgtttgttttaccactggaggacaccagagggggaatcctggtcctgtttgtgtgactccatgtcccccttctccaggccctgacccagttgggcctgtctgtctctcattcttgttctctctggccttttctctcactcatcctcccactttttctgtccctctggtcg

SEQ ID NO: 585494 - DNA, 107 bp, Homo sapiens
cgctgatgcgtaatcagaactcgaccaagaggaaagtaagatggcaggactgtagacatggcagtcctgatcctttcctgagacggtaatataccttaccgggagct

SEQ ID NO: 585495 - DNA, 316 bp, Homo sapiens
  misc_feature (96)..(96): n is a, c, g, or t
  misc_feature (102)..(103): n is a, c, g, or t
  misc_feature (108)..(108): n is a, c, g, or t
  misc_feature (113)..(113): n is a, c, g, or t
  misc_feature (196)..(196): n is a, c, g, or t
  misc_feature (200)..(200): n is a, c, g, or t
  misc_feature (215)..(215): n is a, c, g, or t
attggcaactcagaagcagttcaatatacacagacatctgtgctggcgcatctgccttcaggaaagaaccttttgcccaagagtatcagccaaacntgaggnngcccngattnctgacatcattgcaatcaagtcacctgacacatttgtgagaactatttatgcaggaaatgctctatgtacagtgaagtgtgangagnaagtgaaagtgtatnctgtccgtggaacatcctttgatgctgcagcaacaagtggcggtcatgccagttcagaaaaggcatcaagtacttcaccagtggaaattaagcctttgcaa

SEQ ID NO: 585496 - DNA, 303 bp, Homo sapiens
tcgagagcgtttcttctctcgtcacctaggccgagtgcagggctgatcacggctcactgctgctcgacctctcaggctcaagtgatcttcccacctcagcctcccaagtagctgggaccgcaggtgcacaccatcatgcctggctaatttttaaatttttggtagagttgaggtctatgttgcctaggctggtctcaaactcttgaactcaaacaatccttccatctcagcctcccaaagtgctgagattacagatgtgagccaccacaccatgattgcattcctggataacacgttcgcgag

SEQ ID NO: 585497 - DNA, 620 bp, Homo sapiens
gtctaagatccgtcttatatactactcttaggcccatccacagaggtcacaagtctccctgctggcagtgcagatttcaccctattcgcaaactggacagcatcttcatctgcctctctagtcatgggaggcaggttacaacaggctgcagacaatggcccagctggtcatcattcgcagcaggtacgtcaccatcccgtatttgctgctgttccagaaggcatcgccaaattgagggtcatacttgatagcaacagggtaaactgtggctccaatttcaaaacttccctttttgaacatcatcaccgatgtattattgatgcaggttccttctgggaagatgaggataggcagcttgcttttatcttgcacatgttcagtcagtctcttagccaccaggtggcgatccttcacttccgagcgctcaaaccagacgtgtgggcaggccttcaccatggctctctgaatcacacccatgagtcccccgtgcacttgaaccaccattggataatagccatcgctggccaagatgatcacatcgatcggtgaggtatgattggccacacagattgccacatttcttgcgctgttttccctgtcatggtaggtatgatgaagga

SEQ ID NO: 585498 - DNA, 445 bp, Homo sapiens
ttcttcacagccagaggggtcctggctgccttactcagagctggaacaacagccacctgtatggtgcttctggcaggactgcctgatgctggaagagcagctgacgtgggttcttgtctgccggcgtgtcatttcatcctccgaatatttattgagtgctgagtatgttagcactcttctagggctggggacacagaagagatgattgaggaggcagtattttgtggtgattaagagagtgtgacctggaatattctgcccgggctagagtcacaggtttgctgcttcctgtgtaaacctgggcaatggactgaagttccctgatctgcactgtcttcatatataagatggcaaagatgataaaaacactgtctcaggattattctgagggttaaataaattaatacaaataaagtgccttcaacacttcctgtcatatgttaaa

SEQ ID NO: 585499 - DNA, 737 bp, Homo sapiens
atggcgtcaggtctaatgcggtggtgccgtgtgaacgtggggcttccgtagccgccgtgatccccgcatatccacgcgcgtacggcagggatgagagaatgatagaagtcgagtatgaggagtgaagacgatgatcacagtgactaggacagctgtgatgaacgagagatcgagcgttcatctgacgacgtagagtgaatgagtggaattctgacgcttatgccctagtcagtactaatgattatgacgtgaattagagcaaattacatgcgagcagcgttttttctagaccggctccgtgtgaactctgcagagactatcagatcctcttaagttcgacagtaaccatattgggagtgtgagttaagcaaacggatgtttcagtaagacatgctaatgatagatactgcgactgaactgatgacggtattaggcctctcataagccttttaaatttaactgaaagacacgggtacccagtgtgttgaatcaaattcaatgatgttggttctacgcttctgtgagaagaactgtgaacaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaaga

SEQ ID NO: 585500 - DNA, 330 bp, Homo sapiens
gaggactcatttcagacattcatgtgtgtagacctgagaaatatcggcaattcttttacacagcatgtccacaggaatctcatagaccatacttgtattatccagtatcgctgcctcatagctgtgccctactgtaccatgggatctcgctgtcagcatgtcattaccggtcatcacacacaccaagtgttttcacgttatcttgacataagatgagtcacgtgtgcatggaatcccaatacatttgtcatggtactcttcttcgtgtgtgacacattacatgcacagtcatttccactctgaccagctacctgatgtacaggccaccac

SEQ ID NO: 585501 - DNA, 150 bp, Homo sapiens
actctagggaggtttgagctgaggcctgactaatgagaaggagccagccagaggaaggcattggaactagcaagagtcacaaatacagaggcctggagtagccattgctaatgtaccgccaccctcggccaaagtcatcctctaccgcat

SEQ ID NO: 585502 - DNA, 159 bp, Homo sapiens
gagctggtaccgttgatcgtgaacgaaaccgacattgcgctggacgcgcgctggattgcatggcctggctattgcctggagcgctgcgccgagccgcacctgcgcgccggacgcctgcggcgcgtgctggacgagtggtcgccggcgggcgcgccactg

SEQ ID NO: 585503 - DNA, 143 bp, Homo sapiens
tctattaaatgatccaaaggggtgtataatccatccttaagaaacaatttatggcagacaatggtccagaacctaggtaacaagtaaaatatggaagtaacagaacataatagagactataattcatcccaatcaacataggg

SEQ ID NO: 585504 - DNA, 217 bp, Homo sapiens
tggtctcagactcctgagctcaagtgttctgtccttctcggcttccaaagtactgggattacaggctgtttttcgtacttttttgatataagtcacagtaaaaaagtgttttacattatgtgtgtgtatgcgtgagatacaaatgtttgatgggatagttttcactattttttcacccttacaatagataatagattcttaaatttcctttcttcat

SEQ ID NO: 585505 - DNA, 120 bp, Homo sapiens
catttgtcatgatcttcttcatagtactacccatcataatcggacgcttaggcaactaactagttcccctaataatcggtgccccaatatggggtttccccgcataacgacatcagcttc

SEQ ID NO: 585506 - DNA, 793 bp, Homo sapiens
gcaggtcgcccgggcaactagccggctccctcgcgtcgcccactcccgctctggctctccaaggaaaactaggcccctgctgcggcctaaggcccaggatcgcgcgaagctgcgcgcccgaagagtttcagcacccatgtggactttcacaatcagagatggcagcggtaaaggcatcaacatctgaagagctaccaggccgcttggtattctcatccggtatatgcaagatagtggcaacatgatcatcagagcaataggcttggatgctagagccaatcacgatgcctacaggcaaggccgtggaatccatggtgtcaatcttccatggtacttaccttctgcgcttattccccaaagctcgtacgataatgaggctgcgtatcctcagtgcttctatgaccatcatgtggccgtggcaggacgtaccccatgcgaggatcgtgtcacatttcagaagatctgggcagacatccacgttagagcagtaggagtccaggcatgcatgaaagaagacagggcttggtccaaagaggaagagatggagactgagtgagatgcagaggtagaatgtgacctgagcgatgtggaaatcagtgaagagctccgtcagtacttcgcagagacggagaggcataggagaagaacgacggctggcagcgagcagctggatgcagagcgctggacagctatgtgaacgctgacgacgactgtacgtgacagaccggcggtcggtagaagcccaaactgagaggctggtgagcggcgccaggcgagatgagcgttggacggg

SEQ ID NO: 585507 - DNA, 150 bp, Homo sapiens
aggagtattggtaccggggaaatagaagaaggtagtaggggggtaggtaggtacgaaggagggactctagggaggatacgtacgtagctagccgagcagttagcgctcatatagggccggggctaccgactagcaggtagacccgccagg

SEQ ID NO: 585508 - DNA, 358 bp, Homo sapiens
tttatagtcgactccgtttacatttttgccttcttaatttcaagattgcaatttcgcttcaaaacagatcatttttttaaattgtaaaaagtattcaacatatgcagaaataaaaagcatttggatggctgggcgcgggggctcaagcctgtaatcccagcacttggggaggccgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaatggcttgaacctgggaagcggagacaaggtagagccgag

SEQ ID NO: 585509 - DNA, 212 bp, Homo sapiens
  misc_feature (174)..(174): n is a, c, g, or t
aaccgtacattttcattccctcatccattacccgcgcagttaagcgggaaaactatttcgcaacgtcgcgcttgtggctaaaatagccgccatttttcagctactggataagaatgtgaccgtatcttctcatcgacttgaactgttaagcccggcacggatgccgccattgcncgcgaactattttgcacggtgccgatgctgtttatatc

SEQ ID NO: 585510 - DNA, 510 bp, Homo sapiens
tccccaaagaaaaaaatccttcgggggaaaaattttcctttttttaaattaagggttaaaattcccttgcccaaaaaaaaaaaaaaaaaaaaaaggggggggcccaaaaaaatccccccgggggcccccaatctatacgacgacccccgcttttttgttaacaaaagggggcgcccaatattggagcgagccgcagatattaataagacgaccaagcggcacgggcgcccgcttttaaaacaaccggccgtgggcctggaaacaacacctttcagcccgcggtgacgactctctttgtgaggaaagacacacccacttacctctttgtgggcgcggcgcgagccaaccaatcatgatggcgccaccacacccccaccccaacgagaggagaaattattatcacacccggccctcagaggggaaaaatatataacaccttctcgcagcggggcttgcctactcggtgggtcgtcactcccacgaaacggccgccttatttatgactctgac

SEQ ID NO: 585511 - DNA, 464 bp, Homo sapiens
  misc_feature (364)..(364): n is a, c, g, or t
actccccgtgtttggtgtcttaactgtgtgtgcgtgtgcgtgtgcatgtgtgtaaaccccgtgggcagggactacagggaaggctccttcatcccaggtttgagatgaagctgtactccccatttcccactgcccttgactttgcacaagaaaaggctgagccccattcttctcccccttgtagagagggggcccttgcttcctgttccaaggggtacaaaataggctttcttgccttcccaataatcccctttgctaggccccggggaaaccacagggatgcaaatatgcttagggctgggcctctggtgttaccatgggccaaaaaactttttaaagctaaagaggggcctcgggtgccttncaaattctcgtgggtgctggggggaaacaataaacctaacccttggcttccatttccttaatatggctgcaaaattaaaccggattttttaaatagcttt

SEQ ID NO: 585512 - DNA, 162 bp, Homo sapiens
ggcagctaatcagataggaatgttatgagctattttaaaggttcttttggagaaatatattaatcctttttaaatatgtaacctgagaatttgtttccaataaattaaccttgcctttgaatttatacacattctttaaagggtatttaactttaaatgtga

SEQ ID NO: 585513 - DNA, 906 bp, Homo sapiens
  misc_feature (509)..(509): n is a, c, g, or t
  misc_feature (906)..(906): n is a, c, g, or t
tccagccccggtcaccggaccctgaagccgcaaaaatgtggatgcctaaaaaaaaccggtttgcctatttttgaactctctttttaaggagggatgtcagtgggtggccacaaaaggtgtgcccacatgtgcctataagacacccgtgagcgtggcaagacaagaattgttgcccaacctttcagtgctcattgaaggccagtgacagtctcttcaatgttcccgaggctacgttaaaggacacacgtttgtgccgtggacgacattttcataacgtgggatcaccttttaaccaaagtggagaggctatctcacgagattatcttccacggagtgaatatcacctatatcaaatctgtgcccccgcggaaatatgtggttcgccagtgccaaacccaattaagcacggtaaacacggctcacaagaaagaaacgtggcaaaagggcactatcagagaccataaaagagggctctgagggagagagagtgagtgaaagcaagcacccgnggcaagaaaaaactctccaccaaagagaggcgggagacacgccgagaacagagagagatatcaccataacaacagaacagcagagggaggcatggtggccccccacttggtagtcgcactagaactaatagacatcaatgcccagaatgagctcatgggagcgcatgtggggcgatcaaagcgcaaaaaccgcctcagaaaatttacacccaatagtttataaagaaatcgcgcggagaaatattggtgcggctaccgtataggcgaccgatgttgggcacaagagcacaaaactcactaacagtgataaaaaatcactttgggagacagaccgaggattacacaattgacggcacgtctagaatattcaaagacattaaacgaagcacaaaataan

SEQ ID NO: 585514 - DNA, 1840 bp, Homo sapiens
ctttgcatggctacctctacatactgctattgctggctattggaagaccttagtgtcagaatcttcttgtgtacaagccctgaatggtgtgaccaacccaagttcctacagcatctttgcagctgttgatctcactctttcgttcctattggagaaactaccggcccagcaatgtctttgctgtgtttggcagactttaaggcacaagcacaaaagcagctgtctaagacctcctgggattttattgaaggagaagctgatgatggcataacctacaatgacaacttggcagcatttagaagaatccgcctccgccccagatacctgagagatgtgtcaaagatagacaccaggaccacaatccaagggcaggagatcaatgcccccatttgcatctcacccacagcctttcattcaattgcctgggcagatggagaaaagagcacagctaaagctgctcagaaggccaacatctgctatgtcatcagcagttatgccagctatactgtggaagacattgttgctgctgcccctggaggcctccattggttccaactttatgtgcagccagactgggacatcaacaagcagatggttcagaggatagaagccttgggtttcaaagctttggtggtcactgtagatgcacctgtacttggcaataggcgagggaacaagagaagcctgctggatttggaggcaaacataaagctgaaggatctccgatcccctggagagagcaagtctggacttcctactcccctgtctatgccaagttcatcttcctgctggaatgatctccccttgcttcagagtatgactcggttgcccattatcctcaaagggattttgacaaaagaggatgcagaattagcagtgaagcacaacatccgaggcatcattgtttccaaccatggcgggaggcagcttgatgaggttcctgcatctattgatgctctgagagaagtggtggctgccgtcaatgggaaaattgaagtgtacatggatggtggggttcgaaccggcaatgatgtgttgaaggcactagcccttggagctaggtgcatttttcttgggagaccaatcatttggggccttgcctgcaagggtgaagatggtgttaaggaagttttagatattctaaaagaagaactccacacttgtatggccctttcaggctgccggtcagttgctgagatcagtccagacctgattcagttctccagattataaaggacctactgagattgcctacaagagaaagacaagcttttcaacatagtgtgtgatgctgttcttcttgggtcccattcataatagaagtttaagccctctaccctcaaaaattgagacagatggagaaaagataggctaaagctaccagagggtgcatttggatgaagaaataacatctaatgttctacaggaaactagagttaacaattaattgactatatcaaaaagccatgttctagcaagaaaggaaatagttagatctgatgtgacataccagttaccttcatttgatcagtagtgcattatacataattgaaatgtcatactgtgccataattatgtgtaattactatgtatcaattaaaatatcaatatatgttcaaaaagaaatggggacagggttatcctgattttattcattccctcctgcaagaaatatttttaaaacatcaatatatgtagtcaaattctgaagcatagtacagcatgtgaattattcaagtttctgtcacagcatgttacagaaatattatgatctattgcctaatgtccattgttaacagaagctgacctcaataaaaaaacaagaggaagattttgaaaa

SEQ ID NO: 585515 - DNA, 150 bp, Homo sapiens
tccagaagctctggcacagtgaggtgcgtagagttactgcaggtggtccttcccaggaaatttcaccacatcacccagttctcaggcgtcgcgtcccttgtgttgattgctccagggccaattctaggcgcctggaggtgggtggtggga

SEQ ID NO: 585516 - DNA, 609 bp, Homo sapiens
gttgaaaaaaaaaaaaaaaaaaaaaaaaaaaaaaaaaaaaaaaaaaaaaaaaaaccaaaaaaaaaaaaaaaaaaaaaaaaaaaaaatcaaaaaaaaaaaaaaaaaaaaaaaaaaaaaaaaaaaaaaaaaatgaaaaataaaataaaaaaaaaaaaagaaaaatataattaaaagtagtacataatgacaaaattaaagtgatgaaaatgataacataaaaaacatgatgtgataaatattacaaggcgcaggatataaaataaataacattatataaatgagatattcatggggaggaccaaaataactacatgaggtcatattcatgaatttaaaaataataatattattgaaaaaacaatttaatatatgataaatacaaaggattcccttaccaaaaaggttattaggaaaaagatgttataaataattgtgaaaaaaaaaattgactataattataaccattttaaatattatccccataattatgaagataaaaaacctttagaattataataatcacaatatatgtgaaaaatttttgaaaaaatggataattattaacattattaagatatggtgatcatttatgaaggaggaaaaaacatg

SEQ ID NO: 585517 - DNA, 375 bp, Homo sapiens
tgttatcaccagtgtgagcatccgagtcagatgactgcaagtcatgggtgactcctggcatggccagatatgcttccaatcgaccaactgtggtatccgcacagccatagcctgttgccatagaccttggatgcttctcaatctgagagggcctgtcatcagtgatgtcagcaaagggcaggtcgccatctgccttcacatcgcactcttgttctgtaagtttgtcaagcaggtcagcctctctcaatacggtaggaccttcatccacgcctcctcgagtctgtccctttgacaaagaagctgcaataatccctatggttctgcacttggcgtacatgctacgacagttctgtttgctgcacttgatctgttcag

SEQ ID NO: 585518 - DNA, 214 bp, Homo sapiens
ccgcctcattgtagttaagcaaatatacaacactgctgtcgacggttaagagaggagaaatcccaagtaccaaacaatgtccatccacatgcacagagtacaaattcctttgcctcaacaaaacgtagaaagaatcaaaaatactcccaaatggggtactggatgggcactagagagttagcacattgtcagatgtggtcaaaacgtagtgcca

SEQ ID NO: 585519 - DNA, 238 bp, Homo sapiens
  misc_feature (36)..(37): n is a, c, g, or t
ctcctatcgcatctcaaacaccgcaatctcaatctnntgccttgaacctttcaacttgctgttctcttccagatacctgtgcatagatagattgcggtgtttgagattgcggagtttgagattgcggtgtttgagattgcggtgtttgagattgcggtgtttgtgattgcggtgtttgagattgcggtgtttgagattgcggtgtttgtgattgcggtgtttgagattgcggtgtttg

SEQ ID NO: 585520 - DNA, 330 bp, Homo sapiens
ctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatatacagccagcatggttaccgagtggtagagattctcgagcattctcaactctctttgtgggtaatgattgtgctaaaataacttaattaatacagaggggaaaaggtgtacctctacctactaatgtactctaatatatatatctctctactaatcaggaaaccaggagtatgatctcca

SEQ ID NO: 585521 - DNA, 139 bp, Homo sapiens
gaaggggtgcatacatccagaagtgggtcagacctataaagtcctaagatcaaagttaaatgccacacttgaacttcttggtgcccacctgggtctcttccaagtgtactttcctttctttcctgctcatcacgcggat

SEQ ID NO: 585522 - DNA, 413 bp, Homo sapiens
  misc_feature (390)..(390): n is a, c, g, or t
  misc_feature (405)..(405): n is a, c, g, or t
ggcacgagctcactctgtatatacacacatatatatttttgagagacagggtcttgctctgttgcccagactggagtgcagtggccagtcacagctgactgcagcctcaacctcctgggctcaaacaatcatccgacctcagcctcccgagtaacaaggactacaggtacacaccactacactcggctaattttttaaacgttttgtagagatgggggtctcacgccacgttgcccagggtggggactttgtattttaaatttaatctttggtttttaataggatgacttttgtgtatattatgacttgatctacatgtattatggacttgatattatttggaacttcttttagggttggaaccattatggaaattggatattcaaccanttttggacccacggnaaatggac

SEQ ID NO: 585523 - DNA, 247 bp, Homo sapiens
acgagctcgagcacttcatatcagagcttcatgcccatcgtgggctcattgctggcctggttctctttggagctgtgatcactggagctgtggtcgctgctgtgatgtggaggaggaagagctcagaaaaggagggagctactctcaggctgcaagcagtgacagtgcccagggctctgatgtgtctctcacagcttgtaaagtgtgagacagctgccttgtgtggcatgaaaggactcgacatgaa

SEQ ID NO: 585524 - DNA, 218 bp, Homo sapiens
ccagtgttttaaaatgagagttattgtcatacattccaatgaatcaaaacaataccaaaacaaaaaaccacacaaagaactatattcaaccatatgtgatcacaatttccctcattacagtgaggggaagggtctggtggtggtttggtttggcttttaaattgtatctcttttattatctccacactgccacacatacacaaaaagtagagggatag

SEQ ID NO: 585525 - DNA, 174 bp, Homo sapiens
gtcgccacacggacgccgatagcgtctcaactggcatcagatccatctggcttgggatgattggattgcgcatccggaggggcgatgggacgccgtcgtgaggtgccaaagcctcacattgtccaaatctctcagcgactggtgcagctggtccgcatcttcgttcaactccgg

SEQ ID NO: 585526 - DNA, 1030 bp, Homo sapiens
gcactacatgaacttaactagaaataacttggcaaggagagccaaagctaagacccccgaaaccagacgagctacctaagaacagctacaaacgagcacacccgtctactgtacgcaaaactacgtgggaccgacttctatacggtacgacggcgaccaaaactctatccgatgcctgggtgactacgcctgggtttgtccaaggactacgaactcttacgttcaactattcaaattttgcccacaagaacccatctcaaatcccctgtgtaaaatttcaactggttaagtccaaaagcaggacacagctctttgggcacactcaggcaacaaaaccttgtgtcagcagacgcagtacaaaccatgttaacaacccattagtagggccctaacacagcaggccaccaaagttaagacaacgcgtttcaagcctcaaaaacccaagtaccctaacacaaagtcccaaaaagcattataacgtgaaactccttcaataccacattgggaccaagtctatcaccctatagacagaacctaatggtcagtatacagtaacatgaacacacaattctcctccggtcatacagccctgggttcaggattacaagacacttgaacctggagcaagttacacaggccccaagtattctaccaatcaaaccaaaccacaggtccattacttacgcctcaactggtgcaaccacaacaccaggcattggtccaatataagggaacaacgcgttacaaaacacatgttaataatgggaacttcggggacaaactctttacacccccgagcagtgttaacccaaagacatcatgttcaacctttcgtaggccatccacaccaggatctaagaagggataccggatgtgccacaggggacaacttgtgttcaacgggacagacgaaaccactacacacgtggcaaaggcgagaaaaacactgtggctcaaagtgagacgacctggctggacaggccccacaaggatacaaacaagagcacaacaataaacacacagaggaagc

SEQ ID NO: 585527 - DNA, 266 bp, Homo sapiens
ccaattcctgcactttgccgatttggacttcattctattgcagagtatgatgaaggaactccttgatagaaatacaatacttgcacaaagaaagaagtccaaatccatcctagtttttttttctttttcttttttgagatggagtctcgctctgtcgcccaggctggagtgcagtgacacgatcacggctcactgcaagctccgcctcccgcgttcacgccattctcttgcctcagcctcccaaatcggcaaagtgcaggaattgg

SEQ ID NO: 585528 - DNA, 132 bp, Homo sapiens
  misc_feature (19)..(19): n is a, c, g, or t
agagatggggtttaccatngttgctcaggctggtctcaaattttcgagctcaagtgatccgcccgccttggctcccaaaaggcatgagcactgcgcctgacctacgatttctttctttatatatcagtatga

SEQ ID NO: 585529 - DNA, 492 bp, Homo sapiens
  misc_feature (423)..(423): n is a, c, g, or t
  misc_feature (436)..(436): n is a, c, g, or t
  misc_feature (464)..(464): n is a, c, g, or t
  misc_feature (473)..(473): n is a, c, g, or t
gagatagggtttcactcccatcacccaggctggaatgcagtggcaggctcttggctcactacaacctctgcctcaagcaatcctcatacctcggcctctagagtagctgggactacaggcaccagccaccacacctggctaatttttgtatttttattagagactgagtctcaccatgttggccaggctggtctcgaactcctgacctcaagtgatccacccgcctcagcctcccaaaggctgggattacaagcaagagccacagtgctgagcctcagaatcttatccctgtactcacccttcctcaagaacccccagaaggtgagcttttcccatgacagcaagcccttgtttgggaggtagagtctttaaggaataatcttaatttcatcaaaatcatcaaatgaatttgatgcattgacnggggaagatagtntgaaagaagttttatagttctgaggagngtttagggnaattagtgccaggtggttg

SEQ ID NO: 585530 - DNA, 776 bp, Homo sapiens
taatcccctggccaacccgtcatctactctaccatcttggcaggcacactcatcacagcgctaagctcgcactgattttttacctgagtaggcctagaatataaacatgctagcttttattccagttctaaccaaaaaaataaaccctcgttccacagaagctgccatcaagtattctcctcacggcaagcaaccgattccataatccttctaatagctatcctcttcaacaatatactctccggacaatgaaccatacccaatactaccaatcaatactcactcattactactcataagggctatagcaataaaactaggaatagccccctttcatcttctgagtccagaggttaccccaagggcaccccttctgacatacggcctgcttctttctcacatgacaaaaaattagccccaatctcaatacatatacccatattctctccctcaataaacgtaaggcttctcctcatctaccaatcttatccatccatagcaggcagtgaggtgataaaaccaaaaccagttacgcaaatcttagcatactcctcaaattaccaataggatgataatagcaagttctacgaaaacctaatataacattttattaatattatataatcctaataataagcgatcctaatatcaatttaatccagaacaagagctatatatctggactggaacacgtaatggttaaacttaattcatagcctttttctagagctgcccgaacggttttgcaaggaattgggatcaaaaaaaagataaca

SEQ ID NO: 585531 - DNA, 985 bp, Homo sapiens
acaattcagaggctgctgcctgcttaggaggttgtagaaagctctgtaggttctctctgtgtgtcctacaggagtcttcaggccagcctccctgtcgggatgggcttcttaatgaaaacacatttttcctccccattctgggggctctatcatgcgcctactaactactattctgcaaacgaggaattcagaccagagatgctccaaggaaacgcaaacgtgattgtcacaggggcccagccaaaagcggatcgggaagagacgatgcgcctctctcactctgggcgaaccgcacttggcgcacgccccattgttgcgctgcgttgcacaggcggacgggctccaagaatcgacatacacctcgtaccacggacaccgggtgggtcaatccccaacatggccactgtgaacgccctattgggcacgcgcacggccacttgcatgcccacccacccttaaccactaacggcccctgcgcacacccccacctggcgcaaagcggagccactggcacccccatatcacggccagcaaacggccaaacctctctcgggcctgggcccccccaacaccgaccaagtgcggaaacacaggacctccacaattgtgggcgacaagcggaaccctttacgcgacaccctacttggccactcccgaagtttgcccgttacagacacatacccccaacgccacaaatttccgaagaccgccgtgcaaagtccatgcccacttatgttccacgctctagtcggccaagaccattatccccttctcgctctcaattagcccactaccatgttgcccaaaatgcggcaacttattaagcattcgaccccaccgcccgccaaaaatggccttatctcgccccgacccaccatcatagacgagacaaccgccacaccctttgtcgcccacaccaaggggcttttacaacaagacgaactgatatgagaccgaatattactcacaggagcttagtgcacac

SEQ ID NO: 585532 - DNA, 238 bp, Homo sapiens
tggggccccccccccgggcccccccttttaaatttttttttccccccaagaaaaaggaaaccctttttttggccttttttaaaaccttcccggttttagggttttggttcccttggggatggggttccccccctttttaaaggttggggttgggaaatttcccctggggccccccaacccccaatttttttttaaaaagggggttttttttttttttttaaaggggccgggaagccca

SEQ ID NO: 585533 - DNA, 1147 bp, Homo sapiens
acaaagaaggtaagggcagtgagaatgatgcatctatgacattccttgatgctgttgtgtcatgccagtctgctctgcctatcctctgagtggggcagcaaaagagcgaggactccaacaaaggatcttgcccagcaatacctagaaaagtactacaacctcgaaaaggatgtgaaacagtctagaaacaaaggacagtaatctcattgttaaaaaatatccaaggaatgcagaagttccttgcggtaggaggtgacagggacgctagacactgacactctgagaggtgatgcgcaagcccaggtgtggagataccatgacgctaggacacattcagctccatttccatggcatgccgaagctggaggaaagacccaccttacatacaggattgtgaatcatccaccagatttgccaagagatgctgtagatcctgccattgagaaagctctgaaagtctgggaaagaggctgactccactcacattctccaggctgtatgaaggagaggctgctctactgatctctttagcagatcaaagaacatggagacattgactctttcgcatggccaagacacagattggctcactgactaccacctggacctgggcattatcatgcgagcatatcccttagatgatgatgaaacatggacagaagatgaatcaaggaacaccagcaactccatacgcagactgcatcagcaaactcggaccaaatcacacggaggaacaacacaacacaaacaagaacgaagcacagaaataacccaaccaacagctcagtcaaaaggctccacaagaacagctacagcaagccgacgcagaacgaaacaaacaccaaaaacaaacgcacccaggaacacagacggagacacaccggaggacacaacaagagccgacaagcagaagaaagcacgcgcacgagacaaccggacgaaaaccgagcacaaccaccagaaagaagagaaagaagcagaacaaaaacaaggagaaaccaaagacacacacggcccccaaaacagccgccaccgacgacacaagggaagaaaacacaagaccacacgacggacggccgaacacaagacggaccagctactcaccagcgagagacaccgcgagagaagtagcgtcgacacggcacag

SEQ ID NO: 585534 - DNA, 822 bp, Homo sapiens
tggagacggctctctctctgttgcccaggcggagtgcagtgagccgagatcgcaccatggcactccagtctggggcaacagagtgagatcccgtctcaaaaaaaaaaggaaagggaaaaaaaatatagcattatacctctttcttggtctcaaccgccatgaaatttctgaacattcccaattccggtggattattccaaaacaaattttataccgtttaaaataatttccttcttataggttaataggtatacttaaaaaggcctcaggggtatataatcttctaaacaggctacaattctcaggtggcaggctactttacccacttattgtcctcttagtttgagaacaactagggccatatttcacgtgctggtgtacgcctcagggcctaactgggcgtgccaaataaatatccgtagactttaccctgatttggttaaaccccattcgttttggttccacaactggccaaaattctcaaagggctcggtatttatgtaatctctctggaacatatttatctcattggattccacagtaatgggacgggcggcgtgtgactataagaacataaggtcctcattatttattaaaaaccctcaaatattgccttggttttacccaacattccttcccttttctacaagttattttttaccaatcattggggttctcccaaaaggtgatattttgttgctctgaaaccacgtgcaatatttttgctttctcgggacactttgtgtatatttcccccacactttttcttttcagacaattctggcgggaattgtggggacggaccacatctggtttaccatg

SEQ ID NO: 585535 - DNA, 344 bp, Homo sapiens
atccgcttagtagttttccggtcaaaaatgctactgcttttagttaagagggaacatcaaggctcgggtgaggtggctcatgcctgtaatcccagcactttgggatgctgaggtgggcagatcacctgaggttgggagttcgagaccagcctgaccaacgtggagaaaccccgtgtctactaaaaatacaaaaaaaattagccaggtatagtggcacatacctgtagtccttgctacttgggaggataggtcaggaggattacttaagtccaggaattggaggttgcagtgagtcatgatcatgccactgcactccagcctgggtgacacagcaagaccctctc

SEQ ID NO: 585536 - DNA, 166 bp, Homo sapiens
agtgttcatgtctacagtagaaaatctgatcatacctagcaaacaacagattgtcttctaatgggaatgtaacagaatctggatgcaaagaatgtgaggcactggaggcaaaacatattaaagaattttagcagagttttgtacatattgtcccaatgttcatcaa

SEQ ID NO: 585537 - DNA, 487 bp, Homo sapiens
gctaaatagagtacggaatggaaataaatggaaggtggtcagaagatggacatttgtagtaggctcctacgcgatctctcaatgatggccgaagattattagaatcagcgggtcaataggacgaaatgtagcctgggactctgtgcgtcgtgggtatgtttttcatgagagtttagtgtctcttcgtacgggacggcagcacacaaaggtcatgagtaggatcttactgctttacagaggggactccttaatttttaaatgaaaacaatattggcatgatggtgaagttcccaaccagtccatacaagcccactgagttcataacgtactggaagaccaatgcagctctgcccaccaccggcaaacaacgtcttctcgtgacatctcccaggttccaactggggggtcacttcagttggcagctcccaagacctaggcaaggcctctgtgggacaggaatcaggatcgggtagaagaggcaggaccg

SEQ ID NO: 585538 - DNA, 579 bp, Homo sapiens
  misc_feature (150)..(150): n is a, c, g, or t
  misc_feature (262)..(262): n is a, c, g, or t
  misc_feature (265)..(265): n is a, c, g, or t
  misc_feature (268)..(270): n is a, c, g, or t
  misc_feature (274)..(274): n is a, c, g, or t
  misc_feature (340)..(340): n is a, c, g, or t
tggacaggtcccagtcatatacctcaacgcctgggccagattgaatgtgattactatatgaaaagaggagaatgtaaatttggagaaaggtgcaagttccatcaccctattgacagatctgcacccgcaagaaaccagaccctagaacanaatgttaaatttactctcgcaggtcttccaaggagagagggtgttcaacactgccccttctatatgaagactggtacagtagctatgccgtaattgcaagtttgaccacccnccnccnnnagangtcagccgcagcaggaaaggaaacattaacaaaggctgaagaggaagggaaagagagtgaagaggntgctgcaacagctgaaaagtagcagcaggcttttgttaattctagaattcttttagtatataccagatcctttgttgttggaaacaattttctgtttgtttcgatacgtcatgcgtctattttgtttccctttcccccctttgaaaggtattaatctctagaaatggctttggtctacaagcgtttgtttgacttggaagtgcttgaagaagaacttaaatggtattttcttcgttctc

SEQ ID NO: 585539 - DNA, 263 bp, Homo sapiens
catcccccttgcgtgtccatagtaggggtgtgggccaacgatgcttgatccaggtctagttacccgtggcagctgtactgtatcaacgtataatacagaaaaaccatctctttaaggtcctcctacacaaagacatagagtgatactccctttacatgtcagtatttgtacaacactttagtgcaacttgactgtcagggttacaatggactacaggcaattggaataatctgaccaattctgccaccttgtgactttcatat

SEQ ID NO: 585540 - DNA, 125 bp, Homo sapiens
tctcgaagtcgacttaataacgtgtaagtcatagagaacattcaagaaatacaatagtgatttatccacagcgcagttcacatccgatagagaagaagggagaaagggtcaaggtactttaaatc

SEQ ID NO: 585541 - DNA, 1086 bp, Homo sapiens
gcggaggtcggcaggtcgggtccgtcgtctgcccgcggctgtgtgctggcgccggcggatccatgccttatgctggtttcatctctgtgtgctgtgctgtgctgtgctgtgctggcctctgtgtttgactgcctcctcctgccatgctgatgccctgcatgggagcccaggacgcctgcttcccctggccatccccgctccccgatggctggcctgcctggtcatggcgcagccgggcccggcttcccagcctgacgtttctcttcagcaacgggtagcagaatttggaaacacaattaatgcagaatttattacgtgcacaacagcacgctctgaaccaagacatttacatcaaaacgagagcccaccacttcaccgggagctcactacttcggcctaacacgacggacggactctgacacgacggcaaacactgccacacttcacacacgcctgcacatagactgacttaggggaccagcctatcgcaaccccagactgtgcggcaaacgctcacaatgccaccagcatgcgcagcacatcatcaccaggccggactttgtcctaacaggctcctcctggaggaaaccacacaacagcccaacgcaacgcctactacgcatacgcaaccgtcgacaacaagaacccggctgggcaagacagacacgcacacggtcgacactaccacacccatccacgacgcctcgcacaatgaccacaggaacaaccaggacaccggcgaaccacaatgccacgcaccccagagataccaacaccgtaacagcgcactgggcaagccacaccaagcacgaacaccacacacgaagaatcacaaactacgcttattaagacctcaacctcccggcccactaatcagtggggacacaattaggctgtgacttgcaatgccaagaaccaggcatggcccacgaccatcggacccccacaccagtccatcacaccaactcacaaaccactagaaaccatgtcacacccctcgcccaccacccacgccactgcagacccaacaccccccccgcctccctacatgccattcacttccccaatggtcaacaaacgcacaca

SEQ ID NO: 585542 - DNA, 101 bp, Homo sapiens
aatcagtgtcgatcgagataacgtcgaaatcccacaagacagcgtgcgaaaaaacggtcgtcggtcgctgtgtgcagatctcacggtggcatatgaaatag

SEQ ID NO: 585543 - DNA, 220 bp, Homo sapiens
ctctaaagaaaagaaaactggaggctgggcgcagctgtcacgcctataatcccagaggctgaggcaggcggatcacctgaggtcaggagttcaggatcagcctgaccaacatggagaaaccctgctgaaaatacaaagttagccaggcatggtggtgcatgcctgtaatcccagctgctcaggagcctggcaacaagagcaaaactccagctcaaaaaaa

SEQ ID NO: 585544 - DNA, 550 bp, Homo sapiens
tttacttagctcgagtctgatccatatacaagaagcacacgtagacagtgaagaacagaagaaaactaaatgcattgctataaaaaattaccagtttctagaatgtataaggcaaaacaggtaatagagtcaaaatattgtttggagtacttttctgctaaaatttgctcattaaacttctccaagtagatggtagcacaagatattaatactggagtgtgcatttttgtctaaaatgtatatacatttcaaagtgtataggcataggatactatggatcagatcactatttggtctccattatacattgggtgccttggggaaaaaaatccaaatattgtagtttatgaacctgtatcataagaaactagaaaaatttagttatgttgcctactcaaagtagtctttaggagtgttaagtagtgtgtctagaaacaaatagtaaaataattcagatttgattgcactttccctcttattttgataaattattattggtaaaaagaacaagacacattatgttaagactaatactttttataactattct

SEQ ID NO: 585545 - DNA, 313 bp, Homo sapiens
aagatcttatgatgcaaagtgaggatgagttccccactcttcaggatcacggaagccattcatgaggtgcctccaaaaagtacaacccaagcccaggttgtggaagatcttcagttgcccgtccatgctggagcgggacatggtgaccccacgttggagggaagcccttcagctgcgggatctgcaacaaggcctaccagcaattgtctggtatgtggtaccacaatcgaaaccaacaacctgacgtatttgctgctcagaaaccaccgatcttccaagttctcatcactccagtgcagctcctgtgacaaaa

SEQ ID NO: 585546 - DNA, 673 bp, Homo sapiens
  misc_feature (55)..(55): n is a, c, g, or t
  misc_feature (80)..(80): n is a, c, g, or t
  misc_feature (117)..(117): n is a, c, g, or t
  misc_feature (120)..(120): n is a, c, g, or t
  misc_feature (126)..(126): n is a, c, g, or t
  misc_feature (134)..(135): n is a, c, g, or t
  misc_feature (158)..(158): n is a, c, g, or t
  misc_feature (164)..(164): n is a, c, g, or t
  misc_feature (169)..(169): n is a, c, g, or t
  misc_feature (172)..(172): n is a, c, g, or t
  misc_feature (189)..(189): n is a, c, g, or t
  misc_feature (196)..(196): n is a, c, g, or t
  misc_feature (211)..(211): n is a, c, g, or t
  misc_feature (216)..(216): n is a, c, g, or t
  misc_feature (220)..(220): n is a, c, g, or t
  misc_feature (223)..(223): n is a, c, g, or t
  misc_feature (227)..(227): n is a, c, g, or t
  misc_feature (242)..(242): n is a, c, g, or t
  misc_feature (283)..(283): n is a, c, g, or t
  misc_feature (337)..(337): n is a, c, g, or t
  misc_feature (339)..(339): n is a, c, g, or t
  misc_feature (388)..(388): n is a, c, g, or t
  misc_feature (391)..(391): n is a, c, g, or t
  misc_feature (394)..(394): n is a, c, g, or t
  misc_feature (396)..(396): n is a, c, g, or t
  misc_feature (408)..(408): n is a, c, g, or t
  misc_feature (411)..(411): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (485)..(485): n is a, c, g, or t
  misc_feature (522)..(522): n is a, c, g, or t
  misc_feature (527)..(527): n is a, c, g, or t
  misc_feature (566)..(566): n is a, c, g, or t
  misc_feature (603)..(603): n is a, c, g, or t
  misc_feature (607)..(607): n is a, c, g, or t
  misc_feature (649)..(649): n is a, c, g, or t
tcatagctgtgggtcacccagttctagccaaccaggaataaattatagttttgcnacctcagcagatggcaaaaggagcnttccagaactttggcctggtctgcaccaggtaccaanatnaaagcngcaaaaannaccagaagggattttggaaccgnggtacnagggngcnttcattcgaggggatgnccagggntcaccccaaagaggnttcantaangcntctnctccggggtgcgggngaaccaagagtataggagcttcttgcggtagtacaactgcnaggcatgcacttgcactgccaaaaccaaaaacaggaacatgaaggaaacggcananaaaccaaagaggaaacggtaggccttgccatggcggtagagctgctgtncanagncnaacatctccatnctnccataaatgagtggagcgatggaaaagagttccatgctgatcatggagagcaccaggtanctaatnttnttncngggaaaggagagaaggcccaagagagagggcaaaatnctcancaaatacgggtattcccactgatagggcatggccacctnatcatgttacaagagcctcaggtgttccacgctcatnttancaaccagcagcagccatattaccagatgtacgtagatcagcntcttgatttcatacttgagggtga

SEQ ID NO: 585547 - DNA, 126 bp, Homo sapiens
tgctgctcaggtctagaatgtaatatggaccagatttgaaaataaacactttcttttcaagtaaagaagaaaatctaaattaaaaaaaagcaatccttttaaaagtacaaagacctgagcaagcca

SEQ ID NO: 585548 - DNA, 340 bp, Homo sapiens
gtgtagcagtgaatgtcagagtatatgctcgactttattaagtctcaataaattcggcagggtgtggtggcttacgccgataatcctagcactttgggaagccaaggcgggtggatcacgaggtcaggagatcgagaccatcctggctaacacagtgaaaccccgtctctactaaaaatacaaaaaaattagccgggtgtgtggtggcagttgcctgtagtctcagctactcgggaggctgaggcaggagaatggcgtgaacctaggaggcggagttagcagtgagccgagatcgcaccattgcactccagcctgggaaaaattgcaaaacggtctctaa

SEQ ID NO: 585549 - DNA, 537 bp, Homo sapiens
cggcacatgatcaccacgcctggctaatttttgtatttttaagtagagactgggtttcaccgatgttggccatgctggtcttgaacttctggcctcaagtgatctgcccacctcagccttccaagagtgctggagattacagtcctagaaccactgcatttgcggccgtacagcaattgtttgcgtttgtggggcagttcagaagtctgacataaagaattagcttgacgactttgatgttcattcgtttttatcttccatttttcttgtccttccttgctttaagaaatatccttggacttattttcatgcccgtcgattttatttacttcgtttagtgcattctagataccaagaacctcgttcctctatcctatgcttgcgagattgagtcacagcttgtggtttaccttatttccccaagtccatgctccgttgatgtgatgatatagcgctccctcagctttcccctctttccccagtgctcatttatgacccgtctgtgtgttcatttccccttccccataactggcatca

SEQ ID NO: 585550 - DNA, 149 bp, Homo sapiens
tttttttttgaagatatttccctttctactgttggcatcaaatggctagaaatctccacttgcaaattccgcaaaaagagtgtttcaaatctgctctgtctaaagggacgttccactctgtgagttgaatgcacacaacacaaagaatt

SEQ ID NO: 585551 - DNA, 329 bp, Homo sapiens
tccactagtgtaggcatgagggatgcataacattgtaaatatactgcatgctatactttcaaatggataatttcatatgaatttcaattgtaaaacgattaaagcacagcagaacatacaacataaaaagtctaaccaaaagtaaaaaatcaaaccaaaacccacaaacaccatggcagcccaaaaagccttgtattccagagctgaacgtgccaggaatctccttttaaacccagataatcccagtaaggaaagaaacctaagggaaggactgctagcgcccatgcactgagcagaatcacctgctccccagtggacacactccttcc

SEQ ID NO: 585552 - DNA, 165 bp, Homo sapiens
gtcggtcccgtgttcgtctgatgtctgctcgaggctctacttcagcttcctgctcagtgtgtggctttttgctttgagacatagtctcactctgtcgcccaggctggagcgcagtgttgcaatctctgtctcactgcaacctctgcctcccggcttccacttcca

SEQ ID NO: 585553 - DNA, 108 bp, Homo sapiens
gttctctccttttttttgttttcaaccgtaaaagcaaaaatgaacgatgataatctttactggtggaaaggatggagaaataaatcatcaaatgcacccagtttgtga

SEQ ID NO: 585554 - DNA, 210 bp, Homo sapiens
atctatacaatataatgttaggtagccaattaaaaatcaagttttaggctgggcatggtggctcacctgtaatcccagtactttgggaggctgaggtaagaggatcgcttgggcctgagaggtcaaggctgcagtgagctgtgatcatgccattggactccagcctcggtgacagagtgagaccctgtctcaaaaaagtaaaataataaa

SEQ ID NO: 585555 - DNA, 287 bp, Homo sapiens
  misc_feature (204)..(204): n is a, c, g, or t
  misc_feature (275)..(275): n is a, c, g, or t
ggggaggccccggggttgggaaagcttgtgccttcttgggccgaagccaaagccccctttgtccttccctggccctgatgccgaacaggagatgcccagcttgtggggggtgggccttccctccttaggtccttttttatattagtgattttaaaggggacttttcagggacttgtgtactggttatgggggtgccaaaggcantaggcttggggtggggaggtcccgtgttccatataaaggaaccccaaataataaaaggccccacatctgtntgtgaaaaaaaa

SEQ ID NO: 585556 - DNA, 185 bp, Homo sapiens
  misc_feature (8)..(8): n is a, c, g, or t
  misc_feature (75)..(75): n is a, c, g, or t
tcacaaantcatgtcttttgcctcttttgttacccaggttctgtataccaacgcgcgagaaccttggtggaaatnggcccaccaagtgtattttctctaataatcgggttgggacttaactttaaggtgttttcaatgtgattttagtatttccagtaataaataaaatttatacaaagtttcag

SEQ ID NO: 585557 - DNA, 141 bp, Homo sapiens
tgagtctagaggatcccagacctccattcttacattagcacgtctcttgcgatagagtccattcttgcatagactggcattcttgcgatgccggcgacggccgggtatgggcccgactgctccagcgccatccattggcag

SEQ ID NO: 585558 - DNA, 232 bp, Homo sapiens
  misc_feature (1)..(1): n is a, c, g, or t
  misc_feature (13)..(13): n is a, c, g, or t
  misc_feature (18)..(18): n is a, c, g, or t
  misc_feature (24)..(25): n is a, c, g, or t
  misc_feature (27)..(28): n is a, c, g, or t
  misc_feature (40)..(40): n is a, c, g, or t
  misc_feature (93)..(93): n is a, c, g, or t
  misc_feature (137)..(137): n is a, c, g, or t
  misc_feature (155)..(155): n is a, c, g, or t
  misc_feature (168)..(168): n is a, c, g, or t
  misc_feature (170)..(170): n is a, c, g, or t
  misc_feature (178)..(179): n is a, c, g, or t
  misc_feature (181)..(181): n is a, c, g, or t
  misc_feature (188)..(188): n is a, c, g, or t
  misc_feature (193)..(193): n is a, c, g, or t
  misc_feature (221)..(221): n is a, c, g, or t
  misc_feature (223)..(223): n is a, c, g, or t
  misc_feature (229)..(229): n is a, c, g, or t
ntctggagcctanttagnaccttnntnnttagtaatccgnctcccacacagacttcagtgagagtaacatcgtcagaacccccaaaccctgcntcactctagcaaatcagaaaaaagggaaccactgagaaaaagantgctggaaaaacgctggngacgcccttaaanangagggganncnttatagnttaangactcaagatgatggtgaagatgaaaanancacttngga

SEQ ID NO: 585559 - DNA, 129 bp, Homo sapiens
ctagaggattcctttttgccacgattggaggcagatggtcggcatggagactgaagacggctgcgctgaccctaaaagttgctggccaactgattccctggttcttattttatctttttggactaatcg

SEQ ID NO: 585560 - DNA, 138 bp, Homo sapiens
agttcgacggagactctcctctgattagcgatatgctcccccagtggactccatgtaccagtctgtgtgcttgatatcagaggagaggaatgaatgtgtcattgccacggcaggtataatggcagtgagccatacctg

SEQ ID NO: 585561 - DNA, 131 bp, Homo sapiens
accctacgcacaaaccccctctcacccacaaaccccctcccaaagtgctttgattataggtgtgaaccaccatatctggcacccattatctcttgaactgcatcttcagtttcttcctctgggtaccgagc

SEQ ID NO: 585562 - DNA, 626 bp, Homo sapiens
gttgaatgcatagcttagaaaggtcacacgtggaaaattccacgaggatcatgctcagtatctcatcaactcattgcatgattccagttgcattagacacctggcgtgacaagacctgacatcgtaccctagatctgggtctgcagggaggctttgtagccatgctgcacggccctaactagagttctagagtttgtgaatatgattctaagtactccttttatacgcttgctatacaaaatccgctacagggtagtcgatcttagaatgtatgaagaatgatatgcaccagctgtcaagacctaagactgatgtcagccagctgatccggacttgctgtgcacgactatggcagatgctgatgccagtagtctgtgactgatgctgcacgtgtgactaagcagcattatctgcatatgcaatcagcacatacaggcctgtgtgagactgatcagtgtttgcccgttgacccatcagctgcttcccatagttaccactttgaatccaacactctttcaccatcttgcatacgcaacgggatcaggatacttggacgtaactggaagtagagatcgatccaacacgcccacgtaacaagctgtctgatgcattttgggcacgtattt

SEQ ID NO: 585563 - DNA, 208 bp, Homo sapiens
ggtatctagagatccccaaggtaaggagtttgtacttaatgaacacaaaaagatatgatgctattagtcatcacgcgttaaaaatggttttctaaattattcaagaagagcatataggtatgtatatggaaatttccctcaactctatttctagaatggctatgtacaaatccagcaaaacggaacagaacagggtaagaaagcacat

SEQ ID NO: 585564 - DNA, 778 bp, Homo sapiens
gacccacgcgtccgatcaagtagtgaatgtgatctactttgcagagctatagatagaaacagctggaaaactaaaggaaaaatacaagtgtttgcggggcatacattttttttctggggtgtgcatctgttgcaaatgctcaagacttaattattgtgcgcttgttgaaatcactgtaaatgcccccatccggttcctcttcttcccaggtgtgccaaggaattaatcttggtttcactacaattacaattcactcctttccgaatcatggtcattgcataagtgcctttaacgcaaagcaatatggtcactgtaatgggtaattctcttaagaaaccctgcagcattagataagagaatgacgtgattatggataacgttagtaggaagagccttagaagcgctccgcagtgagagtagggagattattgttctctatcttgcccttgtactcttataggagcaatagttaaattagcgagtattagttatgagtttggttgcagggttctatatcgttgtgggctgatttccaaaaaccacatgctgctgaatttaccagggatcctcatacctcacaagtgctaaaccacttactaccaggccttttgctgtgtccactggagagcttgaggctcacactcaaagatcagaggacctacagagcagggctctaagggctgaggaccatggcttacctttgcctgctttgataccatcacaacggcatttacttccttcttgccctgctgccccgttgtcgataaacggaaaaaag

SEQ ID NO: 585565 - DNA, 139 bp, Homo sapiens
tagaggatcccccttgtcagtacactttagatgtatctaattctcctgactgtcttcccagtggagtgtggaggtcttggccgtgtgcccgtgtcctaccaataactgtagaataaaaacataacccactgacaacggc

SEQ ID NO: 585566 - DNA, 206 bp, Homo sapiens
gactattgaacacagctgcggagggggttctgcggcgtgggctcctgtggtatagctccctgggtgtggggtcttgcggcagcagtgccggaaatgttaggcactccaactcaagtcccaagccccaggcatctttcctgccctgccttgcttgcgccatccagtccaggcgcctggagcaagtgctcaataggccgcatccaaag

SEQ ID NO: 585567 - DNA, 198 bp, Homo sapiens
ctcttccggacctcaggatccaaccgcctgggcctcccaaagggcggggattataggcgtgagccaccgtgccggtgtcgatttaagttttcaacggactggataatctaggtggtacatgcacatactttctaatacagaatatgactagggctattagggcactatagtctggcagaagtgaggaagagacccgca

SEQ ID NO: 585568 - DNA, 117 bp, Homo sapiens
ttattgagctgtacctgcttcttctcatcccggtcactgtcaccctcattacttggaggagcctggcagaggctgttgctgtcaaactcctctgccacatcttcctcctcttcacct

SEQ ID NO: 585569 - DNA, 695 bp, Homo sapiens
  misc_feature (373)..(373): n is a, c, g, or t
  misc_feature (432)..(432): n is a, c, g, or t
  misc_feature (560)..(561): n is a, c, g, or t
ggaattgcacgagctttttttctttattagtcctgctagcagtgtatcaattttgttgatcctttcataaaaccagctcctggattcattaattttttgaagcgtttttttgttgctatttccttcagttctgctctgattttagttatttcttgccttctgctagcttttgaatgtgtttgctcttgcttttctagttcttttaattgtgatgttagggtgtcaattttggatctttcctgctttcccttgtgggcatttaatgctataaatttccctgtacacactgctttgaatgtgtcccagagattccggtatgttgtgtctttgttctcgttggtttcaaagaacatctttatttctgccttcattntattatgtacccagtagtcattcaggagcaggttgttcagtttccatgtagttgagcangtttgagtgagtttcttaatgcccgagtctagtttgattgcactgtggtctgagagaccagttaatttctggtcctttacaattgctgaagagggcttactttcaagtatgtggtcatttttgaatanngtgtgtgtggtgttgaatgtatatctggtgaatggtgttgagagtctgttagatgctattaggtccacttgtgcaaggttaagttaaattcctgggattcttgtgaaccttctggctttgaccggctgttgcag

SEQ ID NO: 585570 - DNA, 561 bp, Homo sapiens
  misc_feature (397)..(397): n is a, c, g, or t
ggaaggagtggcctgtactagaggcaactcctgcacgagccctatccaattatgcgataaagagaccaatcctgctaggagagctggggtacgctagagtaccagcgaaacccttcacactttgcgaacatacagtatacacactgttcattctggaccaagcacttggacagcaagtgcctgcgcatgactttatccacataccgagttgtgtagaggctctggaagactcactcagtccagtggaggtggacataggacatgcgcgtaaactgatgtggtcagctttagatggatacttcatacaacagatagaagcattctgcagcattctggattcaggacaacgtgtctactcgatgagttagcagcactgatcggccagctgatgattagnaagagtaagcttagatacacatagtagggcacacacgtagttgagtgttacatcgaacctcattaacagttctactatgcttcagatgactcttccgtctgtacctgtcccatgacgaatatacgttatccacggccaggttaccccctttagaacactgctgg

SEQ ID NO: 585571 - DNA, 336 bp, Homo sapiens
tgcaggatcctgtgtgacttctgctctcggggcctggcctgaccgagacctgggcggctcccactccatgaggtatttctacacctccgtgtcccgtgccggcggcgggagccccgtttcatctcagtgggctacgtggacgacacccagttcgtgaggttcgacagcgacgccgcgagtccgagagaggagccgctgggcccccgtgggataagagcaggaggggcccggagtattgggaccggaaacacacaggatctacaagggcccagggcacaagacttgaccgaagagagcgctgcggaaacccttgcgcggggtacataaaaaccaaga

SEQ ID NO: 585572 - DNA, 156 bp, Homo sapiens
tcaaggtcagttgaatggtcatcgccgacagagcttggcacggctggattgctccggcggcacgtcggcatgaggtcaacgccccgagggtgctgaattgcagcgagcgaatgatcccgctgccaaataacaccagtattacaagccagtaaggtg

SEQ ID NO: 585573 - DNA, 231 bp, Homo sapiens
aggtagactgcattcagaacatactatgcacaaatatctgtacatgtctcccatcatgaaagattcattggcagtgccacaggggattgtcctccttcagtcctgtaaaggtcgaactagtaaaaaccaaattatggggctgctgttgtcacactagcatagagaatgtgttgaaatttaactgtgtaagcttgtatgtggttgtagatcttttttttccttacagaacga

SEQ ID NO: 585574 - DNA, 158 bp, Homo sapiens
  misc_feature (134)..(134): n is a, c, g, or t
ttggtctcctgctctctgtgacatgcatcatgagagcactgtttctcattcccagaaaccctcctcccctgtgctgaatgtcaaaaaaatggtctgaagaagttttttatgttttatatgaatgtgtgtgatcnctctagatgtctgaccttgcatgt

SEQ ID NO: 585575 - DNA, 318 bp, Homo sapiens
ccctatccgtatctcaagatcaaggtacaggtcgagtccagagattaactcagaactcctagtagcacattatgatggaacactttcctacttaggcagttactcttccatgctatatacggtggcctcttctgcaagaggaatctcttggaaaacaggggcacacagaaatttgatgtgtggccaaatgggatgaaaaagatgaggctctaaggaaatgggggcatgaagaccctctcccttcttggtagaattaagataactttgattttatagctttagagctaacgtaacttttgtaaagattaagggatagag

SEQ ID NO: 585576 - DNA, 416 bp, Homo sapiens
  misc_feature (30)..(30): n is a, c, g, or t
  misc_feature (79)..(79): n is a, c, g, or t
  misc_feature (83)..(83): n is a, c, g, or t
  misc_feature (91)..(91): n is a, c, g, or t
  misc_feature (104)..(104): n is a, c, g, or t
  misc_feature (115)..(115): n is a, c, g, or t
  misc_feature (135)..(135): n is a, c, g, or t
  misc_feature (141)..(141): n is a, c, g, or t
  misc_feature (160)..(160): n is a, c, g, or t
  misc_feature (167)..(167): n is a, c, g, or t
  misc_feature (170)..(170): n is a, c, g, or t
  misc_feature (178)..(178): n is a, c, g, or t
  misc_feature (182)..(182): n is a, c, g, or t
  misc_feature (196)..(196): n is a, c, g, or t
  misc_feature (274)..(274): n is a, c, g, or t
  misc_feature (278)..(278): n is a, c, g, or t
  misc_feature (282)..(282): n is a, c, g, or t
  misc_feature (316)..(316): n is a, c, g, or t
  misc_feature (323)..(323): n is a, c, g, or t
  misc_feature (328)..(328): n is a, c, g, or t
  misc_feature (338)..(338): n is a, c, g, or t
  misc_feature (407)..(407): n is a, c, g, or t
ggagatgggaaggggggatcctaatggagntgacccctagagtggggagatccaggccagcagaacgggtggttatagntacntcttgggntagaaggtttgtngttcatagttngattagtgtgtccttagganataggnccagccctagagattagcngggtggnganggtaagtntctngacaggggttagtntccaccctcgaggcatggaaccattcaggggaagcctgggatgtgtggcacaggttgactcaggctgatataaaattnttanaatnagtaataaaaaaattataaaatctgttgcttgtntgaatanatttntgcaacagtnttgcttttgttaaaatcctggagccgttaagtcctgaatattattatgggaataattgttggaatgaanaaaagcaac

SEQ ID NO: 585577 - DNA, 125 bp, Homo sapiens
ttttttccctttgcccccaaaagggggggcccaagggacgagttttttttatttgggaggagcagggtgagggtgggggccccaggtttccccctccccttcccaaataaaaatgggggttttta

SEQ ID NO: 585578 - DNA, 402 bp, Homo sapiens
  misc_feature (1)..(1): n is a, c, g, or t
  misc_feature (77)..(77): n is a, c, g, or t
  misc_feature (82)..(82): n is a, c, g, or t
  misc_feature (84)..(86): n is a, c, g, or t
  misc_feature (95)..(95): n is a, c, g, or t
  misc_feature (98)..(98): n is a, c, g, or t
  misc_feature (102)..(102): n is a, c, g, or t
  misc_feature (150)..(150): n is a, c, g, or t
  misc_feature (192)..(192): n is a, c, g, or t
  misc_feature (194)..(194): n is a, c, g, or t
  misc_feature (201)..(201): n is a, c, g, or t
  misc_feature (235)..(235): n is a, c, g, or t
  misc_feature (250)..(250): n is a, c, g, or t
  misc_feature (256)..(256): n is a, c, g, or t
  misc_feature (271)..(271): n is a, c, g, or t
  misc_feature (306)..(306): n is a, c, g, or t
  misc_feature (313)..(313): n is a, c, g, or t
nactcgccccctttctgcattaaaaggcttcattcctctttaacccaacagatcttgccattttctccaagctgtanatacnannnggggggggntgnaggnctgcaggaaatattttatgttctgctaattttactctttcagaaaganttgcgacagtatcacccctcttcacgggaacagcttcttgcnanataatcngtccagcatccacatcttcagctacaaagtgtanagtgcacccagtaantgtgantccggtttccagggnttgctcatgggcatttgagcccttaaaagaagggngcaaggntgggtggatattgagcatttttccattccacttttggacaaaggggccagaaagaattctcatgaatcctgcaagacagactatgtcta

SEQ ID NO: 585579 - DNA, 102 bp, Homo sapiens
  misc_feature (6)..(6): n is a, c, g, or t
cagagntcctggacgagccataccctggaccccagcagccttcatatccccttccctcagcccccacagcagtcttactatccacagcagttgatatgtctg

SEQ ID NO: 585580 - DNA, 553 bp, Homo sapiens
cagagttagagttcgtactggtcaaagagctcagtatagaacttcttgaagaaatccttcttggagctctgcatcacattatgacacagcgcgcctcatcgtcctgcaacgggcgggtggcgtggcccactatctgaagcacgtcatagctggggcctgccagataggcgtgggtctagcgaatgtagtactgggtctccatgtagtgattagcaggtgagcagacacgttgatgccccagcagagagtccgagaagtccaccaccaagctggatagcccctgagctgaagagctgctccagcaggcgtcgttccatggggctgagcccctcatgcaggtagcccaacccatttagcagcgtatccttgagcgtgctgtcacttagcttctccaggtacggaatcagatccttctcggtgcagtgcaagaacctctgccgttggatgtctgctgcacaggtggtgaggatgtcaatggcagtgaggcgggtctgcttgcgagacggcacaaagacaatgacaggcttcttgggcgagtgcttggtgatagcat

SEQ ID NO: 585581 - DNA, 458 bp, Homo sapiens
  misc_feature (449)..(449): n is a, c, g, or t
tagaggatcccctggcgaggctctctacctccccctaaatataaaaatattgtatgggttggttatttttatttttagccctttctcctacgcttattatcctccacccggtacagtagggttgtctggtacaggactcaaacggggaaggcagattttcttcaaccactttacacccacttcttagttgagacagatggccagagtcctatgtaatctaacagattcggggggtgtcaagggatgtggcttctttatactgtgctaaggaagccctggtgtggtgtgtctgtgatgtgtgtctgggatgacagcagcaataataccatctattttctaggcagaagagaggcaaagagaggcgcagcgggtctcattggacagccaggaggagtggaaccagatgcagagccgggaggatgagggggccatcacggagcaggatcggnaacttatga

SEQ ID NO: 585582 - DNA, 604 bp, Homo sapiens
gcgaaaggaaagaaggccagggaaagaaggtggctccggccccagcgtgtcgtgaagaagcaggaggctaacacagtggtgaatcccctgtgtgagaaaaggcctaagaattttggcagtgggagaggacatcctagcccaatagagagaccttcaccgcgcttgtgataagtgggacgccgctatagtcgatggttgctagcgggagagagcacatcctctataagcgggctgaaagtgctctctctgcagattaacctacgttcatcccaggcgcctggaccgccaaacagctactcagctgcttaagctgtgcccgacacagtaccgaccaggagacagaggacaagagaacgaagcagagactggtaggcccgggccgacgaagaaggcgggctggcgaaggggacgtcccaatggacggagacccaccatggtccctatctgacgcgaggtagctgtaaacagcgcgttgcactcgacctgtggctggagaaccaggaaatgctctagcgtggtggtgtatcgcgacacgacgtggatcccatcgaggctggttgtcctgcttgcctggccctgtgtcgtacacctgggggtcccttac

SEQ ID NO: 585583 - DNA, 167 bp, Homo sapiens
ctaggtagactaacccagctagaccaacatggtgaaaccccatctgtactaaacataaaaaattacctggcatggtggtgtacgcctgtaatcccagtgacttgggaggctgatgcaggagaatcgcttgaacccggaacaattcactacacgttatgtctacctgg

SEQ ID NO: 585584 - DNA, 385 bp, Homo sapiens
  misc_feature (21)..(21): n is a, c, g, or t
  misc_feature (105)..(105): n is a, c, g, or t
  misc_feature (249)..(249): n is a, c, g, or t
tgtttccctgccacattagtnccctttaatggcagggaaggcccatctggttaacctgtattcacaaactctcaagagtttcctacttatttcaggagcttaagnatttagataactcagccgggcgtggtgactcatgcctataatcccagcactttgggaggctgaggcgggtagatcgctagaggcaaggagttcaaaaccagcctgggcaacatggtgaaaccctgtctctactaaaaatacagnaaattatccaggcgtggtggccggcatctgtaattccagctactcagaaggctgaggcataagaattgcttgaacctgggaggtggaggttgcagtgagccaagattgcaccactgcactccagcctgggtgacag

SEQ ID NO: 585585 - DNA, 106 bp, Homo sapiens
tgttatcgaggctctgtacatgtacgtggtcgcaaggtacgcgtatcgatggcgcagtggaaggcggcgcaatatgatccaaggcctataaatattcgggagtata

SEQ ID NO: 585586 - DNA, 699 bp, Homo sapiens
gcgactgtctccgccgagcccccggggccaggtgtcccgggcgcgccacgatgcggccgcggctgtggctcctcctggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctttccctgaactgggacctttagtggtggccatttagccaccatctttgcaggttgctttgccctggtagggcagtaacattgggtcctgggtctttcatggggtgatgctgggctggctccctcttggtcttcccaggctggggctgaccttcctcgcagagaggccaggtgcaggttgggaatgaggcttgctgagaggggctgtccagttcccagaaggcatatcagtctctgagggcttcctttggggccgggaacttgcgggtttgaggataggagttcacttcatcttctcagctcccatttctactcttaagtttctcagctcccatttctactctcccatggcttcatgcttctttcattttctgtttgttttatacaaatgtcttagttgtacaaataaagtcccaggttaaagataaaaaaaccggaattc

SEQ ID NO: 585587 - DNA, 326 bp, Homo sapiens
accctgaccatgatctgtgttacgtgaacggatccgcaaggggctacagctctatacatctgcacccactgagccttatttgtcttatcagaactatggtgagctcttcatccaacacagattcatctggttagtggatgacaccaacgtctacaacgtgcactattcacaagcacctttgaagggaacttgacaccaaagcccaatcaacgggagccatcttcatctacaaacccacgcacaggtacagatgttcctcaagataatccacacgtccagtgtgtgagcgggcaagacccgtatggagctgaagacaaaggtgcatt

SEQ ID NO: 585588 - DNA, 816 bp, Homo sapiens
  misc_feature (420)..(420): n is a, c, g, or t
  misc_feature (447)..(447): n is a, c, g, or t
tggaggcccccgccccggccccccccgtgggccaatggcccacacccgcccaggatggaccacagcggcctttttccccaccccacctcccttatccccaaccccatgggagggaataattggcgcaaacacgagggggagggggaagaaatagggacgccccgagacaggttccccaggcgccccgcgcttgtttgttctcttgaagaagataacactctctgtataaaagaggaaatatatggtgttgggaatatatttgttcatattccaccacattgtataatatttctggggacaaaaaaatgttttagaggtcccacacccctctttatgaagaggatactccggggataggacaccccaaccccagacctcttcgcggagacgcttgttttctgtgtccccaacatcttctgngaccattttacatttggtgtggtgtgngacacccaatgagggccaagatataaaatactctctaagaggaggataaaaaaacccttgggttataaaaaagacccaaagatggacccaccaggaaacacccagtctttattcttcggagccaattcccagagcaacactttttttgttggtaaggtacacttagacctggtacctataagatagagttgggttgttgatgagaatgggtataaaaggcccaagattaaagggttcctttttttttccctttttgtttaatgaaattgcctggtttaatttttttggcccgttttgaagtaatgtggtgaaaccaaggttgtcccaccataaaccgggattttaattttgctgaggtggtttttacca

SEQ ID NO: 585589 - DNA, 101 bp, Homo sapiens
ctggggtaagaagaagtgaggctcacggatggggcaggctgagagggcaggtagtggtaggtatcctggggctcgcgtgctgaagaatctggtcctgaaaa

SEQ ID NO: 585590 - DNA, 503 bp, Homo sapiens
acgcttttaatcaagcacatgcacgaaactaatggctctaaattatcattcattactcactttgcggtgggttacagtgccttcatatcaaaatgtcagaattcgaaacgaatgagcatatgcatgaattagtacaagagttacaccgtatgaataatggcagacatatttgagccgaggcctgaccaactttacttaccggagctggtatgcttatgggatattgggtgtatggcaagatttgttgataggtcagagaagacctagtccacggtatgtgcatgatcaaaattgaggcgtacgatatagtggttccgctgaccaaggggatatggttattcaaacacgtttgatccagctttgcgaggacggcgccagaaaaacaatcccttccgtagctgcctgaatatggttgttctttaaagcatcaacagattccagggtagagctcttgcagatttgtgcctggaataacactagctacctgcgggcaagctctactt

SEQ ID NO: 585591 - DNA, 377 bp, Homo sapiens
  misc_feature (176)..(176): n is a, c, g, or t
tgcgggtgatcagaggatccccgtcgaggaccaacaagaatgagtgtttgatggtcataggattagattttcacacagtcaattatagtagcatttttgatctttcatctgagataatttttatcctggctaaataacatactttaacattttctttaagctaaagtctggtggtnggtatcagaattttccagttcggctaaaaatgtcttgatttcactctcatacttgaagaatatggtagtagggtatagaactccaggtagacaactatttactttctagatattaaagatgtcgttccattgccttctgctggctaactgtttcttctaagaagtcagctaactaactactggttataattataccgtcct

SEQ ID NO: 585592 - DNA, 560 bp, Homo sapiens
cactgatcaccggagacagagatacgggacctggtcaccaggacgagaacagacgaacagagaggacatccgagaaatcagcatcaatatactcagtcccagagagcagcattataataaagaggagaaggaaaagcaacaagaacgaatagacacgaaaacaaaacagaaggatcaaatgacacccacgaacacgagagaaaaaacaaaacgagaagaaaaaaagaacacgagacaacagaacaaacaaacacacagaacacctacaacaacagaaacatagacaagaagcacacagaagacaagacagacaacaaaaaacacgatgaaacacaacaaaaccacaccacgaaaagaacaagccccaagagacacgaaaaaaagagagggaccagaatgagagacggcaacccgaaacaagaaggaaacacacaaaacagaaggacgcaccggagacaacacagaaagcaaagcacagcaaaagaaaacaaacaagaccaggacagaaccacaggaccgaagacaaaaacaaacagcagaaacaaccacaacaaagaaga

SEQ ID NO: 585593 - DNA, 276 bp, Homo sapiens
  misc_feature (79)..(79): n is a, c, g, or t
  misc_feature (93)..(93): n is a, c, g, or t
  misc_feature (98)..(98): n is a, c, g, or t
  misc_feature (100)..(101): n is a, c, g, or t
  misc_feature (103)..(103): n is a, c, g, or t
  misc_feature (113)..(113): n is a, c, g, or t
  misc_feature (164)..(164): n is a, c, g, or t
  misc_feature (186)..(186): n is a, c, g, or t
  misc_feature (195)..(195): n is a, c, g, or t
aagcaggaatgaaagtggggctttttccgccccaggggtccaggacaatgtttgaggccagatggaggggatgaggggncttcaactcacttnatccntnntnccataaacanacaaagcaactacacctggatttttcaaacaacttttatttcctcagagtnttccttaatcctatggaacaanaagctgccnctgaatagggcccagtatagggggttggttttttactccctccccccaatataaaaaaatagacttttttttgtggtccca

SEQ ID NO: 585594 - DNA, 356 bp, Homo sapiens
tatcagctacaagctttcctgccattggcctgtggttgcagcctgtcttcctttgaaatggtctgactctctgagttatatatgctggaatccaatgcggagttggttgggactgtgatcaagacacctttcattaataaagaagagacacaggtgtagatatgtatatacaaaaagatgtacggtctggccaaaccaccttcccgagccttgatgcgtacaaaaaggggagaagtcaagagcgttgtcactcttccagaacatggttgctgtggaaaagctatctgtaatgaaagtttcggaagtagattggaaccctatggttctagatcagacaacacaaaagacatgaagat

SEQ ID NO: 585595 - DNA, 176 bp, Homo sapiens
gatatagaggatacccgcggaatacctactactagctataagtagcgctccgggtactacctacaggcggggacgcagagtcctagcagcctatacagtagcctaccatagccccctagacggcctagctagcctaggcagacaacggaagccactagctaggtagtatagcacta

SEQ ID NO: 585596 - DNA, 365 bp, Homo sapiens
cgacatttgagcccccatccaatctcagacatcaaagtgggaaatttacatgctctgaaagactgaactaagataaatgaaaatctctccagatatgtgttttaaaattccttcgagactacattgagtttggatcatgaaaacagagttcaatttgttcttttgatttttcccagtttcgcatttttttttaatatcctttcaccacttctcagcgcagaaggctctgcatgtatctgtggcctggtctcaactctcaagccttcatctcctcatcctcttagtcctgcctgatgcctgggctgagtcccaactctcaatagatggccagtgtgtgtgtgtttcccacaggatgccgtcgacgc

SEQ ID NO: 585597 - DNA, 153 bp, Homo sapiens
  misc_feature (7)..(7): n is a, c, g, or t
gatcgantgcagagggtgctctgggaggtgccttcccgccgccccctcccccgtatcgaggaatcatttccccctgacgcctctagtaggaggagatcttcccttccccgccgcctcctccggtcggaggcgggagggcctgagagcccccat

SEQ ID NO: 585598 - DNA, 148 bp, Homo sapiens
acgactcgggcgactccggagaacaacagctgcgttcccctctatcacctgagtaacttgaggactgaaagttctcataagctgaatggtagtcgggaagcccatgggagcccaggtggaaggccatgaccggagggacgctgccctg

SEQ ID NO: 585599 - DNA, 179 bp, Homo sapiens
ggtcgacatcctacttatctggtcacccgaagtctgggcattttgccttttgtagggggctccttgctggacaatatctccagacgttctagacggctgaatatcctggtctattcgcttgccttgtaatttcggttgtctacttatgtgcacagacgtgccttgctctagccgtcatc

SEQ ID NO: 585600 - DNA, 114 bp, Homo sapiens
gctgcgcgggctgactactgtgccagcagacctccactggcccgaacatgaagatcaaggtcttcaattcgccgcagaaggacttggtgaaggatttcaagtcggccatcgact

SEQ ID NO: 585601 - DNA, 159 bp, Homo sapiens
acttaacggagttagtggtctgtactctattgtctggtcttcacattccaaggggtctggagacttgcaggaacaggaacagcaccttagccaagagggttccaggcctcctgcctagtgctgggtctcctcgttaggtcccaggaataaattgagttc

SEQ ID NO: 585602 - DNA, 248 bp, Homo sapiens
cgtcgaccggcatttggagcagcgtaagcatgtaggtgagatcgcttggttcaagtttgaggggcttaagttacggcttgcggacaacactttctacacacctgacttcgtgctgatgttgtccgacggcgtcatggaagcgcatgaggtcaaagggttctggatggacgatgcacgcgcaaagatcaagatcgcggcagatatgtatccattccgatttattgccgtgaaggctcaaacgtcgacgc

SEQ ID NO: 585603 - DNA, 374 bp, Homo sapiens
attaataattatagaggatgcaccggcacggtgactcaggcctgtaatccctgcactttggggagccgaggcgaggcaggtggatcaccgaggtcaggagttcaagactcagccaggccaacatggtgaaaccgcgtctctactaaaaatacaaaaaattagccaggcgaggtggtggatgcctgtaatcccagctacttgggaggctgaagcaggaatacaggattgacaggaagattaattttaaagtcagacagaattctactcctgccacttactaattagctgtgcaatcctggtcaagcgaacacttgtgttttcttctgacaaatactgccttaaagggtttttgtgtccattaaatgggatcaatt

SEQ ID NO: 585604 - DNA, 378 bp, Homo sapiens
tcctgctggacgacgaggccagccctgcgcgactgctggcttatgtcacagggccagaggacatggacgcacgcgccatccgccaaggcctgcgtgcagacctgcccgagttcatgctgctcgccagcgtgaccatgctgagtgccctgccactgacccccaacggcaaactcaaccgggcccgtttgccggccgtgcacggtgcgccacgccatgacgccggcgcgccccaaggcccgatggagaccgcattggcagcgatctgggccgatctgttgcacacaccgcacgttcgccgccacgacaacttcttcgacctgggcggacactccttcctggtggtgcagatgatggaccgcctgcgcgcgatgcagctgg

SEQ ID NO: 585605 - DNA, 261 bp, Homo sapiens
aagcaagccaccgaggggatgctggcttccagatgcgagtgggttgttcctggggccccgttggccaggctgtggtaagctggggcccgatgggggatttgggtgttgggaagatactggatgtggtggtttctcccccgccttggatttgcgcacgccactcttttttaggcagggcgagggggataggggttacagcgtcgtttggcacccccttttaaaaacgcatctttcgtttataaggccctgaaaaaacaaaaa

SEQ ID NO: 585606 - DNA, 1528 bp, Homo sapiens
  misc_feature (310)..(310): n is a, c, g, or t
  misc_feature (518)..(518): n is a, c, g, or t
  misc_feature (521)..(521): n is a, c, g, or t
  misc_feature (584)..(584): n is a, c, g, or t
  misc_feature (1044)..(1044): n is a, c, g, or t
ggagagagagaactagtctcgagttttgttttcttgtttttttggagacggggttctagctgtcaccgcagggcgtggaggtgcaggggtgtgtgtgacgtgaaagctcacgtgctaacgctgtccggccttccgtgggactcaagggtgatccgtaccttgtagtcctccccgagaatagttgtgagaacgatacgagggtggtgcagccaccagaagcccgaggcgtaatctgtgtgtgtggtattctgtgtgtggcgataaagagagcagagaggttctgcacctatgtgtgtgtgctcacatgggngcgtggtctcctcaagagcactcgcgtggagatctcacacgtgtgatctcacggcacacagcactgtgtggggcccttccacaaaagtgtgctgggagaattatagcagggagacgtgtgagagccgcacccccagcggcccggtgggcggctctctatctgtctcgcacagggtgtctatagacacgccgtctctctgtacacaggnagnggacaccgctctgtgagaaggggccctgtgtgtctgtggccacaagtgtgagaggagaggggncttctccgggggtggaggtgtgtctcaatagagggggggagacatctctgtgtggggggacatgtgtgacacctctcagcggtgtggggggggagcccaaactctctctcttctctgtggtgagagagatagtgacgcccctgtgggttacaaaggccgggggcgacagaggcgagagacacacagcggtctcctctctatctcccgagtggaggggtgtgtgattacacagatggttgtgttaccacagtggggggttaaccaccagggggggcggtcacacctcttgagagaagaccccagggggcgtgtggggggcgccctgagggcgaggggacgatttaaagagccactctctcacacaaaggcgccccccatttaggagagaatgggtacccctgcagaacaaatgcctcccaaagggggtctccccccccggggtgtgggctcttccaacaancccctggggaggggggaggactgtggtggggccacacacatctgtgcacagcggagcagacaccccccatggggatatctccccagcgggggaatataccctgagaggaattctgcgccccccgcgggggtgcaacacacgccggggctaagagtgcgcgcgggacaaccaccaaaacacaaagacacatcccagggaggggccaacacgggggggccccattagcagaccagactgcaataaaccccccgctgatcggatgggcgcgcgcaacacaacaaacatcgggtgctccccccaaggaaggccttcctacccggttcgcccaaaaaagggcccaccacatggcacaactgcgggtgggagacactccatcacccacagatgtggggcgaccgacgcagcaatacccccacaacacagaacttctattatacacccagcagccagacaaacacggatgttactcacgagagatacaccc

SEQ ID NO: 585607 - DNA, 204 bp, Homo sapiens
ctagaggatccctcgcagcagacaacagcataaaagcatttctgtttttcagtggcttcgccagcatctgttgtttcctgactttttaataattgccattctaactggtgtgagatggtatctcattgtgtttttgatttgcctttctctaatcgccagtgatgatgagctttttttctgttgtttgctgcaggggtaccgagc

SEQ ID NO: 585608 - DNA, 286 bp, Homo sapiens
cagtcctacacttgcttgcagaaagctaagatcaaaaaaaaacaaaaggtcagacactatggctgaggcctacaagtccctagcacttttggaggctgaggcaggaggaccgcccgaggtcagtagttcaagaccaccctgggcaacacaggtagaccccatttctacaaaaaataagttagccatgtatagtggtacgcttctgtggtcccagctacttgggaggctgaggcaggaggattgcctgagcccgggtatggtcaaagctgcagcaagttgtcgactg

SEQ ID NO: 585609 - DNA, 158 bp, Homo sapiens
atctagaggacccttgaggcaggacactggagaggcctgcacgaactccatcccccgctggtgctgagcttcctgaccaggtacacccggtgccagtcgttctccacccggatacagaactgcttgacttgctgcaggtagcactgcttctcctggcc

SEQ ID NO: 585610 - DNA, 556 bp, Homo sapiens
  misc_feature (9)..(9): n is a, c, g, or t
  misc_feature (28)..(28): n is a, c, g, or t
  misc_feature (47)..(47): n is a, c, g, or t
  misc_feature (92)..(92): n is a, c, g, or t
  misc_feature (453)..(453): n is a, c, g, or t
  misc_feature (455)..(455): n is a, c, g, or t
  misc_feature (492)..(492): n is a, c, g, or t
  misc_feature (506)..(506): n is a, c, g, or t
  misc_feature (508)..(508): n is a, c, g, or t
tacccaaanggaagaaaaaataccctanggtgtgatatatttagganttatatattacctacctatttgcctgtgaagaaagtcctccctgnctaaagatggctttcagataaattttaatttcccctatgagtcttttgcctattccctataattcatgcctttttgttagaaactaatataggttttgtatgattttttttttcaatgagcaaaaataagttaaataagtaagtaagtgaacaaataaacaggtagtttaaagcaaaggaagggccccaacgtgatgactcacgcctgtaatcccagcactttaggagactgaggcggcagatcgcctgaggtgaggagttcgagaccagcctggccaacatggtgaaaccccgtctctactaaacatgcaagaaattggccgggtgtggtggtggcgcctgagcccagctacttgggagntnagcacaagaatcgcttgaacctgggagcggatgttgnggtgagctgaagantnccattgcacgccacctggggcaacaagagtgaaactccatctcaaaag

SEQ ID NO: 585611 - DNA, 396 bp, Homo sapiens
tcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccacgtttgcatagcagttgaataggttgtgtgggtgggctgttgggagtgaggatggagtgttcagcgcccatctttcctggtccggttacaggtcgtccgtccgacatagtgagtattggtataagaggggggggttccattccaaagcgtgctcaaataatggacatgttgtcccccgtgtggcttaaatagttttttctatcaaattaagtcgaatatatgtttttcac

SEQ ID NO: 585612 - DNA, 992 bp, Homo sapiens
agtttctgtggctcattacaggggcatctgacctcctgccgcccagcatagacacacctcacagactggtcctgcccatgcatgagccctggaacggtgtgagcactcttaaaaccccccacaggccgctccaggtcctccagcttcgtgtcagatggagggctctcgtggcctgagatcgccactggtaggcctacgtggttggaacgagtgctctgggaataaacagctagccctaggctcctcagagggatccctggcaacccaggaggcctcctgacaccagcctaaaatcctgaacaggcagggtctgccctcttgcagtgtggtgcgatgcccctagtcctttaatgggttcgggtgctaaggggctgtgctccaaagcaatgggctggggcagcctgcagctgccaccaactggtcttcacaccagattgcacaggatactgggtcttgtctatcttgatggagaagaggggttcctgcccaggatcttacaacacagcaagtagcatagagctctttccttcctctttttggggaggttggggtcaggcgttgttctttgagatttaagttttcattttgaggggtaatcaccttcaagtaaaacagtaatagcaagagtgaaggtactttggaaaccactaacacctctgcacagggcagtttagccagctcaagttcttcttcagagacaggggacttggccagtggtttaagtaactgccccttcaactctcagacgagcagctgacgaggcagtgggccagtctggagtctgttcaggaaagtgttggagctggtcttgaaccgcagttggccctcaaacatcaggatggttttttgtttcaaagcggacttcttgtgccatggggctggcagactggtcataaccccgcgggcaacgcctcgtagcccccacgggaagatcaacccgcgttttattaagaaacactacggagaacacccgctagcccaagctaagcgac

SEQ ID NO: 585613 - DNA, 275 bp, Homo sapiens
  misc_feature (2)..(2): n is a, c, g, or t
  misc_feature (164)..(164): n is a, c, g, or t
angttgtgcggtgatctagaggatccctggagttgtgataaatgacctagttctctcttttcaaggagttacaccctagtgacagagactaaagaagtactaatatatggaaaaatatggtaatgaaagtgttataagagaaattagaactcagatgaacacangaagtggatgtatatacatctatgcctatgagaccagtaggtgtcacgaaaaacgcttttattgaagaggtaaccttttattctcttaagaatttcaagtggtatccgagc

SEQ ID NO: 585614 - DNA, 473 bp, Homo sapiens
ggtcttgctttatcgaggtggagttttgctctggtggccaaggctgcagtacaatggcgcaacctaagctcaccgcagcctccgactcccaggttcaagcaattctactgcctcagcctaccaagtagctgggactacaggcatgcgccaccaagcccagctaattttgtatttttagtagagacagggtttctccatgttggtcaggctggtctcgaactcctgacctcaggtgatccgcctgcctcgacctcccaaagtgttgggattacaggcgtgagccagcacgcctggccacaaactacttttcaatggcttcagagtattccaatgtatggatataccagaatacacttaaacctttctgtttacaaggggattcagactattttcagtattttaccattatgcacaatgctgtagtaacatttgaacttctaacctctaatttcggattcaagtgaagcaagtga

SEQ ID NO: 585615 - DNA, 405 bp, Homo sapiens
ttttttctctgtctcattgcggtagccatcgattgtactatgcattgatgtagtctctcccggggacgccatcgatagaggttatgatgactcgagagtggtcgtaagcgatgatcattcgcattgcgtttcttgggcttgttcacctccatgtttgacttctccctcgttaactgctgtccagggtcgatatactcatactcctgggagaacttgaggccatcgttggctttgaggcgctcgatgttgtccgccagtgctcgagcatatgagaatccctctacgtggtctcgcatacctggggtctggtagttgagcctccgcatctccacagggtcagaggagtgggccagcaaggagtccttcagtccgatcgactgctcatccttagaggacggagagtgg

SEQ ID NO: 585616 - DNA, 703 bp, Homo sapiens
ccacccgcccagcgccccccacggtgtgagcagatcctggatggatgtgctggggtgctgccggcagaggatccatgtgttcaccatcctggcccctggaagatcccccagttcccttcagtgatgatggacgtgatgctgtgatgggcccctggtgagatgcagctctaccatgcaaatgcctggtgcctactgtggcttgccaaccatgtggcttgcagcagtgctggtgcaactgttgctgagtgcaggaggttgtgatgctccctgcagctgacgcctgtgcgagtgaccctgtgatgctggcgacgcgtgtgccccagcatgaacgcatgtgccagccattacctggcacgcctgatggcttgcctccctcaggctgaccatctcgtgtggccttgcaggctttggggcaccgctgccaccaatggtgggcctggcacccagggctttccctgcggtggtcctgtctgagcccatgactggcattcactggggtccccatgccactgtgggtgtttgacacaaggctgcaccatcctgattgcttgggaggctagctggttcatcctgtcgtctcattcatgccgagttggttggggaccacacccagcttggctccgtcctgctgtgaactgagggccccactggggttctggaagaggataggggaccattattgctagtaaattgttgattctga

SEQ ID NO: 585617 - DNA, 552 bp, Homo sapiens
caagcagatgcagcagatccgcatgtccctatcgcgggaaggctgtgtatgctgatgggcaagaacaccatgatgcgcaaggccatccgcagggcacctggaaaacaacccagactctggagaaactgctgcctcatatcctggtggtgaactgtgggcctttgtgttcaccacaggatgtgacctcactgatgatcatgggcacatgtttgctgtgccaataatggttgccagctgactgcccgtgcttggtgccattagcacccatgtgaagtcacttgtgccatgcccatgaatcacttgtgtctcagggcccagagacagaccctaccttattatccatggctattacggtactcaccagctacaaatctcacaggggcaaccacttgacacatccctgacgtggactgtagcacgcttgactcacatgaccttgtgacgaccacaactgtggtgacgcccagactgacagaccaccagctgactgcacacactgctacacacatcatccccacatatctacctatatggggactgggtcaatccgac

SEQ ID NO: 585618 - DNA, 256 bp, Homo sapiens
accctccctaaggagacctggcaaggagattgagcagaagtacgacatgtggagaagagatcctggtatggagcctccctccctgctttggagctcagctttgttctgtacgcttctcttcctgaggctcagacatctcttgcgctatccctcattgcttctccagtttcacggatgctagtctgccatgcacagagtgaggcagctgtatgcaatcaagggacatggacaaaataactaggctacccaggtaagt

SEQ ID NO: 585619 - DNA, 603 bp, Homo sapiens
  misc_feature (420)..(420): n is a, c, g, or t
  misc_feature (433)..(433): n is a, c, g, or t
  misc_feature (439)..(439): n is a, c, g, or t
  misc_feature (441)..(442): n is a, c, g, or t
  misc_feature (453)..(455): n is a, c, g, or t
  misc_feature (462)..(462): n is a, c, g, or t
  misc_feature (465)..(465): n is a, c, g, or t
  misc_feature (467)..(467): n is a, c, g, or t
cccacgcgtcggcccagcccctctcagagcgctgtctatgtcctgctccatggctattccttgtcactccagctccaatgtggtggtggagcccagtgggcttctagagttgaacaacttcaccagtcagcagctagatgacgacgagacagccatggagcaggacatagacagcagcacggaggacgggactgagcccagcccctctcagagcgctgtagaacggtcctagtgtgcagacgccggagtgcactttagagcctgcgtggttaccaaatgtccaggaaacttaaaatttgttatagtaaaaaagaaaaaaaaaaaaaggaaagaaagaaaaaagagcacttggcccaatattaggcgggggacctaaaagcttttaaacaaaattaaactcacagaggaaggtactttaanaaaagaaaaactnagaaanannaacaaaaaacnnncagaggnaancngaggcaccccatgggagccgggccccttggtggggggaaacgcaggggagaagagagactacccgggggaggggcccaccgacggggttcccatggagccatataccaccatagtatattaacacaaacacaaaag

SEQ ID NO: 585620 - DNA, 650 bp, Homo sapiens
cgggatggaggcggcggccggagtgtggggctggggctgcctatatatccgcgtacccctggaggagacctacaggcagcctactgtaggtactagaggacccgcctagcatagccaggtatctccgggaggctataggactatgggagcctatatgaacgtagccctatgagaaggcggatacagaagggggcaggtattatacgcatacatagtagttagagcccctacacatagcaccctaccaaggtacctagtacgtgggataggagcagctatgctggagacaaggggcataggcctacagcggtaggcgccgggagcctaggaaacctaggccggcgtacaggcacatacatacctaggtacctactacaggaaaggggggcgtagggaaaagcaccatactaccacggagctaggccctaggcactagcgccatagcaggcaagaaggtagggaatactaggatagtaggacctagtagtaggcccccagtaataccccgcatagctacggggcgcagggcagggctagtagcaccagttgcgaccgaggctagggcaacccgtactatcctaggacctgggagcagagcatattagctcatgtattgtgggctatcctgctggagaagccgggagaggccg

SEQ ID NO: 585621 - DNA, 642 bp, Homo sapiens
ggcaggaagggccccctgtccagtggacacatgacccatgtgaccttacctattattggagatggttcacattccttaccctgcccctttgtcttatatccaataaatatcagtgcagcctggcatttggggccactactggtctccgcgtcttggtggtagtggtcccccaggcccaggtgtcttttctttgaaaaaaaaaaaaaaaaaaaaaaaaaaaaaaaaaaaaaaaaaaaaaaaaaaaaaagggggggggccaaaaaattcccccggggggcccaatagacccgacagtttttgttggtcgaaccaagaggggcggcccccccaatagaggagagcggcgcgtatatgaagacggcagagagcacacacggggccgcgcggagttttacaaccacacacacgctggcggagacgagggggaaaaaacagcgcgcgctctaaccagcgagggaagacaccaccttgctggggggaaggaagagaacccccctataatacgcgcgggggggggggcgacaccaatatggtggggcacaaaaacctccccatccagagagagattttggagacaggccccccaggggggacaatattatataaacatttacgagcgagggtgttacaggggggggtgac

SEQ ID NO: 585622 - DNA, 110 bp, Homo sapiens
gggggtttttttttgggggggcccccccttgccccgcccccccggtaaaaaaaaattaaatgggtttttttttttgggcccaaattacccccccggggggtttcccccca

SEQ ID NO: 585623 - DNA, 984 bp, Homo sapiens
  misc_feature (6)..(6): n is a, c, g, or t
  misc_feature (71)..(71): n is a, c, g, or t
  misc_feature (76)..(76): n is a, c, g, or t
  misc_feature (79)..(79): n is a, c, g, or t
  misc_feature (116)..(116): n is a, c, g, or t
  misc_feature (123)..(123): n is a, c, g, or t
  misc_feature (131)..(131): n is a, c, g, or t
  misc_feature (136)..(136): n is a, c, g, or t
  misc_feature (168)..(168): n is a, c, g, or t
  misc_feature (172)..(172): n is a, c, g, or t
  misc_feature (179)..(180): n is a, c, g, or t
gccctnccccccccccggccccgcctcctcgttctcctgtctcgtggctgcttctgcctgtgctgtggggnggggnggncgccgcccggcctctgctgccctttctgtgccccccnggttctntctccccntcacncccgtggcctggcttcaggtgggtgcggagcngccnttctccnnggccccgtggttgcccctggacgtgtgcgtctgctgctccggggtggtgctggggtgtgggatgcacggcctcgtgggggccgggccgtcctccagccccgctgctccctggccagcccccttgtcgctgtcggtccctgtctaaccatgatgccttaacattgtggagtgtaccgtggtggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgttgagagccgtttcctgtgcctcccccgccccatccccggtttttgtgttgtgtttgccaggctcaggcaaaggggcctgtccctgctttttttttgaccgggaaataaatgcccctgaagg

SEQ ID NO: 585624 - DNA, 1190 bp, Homo sapiens
ggagagagagagagagaactagtcctgagtttttttctttgtttttttacaagaccctcttcaatggatggactacatactgaaatgctccgaaaccccattaacaaacactgccagtcatccagggcgggcgggtttcgaacctccaagagcttgatcgttagggtcttgtaaagcgtggaaaattgagatggcgcgtgcgtctagaacgcaagatatggtgagcgacaggttgacccgaaaaatgagagctgtggacaagtccgagtggagcatgcctgtgggtggtaccaacaaatgagtggagagcgccggaacaatgtcgccgctcgagaagttgggggcgagaagggacagactccgagaggtgattccgagagggcgttcatcatgagtagggcaaaatctcacagtaagccccgaggtaaacatgttgttgcataacagacttgcggtcgttggaacttttgcattggggtaatcaccgcctgggtgtctcctgtattaaaccatattgagggggggcctggcccaagcttgggcctggaatgcaccgcctggaaggacgaagtaaaccaagcggggagtgggggctcacacggaacgggggccacctctcgcaaggggcaaaactaatgaccgggggggaaaggaaagcccgtgaagagcgggagcgccccaaggagaccccactccacacaaataggggcgagggagcacaggcggacatacggcccggagacgagtgatcacaacaagagcgggcaccgagaaaaagaaacacccccgaacgataaaagaacaaaacacagaacaacacgagaagaggtaatacacaaaacgaaagacctaaaccacgagacaacacgagaaaaacgcacccaagtcagcaacaccgcagaggatagatgacgcgaaggacccatgggctaatacatagcccaccccgcaaggaaaaccaacacgcgcacacaaccaacaaggacaaatcgagggaacacaacgaggagaaggaaaagcaacagcgcaccaaaaatgaacaggcccaccacaccgacaaaggtagaactcaacaaaccacaaaagcggataatggctcacgagcgcccaaaccgaggcaacagcacgaacgaaaagaaccctcgcggaaaagccggccacaccgaccacagcaaacgcgaaccaaaaag

SEQ ID NO: 585625 - DNA, 1025 bp, Homo sapiens
  misc_feature (6)..(6): n is a, c, g, or t
  misc_feature (71)..(71): n is a, c, g, or t
  misc_feature (76)..(76): n is a, c, g, or t
  misc_feature (79)..(79): n is a, c, g, or t
  misc_feature (116)..(116): n is a, c, g, or t
  misc_feature (123)..(123): n is a, c, g, or t
  misc_feature (131)..(131): n is a, c, g, or t
  misc_feature (136)..(136): n is a, c, g, or t
  misc_feature (168)..(168): n is a, c, g, or t
  misc_feature (172)..(172): n is a, c, g, or t
  misc_feature (179)..(180): n is a, c, g, or t
  misc_feature (996)..(996): n is a, c, g, or t
  misc_feature (999)..(1002): n is a, c, g, or t
  misc_feature (1004)..(1004): n is a, c, g, or t
  misc_feature (1008)..(1008): n is a, c, g, or t
gccctnccccccccccggccccgcctcctcgttctcctgtctcgtggctgcttctgcctgtgctgtggggnggggnggncgccgcccggcctctgctgccctttctgtgccccccnggttctntctccccntcacncccgtggcctggcttcaggtgggtgcggagcngccnttctccnnggccccgtggttgcccctggacgtgtgcgtctgctgctccggggtggtgctggggtgtgggatgcacggcctcgtgggggccgggccgtcctccagccccgctgctccctggccagcccccttgtcgctgtcggtccctgtctaaccatgatgccttaacattgtggagtgtaccgtggtggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgttgagagccgtttcctgtgcctcccccgccccatccccggtttttgtgttgtgtttgccaggctcaggcaaaggggcctgtccctgctttttttttgaccgggaaataaatgcccctgaagggaaaaaaaaaanaannnncnaccnatactagttctggtctc

SEQ ID NO: 585626 - DNA, 464 bp, Homo sapiens
  misc_feature (14)..(14): n is a, c, g, or t
  misc_feature (50)..(50): n is a, c, g, or t
  misc_feature (57)..(57): n is a, c, g, or t
  misc_feature (264)..(264): n is a, c, g, or t
  misc_feature (464)..(464): n is a, c, g, or t
ttgcccccggcctnctgctgctggtgaccagtgtaaccccggactcccanccccggntttccctgactcagaaagactgagcttttcccccggatgttattaatagcctaattgtgtcccaagcaacccaagggcccttgagtcctgccttggttcctgccttatggcctcacatcaagaaatggagcctagtcccatgtctgtagtcccaatgctttgggaagcccatgatgggaaggttgtcggaggccaaaagttcaaganccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctctn

SEQ ID NO: 585627 - DNA, 790 bp, Homo sapiens
  misc_feature (23)..(23): n is a, c, g, or t
  misc_feature (26)..(26): n is a, c, g, or t
  misc_feature (49)..(49): n is a, c, g, or t
gtgcctacttattcgcttgaccntanttgaacaccgctttggttctttnataaaacagtgtacggcgatccggatgctctgggcggcgctcagccgtgtcctgcagccctgtgctgtcggtccctgtctaaccatgatgccttaacattgtggagtgtaccgtggtggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgttgagagccgtttcctgtgcctcccccgccccatccccggtttttgtgttgtgtttgccaggctcaggcaaaggggcctgtccctgctttttttttgaccgggaaataaatgcccctgaagg

SEQ ID NO: 585628 - DNA, 228 bp, Homo sapiens
tggggggtgaagcgttgttcagatttctatgtccagggccatcaacctaacccagaaactctgcacaacagtgatcgcagcagaaatcatgtacgactggtcacaatcccaagaggaattacaagagtactgcaaacatcatgaaatcacctatgtggcccttgtctcggataaagaaggaagccatgtcaaggttaagtctttcgagaaggaagtgcagtaaacaag

SEQ ID NO: 585629 - DNA, 1103 bp, Homo sapiens
  misc_feature (1103)..(1103): n is a, c, g, or t
ctgggcggctgagcacgcggtggcggcggtctctgagcgcctctgctctctctcccgtgtttcagatccgcatttgctaccagcggctggccgcggtggagccatggccggtcctcagcgcccagcaccgccgctccctggcaacccgtgaggcgcgcaccggaaggccggtcgtgccggaagctcgcgcattcccagccaatcacttctttccaccttgctccttaggagacgggcaaagattgagttgagttcggaggctcgaaagttccaagccaggccctttggccctccaagtgcaagggaaaaaggggactgggcacttgaaaaggcgggtgcgccggtgtgcaagggtccgggccgccaaggccaaggcccttccctgaagaggtatggcccacaggcggaaaggtttgccccaaacagccttaagagaaggaaccctttcgtgtgcaccagaaccccaatactggggcagacgccagcaacaccgttggtgtgtgtcttggcccaaggaccccccgggtaaaaaacacccaacccaacaaatctccaggggcacggtgcacacacaagtgtgtgggcaggcccccccaaaaaaaatctcttgggtagacaggcggcgtgacacaaagggagcggggccacttctccgaccaaggaagagttcccttcgaagagaggagacgcggaggcatgttgacccccaattgcctgttgcccgactgtgctcccatccagcgtgggagggagcagcagggctttcccttttcttgtggggacctgttggaccagggtttttggttccctcgttcccccaaacagtgggcccgccgtaggcgctttttccccacagatgcgccagatgcatttcaagccacgtcggtcttttttggggcgggacccccccacgtattttttccatcgtgttgggccgctccacccacgcactagtttataggatgagaccacagcctccgtttagagatgcacacctcaaggggcggagaaggagcggacggatctcccacatgaggcaggttgacgtctccccgccgacgcaagatagttaatgatactcctcagcgagagaggagcatccn

SEQ ID NO: 585630 - DNA, 237 bp, Homo sapiens
  misc_feature (70)..(70): n is a, c, g, or t
aatggagtattgagattgcattcccgtccccaatacttatcttctgtgagctcacagaaactcagggggncccttagctcctatgactggaaccattggaaaggtgtttgtccaagctggagacgaagtggaagcgggaggttccctcatggttattatcggcctgaagatggagcataccataaagtctcccaaggatggcacagtaaagaaagtgttctacagggaagttgctag

SEQ ID NO: 585631 - DNA, 231 bp, Homo sapiens
  misc_feature (13)..(13): n is a, c, g, or t
  misc_feature (53)..(53): n is a, c, g, or t
  misc_feature (161)..(161): n is a, c, g, or t
  misc_feature (182)..(182): n is a, c, g, or t
  misc_feature (195)..(195): n is a, c, g, or t
  misc_feature (210)..(210): n is a, c, g, or t
ctcattctgtganttcggctccccggccaaccgcaagatcggcgtgtgcaccnccaaagatggtgctccctgcatcttcggtggtacggtgtacgcagcggagagtccttccagagcagctgcaagtaccacctgcacgtgccctggacggggcggtgggntgcatgcccctgtgcagcatngacgttcgtctgnccagccctgactgcnccttcccgaggagggtcaagc

SEQ ID NO: 585632 - DNA, 336 bp, Homo sapiens
cgtttctccagccacagtgaagacccgacttgcatatgggagtcttctttccaatatgctcaaatccctttgccttgaagtatttggtaatgtcatgtgtgcctctcaaagtagccaaaggcccttgctccatcagtgaaacccacttcttgaccaagaaggggcccacggggccctccggtaataccattaagtttgtctcctactgggttccagctccagtggtcaggacacacgctttctgcgcggccctgtgctccttccagtgctgcatctggtcgctggcgggatcgcgtctgtcagccatagcgtgcggttttctgtgcagcactgtgc

SEQ ID NO: 585633 - DNA, 1065 bp, Homo sapiens
tgcggtggctcacgcctgtaatcccagcactttgggaggctgaggtgggcagatcacctgaggttaggagttagagaccagcctggccaacatggtgaaaccccatctctactaaaaatacaaaatttagccaggcgtggttggcgcaccatcttgtatgtcccagctactcggagagcgctgaagcaccgagaatgggcttgaaccccgggaaggcgagaggttgcatgttggcgccttgggagttgagcggaaacttagggacttccgaggtactggggcaaacggaacagcgagaaggcactggtccttctaggactaatatgcctgggtggacagtgcatttccggtaacaagggatcttcctcaggcacctattgacaggtcacagagagaaaggacagagtttcctcggacgggcccgcggtggaatccttcacaagagattcgctggaaaaaccctattgggttgggagcgaccagtcttgcaccttgcttgttgtagataccatggacaacactatctcacggtcaaggttgggataagtagagagcaccttggcgagaacgcacgtatacgtccaggggagctctcaacacttaacacaaagcggcgccggtagaagtcccgggtactgcaatggactctcgcaactacccagtaagtatggtcgccaggacatacgtagtgtgtgcagaacgataaaggggaggatccagtggacgtcagatggaatactataattgacggccgccagccgttggcgaagatgacaattcggatcgtcaacgtatactaggggcctacagagcacgcgtgcagaaacgcccagccatcggtccgcccgcgggacccggggcaactaggacgaggctcacgcctatatgacacgcaatcttccaggccacaccagacgtccaccagcttgttgatcagcatccaccgccgccgtctacgaaggcgtccaccacaacaggccgcatacacacgtggcagagacgggcgcagtgagggtcaccacactagagaagataccagaggggccacttcgcgcagagagtacc

SEQ ID NO: 585634 - DNA, 1488 bp, Homo sapiens
tggacaagacaaacgagttttaatttattcaaaagtaaattcccaggtgtaaaaagaggccacaagtaaaggtggttaaaaaaaaaataaacacactcgtgctacacccaaggtgcggcattaaagtgaaacacccacctaagaacaagaaaaaagaagacacagtgaaaacacacccacgtggaaacaccagcccacccggaagcctcagttccgtggcacacagaacccacctctcctctctttcaacgaaaactccagcgtggaaatcaccatgtggaagaagccagagtctccacgtggtgggtgtgaaagcaagaagaaccgtgggaggtgtgcgtgtctcaagaagttcttcaaccaaagaccttcatgtgtggccacaagtgtcacccgaacctctcaaaggagggcaccttatcataagatgtacaaaaaccagactctctgtgtgtagcgtgggagaattctccacagcagcaaaaagaagacctctgtgggatattgtggggctcattctccgtgaaagttgtgcgccacctctcacaccccaacacagattttttatatacgaagggggatatatattgcgcgcttattcacacgcgtgggatagtgatttaatctaccagggaatagccatatataggggctctgtgtggtcctatataatgtcgagaggcaacaagcgagagacaaagataacatatcttgccacctctctatataacacacgcacactactcagagggccctcacagagaaactgtggggagaacaaagggggagaacccggtgggagaacggccccacaatctcagggaggatggtgcccaccaaggtggtacccccccacaacgcggaggccactatgtggcacgcgtcgcagccatctactaaaagacaacagccgtgggaacaaataagatggcggccgtaggaggcgttgaacaaccggcgcggtcccaacacacccttgctggacagccgcgccccctggtcataaacacacccaccgcggtggggctcactccattttagtagggcccccccacaacagcgcgagggcgccacgaaggggggctgactgtggcagcgtgactgccggaggtgcaccaatggtgggggtagggccactccacaacagaatctacccaacagccagatcccgccgctagtagaaagaaaaaaacgccgcccaccaactatcgccacaggagagataacagccgcgcgcgagagatccccccttgtggagacacagtaggggtgcccccaccgcgggtgatgacgagggaaccactcgaggtgcgccacaacccgcgggagcgtgtcaacaattacacagacggcccctcaagagagagaagccaccacgacggactcagtaggctaacacgacggcgggcccacttgtagtccgacacaagcagtggggacagacagtagtgttcgtccctagcgtagtgactgccccccccgggaagc

SEQ ID NO: 585635 - DNA, 263 bp, Homo sapiens
gacagagcgctgaatgcatggagtgtgcattacatttggaacaaaaatgtgaactcagatcactactggaagctgcacaaacatgaccactgacgaaaaatgacccccaatttgtgatgacttcaattgagacacattaccatgaatgagcaggtgaaagccatcaaagaattgggtgaccacgtgaccaacttgcgcaagatgggagcgcccgaatctggctatggcggaatatctctttgacaatttctcatccttggaag

SEQ ID NO: 585636 - DNA, 174 bp, Homo sapiens
acgatcgagtcggtaccctatttctcgatcgttactcttgtgttaacaataagtagaagtgggatcaaaaggtctgatataaacagctaggacgttctgacttcttttggcgtcttttttatagacggagtctcgctctgtcacccaggctggagtgcagtggcatgatctcgg

SEQ ID NO: 585637 - DNA, 176 bp, Homo sapiens
tcgtaggagttttacaaaaataagccgggtgtggtgcgggtgcacagaaatcccagtactttgggaggccgaggcgggtggatcacctgaggttgagagtacgagaccagcctgaccaacatagtgaaaccctgtctctactacaaatacaaaaattactgggcatggtggtgcag

SEQ ID NO: 585638 - DNA, 120 bp, Homo sapiens
ggtcggtactactctcgtgcctgggggaaacaggaatagcttcaagggtctccctggttggaaatagtcacacatgctccctcgactgtcttgtcccagaaccttttcactccaaaacag

SEQ ID NO: 585639 - DNA, 325 bp, Homo sapiens
tcacattcacaggtgccaggggttagggctttaactcatcttttaggggtacataactgaacctacattagcttccaccactgctcataaatagattgaggctggatgctcactctgtgatcccagcactttgggaggccacaaggtggtggttggattgcttcagcccagaagtttaagaccagcctgggcaacatggtgaaaccctgcctctacaaaaagaaaaaataaattagctgggtgtggtgccacatgcctgtagtcccagctactccagaggctgggaggtgcgagggttgcttgagcctatgttgtcaaggctgca

SEQ ID NO: 585640 - DNA, 1124 bp, Homo sapiens
caaggggtcattttacaattgtcttcgtgaaaatttgttcctcaaatgagcgaggtgcttcttatgcccaatctctgctgcaatgtgactctcgcatacctcggccaaagttttctgcctcatttattggtaccatggaatttctactaaccgagtgtactacactgtgcggcgatctgatagtagccctacttctcttggtctcacattttggtgggccctcttaatggaagccttgctacacatggtaatcttcactatttcttgtggcgatactgggagccatgcgaaatacgatctccatttcctctaccctaccactcttactattgtgttcctgtgtaccctatggtcgtcgaaaatctctttcttgccaacaagtttcccccacattcgactagcaaggatcctacattcttccaattacaggttgtctgttgcgactcgctggtaatgaacgatccttgcccatttctcagcaatgaatgcggtgaacacatctcttgtgcacgacatggctacacgtcggctgccattctggccctgttgttgtagagctcatcgttcgccccatgaggctctattagccctcttttatcctgcacaacgattcgggtcgaggaatagcaccgttctcttgactatcttacgcggcgcttgattgaagtggaacttctgacgcatgcctcgatcgattcattgttttcaagacctgttccatcacggtgtcgctaaggcaggaatctgacttacggcatgaatacatgcatatcgtacagaaggatgatcttagtacgctgtttgtctagcctagaacgcaacactccctttggcatagtcttgggtgcaagctgacacacgtgatgatcgcacctcattagacgcatttaacgcaaattaccttgatagctgttgacctgccttgttgtagtacaaccccgttacaagggcacacatccagcatctcgtgtcttgcctttcagatcttaacagaagcaagcagggcttaacattgttgattttaggagcctcttagtgacctaggttgcgtcctgtgttcagggaacttaaactttctggttcagtagtgtgtattaaacataacactggaataccttactgga

SEQ ID NO: 585641 - DNA, 971 bp, Homo sapiens
tgggggtggaatgcgtgtgtcatgtaggtaaaaaaagtgcacagaacagtgagggtgcagggagcaaggacgtccgtggccgggcctccgatttcgttttgaaatgtgcaaggaccctcccccagataaggggggctcccatcaaggggtgggaaatagagtgtggaggctcttcacgggaagaccatggtcgtttgatgcaactccacttgggtggcccgagttggcgtataaggctcgtggctgggaccgttttctggagacttgaacacctctgaaggaacctccataagataactcttaagagtggcgtggtgtcttctcctcagtgtggtgatgggggacctccccggattctgaaagagaacaaaggctctcgaggagtaacgaggaagggaaccccggtcgtattttccctctggtgaggatgtgggcctcgcgggggcctttctctgtcgtgtgttgacttcacctgtgcggcaatgactctagaatacgtgtgtgcttgtgttacccgcccgtgatatacaatgcttctccctcgcagaacatcccacggtgggactattgacgcaatgctactggggcgtttatgcgccgtgggcaccagcacagcctaccccacgtgaagacaaggggaacccccccattagtggcgagagacaccgtcggcgacagccaacggcgcacaacaaacagtgctgcgcactgtgatcaacacatcgcgcggcgccccacagaggaaagtcggaacaaaaggccggcgagaaaaaacacaccaaggggggagccaccgacacaaagacagcaacaagagtgagcacgcggcaccacaccccacgagggcacacgagccacaacaacgtgcattgcggacgcaccaaacaagccagcacaacgcccccgccaactcagaagcacacccgctttgacgcacaggcgtgtcggtatcaactatcggaacaaacaca

SEQ ID NO: 585642 - DNA, 1108 bp, Homo sapiens
gctttgtggggggggaccgacgacggtgttttcttacaccccacaacaatatgaggaggcggccgcaccatcaactattgggggggaaggatggtcccacatctcgtggtgaggatatgacgcttccccggctacgcgcgtagagtggtttgttgttcatctactcctacggcttctatcactgtcgctaatgcgcggcgacactatttatgacgccgcgggggcgccgcgcgctgttgggcgccccacctgcgagagaagaagaagaggggtgggggacgatagaagaagaagagaggggggacaacaagaagtgtggtgtgtggccacgcggggcgtgggtcgcgcgacacaaccacaagagtgccgccacaccatgtggagagggacgccactacagtgcgccccacatgggggcggcacaacatagtgggcgcgacgacgagttctcacaagaggcgcgcccccacgcagacatgtgggagaagagatagaatatttccctcttcttggtgtgtatgagcactgtattcacacggcgttgttcccccacacccacacagtggtttttcacccccccctcgtatagagagtctcggggcacacagcgtgggggtggtagacagcactctctcgtggtgtgctctcacaacgagagagatctggggggggcacacacacacacacagggcccccccgcgctatggcgcgcacacctcggggttttgggaaaaaggcgcacacacggagaacacacctcgggggggctcgtgcgcggggtacacacacgctcgtcggcgctaacgcggctttttattgcacaactctcccccgtgtgggagaaaaagagggcccatagcgcacagacgtggggcggctctaggatggactgtgtgcgttgtaggcacgcacggaggtatagtagagatgggagaatgcacctgcgtcccatctcacccacccacggtggagagtgggtaacccccgcctggaggccggaagaccatgtccactggggccaccccagcccacggcctgggggcaacctttccccagccttccccgggcccaaaattttttcattataaaaaagttttgggactttata

SEQ ID NO: 585643 - DNA, 498 bp, Homo sapiens
  misc_feature (12)..(12): n is a, c, g, or t
  misc_feature (26)..(26): n is a, c, g, or t
  misc_feature (392)..(392): n is a, c, g, or t
cctaggattganaaatactaaaagtnaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaatttttttcactgtactttctntatcatgtaaaaactacacttaggatatgagaaaattttaaattatatgcatcacatcagaagaacatattattggcaaataataaaattatcaactgttttcaaa

SEQ ID NO: 585644 - DNA, 266 bp, Homo sapiens
aatgttcacggcagctttattggctgactttccatttataaattggaaatacccgaaatctcgggcaacaggtaaataaataaactgtggtttatccatgcaatacaaaatgtgtattattgatgtccacaaaatgggggaatgccaaaataatgatgctgagaaaaagcacctgctgccacagtacttgctctgcgatgccacttagataacattcttaaatctgtacattaacctttagtgagagggagcagaccactggtcgc

SEQ ID NO: 585645 - DNA, 255 bp, Homo sapiens
cgcacgcttaccgttgtcgcgtgcgctgtctgctcggagtgctgccgggaaggcgtctgtctctcgctcaaatgtagggctcagtgctctgctctgtagtcctcccttggcgccaccgcgggaccctctagcgtcgagcggtgtgcactgctggcttggccctgggctgtcggtctctacacaatggatgctcagtgacaaacgcctggcgcctctgcagcctggccacacacccttcgcgtatgactccactcc

SEQ ID NO: 585646 - DNA, 670 bp, Homo sapiens
  misc_feature (139)..(140): n is a, c, g, or t
  misc_feature (157)..(158): n is a, c, g, or t
ggggagctggttatccaacagaagcttctggtgcccaaagaacttatgtgaaactcctgattggccgaagggccacgtgatctcccagatagcacaggaggcaggccatgacctcatggacatcttcctctgcgatgtnnacatccgcctctctgtnnagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctcgttggaacgaacggaaccctgccttagctcagtttccacgagctcggttcttctcgcctcggcacacacagcatacaaaggtgtacgtctaagaacgagtcggccctacttggtggagagacaagtctcagccctagccctccagctgagggtactcgggacctcagagctattcctacccatcgagtcgcatgtctgtgtagccaggagagatttctcttccggccttcacttctatcacagagaacgttggataagaagtcgtgtgctcctgagtgaggtagcgcgtccatagctcacgcaaatcgtgggtctatacactc

SEQ ID NO: 585647 - DNA, 271 bp, Homo sapiens
ggaaatttaaggtgagagcgaacaacagtatttgaaataggaaagaggttgtccacaggtcagggggagacttttgaattaaacccgagaggtgtcaaaggcttgtcggccttggagcctagaggaaactccaaacaatcaacttagggcactaactgcggaaaaacaaggaactttaaatttctcaggatcgccaatatttccatatcgagggccaattttacagagacacacagggagagaaattgagagagctggagaaagaggagca

SEQ ID NO: 585648 - DNA, 678 bp, Homo sapiens
cccacgtcgtccggtcgcgatgtggaatttgctgtctgactgggcttgcgaggaaaccgcctcgcgagctgcagtcgaaggccatggaatcactgaacatcggcgatggaggacagggggttccatacatgggtggctttttctcaagtatattttccagtctgttatggaactcgagacatgagaacttgttaatctttgggattagatggagcaggaacatatagccgacaacttgttgtacagataacaagtgggagaagtcgttactacatatacctaccattggcatgtaatgctagagacggtgacgtacaaagaccgttgaaattccaagtctgggattaaggaggacagacaagtatcaggccatactggagatgtgtatctatctcaatacacagatgcatgtcattgtatgtagtaaggacagctttgtgagccgtagaccgagatttggcattttccaaactcagagttcagttgccatgtgtggaggaagaagagctgagaaaaacgcccatttcatgtggtgtagtgcaaagtaaaccacgggcataggaaccacggtgcactgaacttgcctcagagattgggtaaattacactctgggttacctgcctttgaagggaccgaaaatggcccgatattcaaaaacgtcagcaacaaaggcacccg

SEQ ID NO: 585649 - DNA, 357 bp, Homo sapiens
cacaattaaaaaattgtgtattgagggatactataaagagaaccacagaatgggagaaaaatattggcaaattatgtatctggataagggattaatggccacaatatatgaagaactcctaaaactcagcaacaaactgattcaaaaagtggggaaaggactttaatagacttttctccaaagaggcacaaatgaccaacagacacataaaaagatgctcaacatcacaattactagggaaatgcaaatcaaaaccatagtgagatactacttcacagtaactaggatggctgtcatttaaaagacaaaaacaaaagcagaaaataacgtgtaagctagcaagtggagaaacttaaa

SEQ ID NO: 585650 - DNA, 253 bp, Homo sapiens
tacagcagtgcaagaatggaccaatacacttccccattatctgcaggataaattcagtttcctggttcagggtccaatctgatatgcttcaacttctatttcagatatatcttcctgtgatcagccaaatggatcttgtgatcactgtgtgcctcattgtgacttcacgtccagaagcttgagatattcttcctccacctgtccaccttcttgcattccgcctgtccttagagacacagtcaaaggcaatctt

SEQ ID NO: 585651 - DNA, 798 bp, Homo sapiens
gtattcgtgattctatcatatatacacaattggagaatcctctgtcgtgtagattatgaatacttatatagatgcgtaagattttacaattgctggaatagataataaatccgcaagtattgattttgaaagtgacttaccttttgtcccctactgtgtcaggaaccttatacggcaggagtttcaaggttggtgggtctctataactgctttgcttgctttaccctgaaaggggtctgtctatttcacgggagtatctctaacgtgctttgcagagtgatgcttgccttactgcaggccgcgtgattgtattgctaatgctatttaatcttctgctttgggaatactgcagatctgaagctgtcttatttatgggcaacttctgttgtgatggccctaatgcttactgttggtgtggaacatcaagagaatgcttcttaacccatttgtcaagccccagaaatagttgatattgcactagaccttagcttgtcagctgtgtggagaagtatgcgtttttccagaaccatgtccattcacttcagtgctactcaaaagagctgcgtcccagaaagctctggaggataaacacagggcttccttatctggggatttgctgtaaggctgacagtgaccagctggtgacaagtgtgacgccgggcacagcagtcctgtgaggctggtctggtgtcttgctggttccgtctggtcagaattaaagcagacccccgggaaagttggcctagaatgtagaactttacaatggcaggtcctctttttctcgaggttcacatatac

SEQ ID NO: 585652 - DNA, 916 bp, Homo sapiens
  misc_feature (80)..(80): n is a, c, g, or t
  misc_feature (85)..(85): n is a, c, g, or t
  misc_feature (886)..(886): n is a, c, g, or t
  misc_feature (915)..(915): n is a, c, g, or t
ctatacacaccaatacaccaaccccccaacaaacacaacacacccttaaacaaaaacaaaaaaaaaacctcgggcgtganaacgnaattggcctgggagttgctgcactgcacgcttctcttgtggtaacaaaccccagctgcttctttattccgcaatgcgggttgctgatgtgcatcactacgagaatgtgcggaaagacaagcggctccagtggcaaaagtaaagaactccaagaaggaaaagctgcctacctgaaagatggaccactttttccatagcggagatgagaaccgacgatgaaagacctactacccacgacgatggcagcccagcaaccgcccccaacgaaaccccaccactgacccgacctgacacaccgcctcccaaggacgaagatggggaacaaccctctacctccccaaactctcacaatcccagctccctacccgacaccactccatccaccacaacaccaccacccaaccccccccaacctacccccggggccctgaccaacactctcacaacagcacccggcaatgcccgacccctatcgactcacgcaacaccctagacacttaaaccatttgcgacccgctccccttcgcgaaggtaatcgacacaacaccaccaagaccaaaacccccccgccaacactatacctataccctctgccaactcgcgcacccccacacccaaatccacccaatacgcctcgcgccccacccagccgtcgcaccccaccggcaacccccgcagcacccccgcccacacccacaacccctacacccccacctatcccctctctacccccccaacacacaccctctacatcaaccttcctaatcattaaccctctaataccgactcctagcaactgctnagacgacaccctatatacacaacgacaana

SEQ ID NO: 585653 - DNA, 218 bp, Homo sapiens
cgcttatgacacgcactacagaaatgcacgggagtgactgaaaagagctatgatgtgaactcatccctcagtcatgatgtcagcactgatcatcagtctgccctatgtttcaatggattcttctggaccctggcattagaatatgaaattgacccgagctcaatttgaggggattgtcaaagatctaatcggaaggagtatcgctccatgccagaaag

SEQ ID NO: 585654 - DNA, 1464 bp, Homo sapiens
gcaagaatcttctcatgatgctagtacacagattctgaacctatttcttaaacgacttgcaatcctaccatagtccgagtcgatacacacggaatgtagatgcaggaaatcaactctgtagtaatcccatgttcctaaagtatttatagagcatagactgagagtatgcgagaagcaatacccctagaagcctctctacacttcattgcgataatagcgcgtgtacatatgggagcccatagtgatcatcaaacggatccttaaatgatgtacttacaatgcgccattgacggagagaataaccacacacaagtatctccatgaataaacggtgaaacccattggcgctagtagcactgaccatcatgatgcatctcctggaaactcggctttttccatccattttacatcagacagattgacaacacaaggccaactgtatactatcatctacttgcaaggtagttcacacactagaaagaaagaagcccttttccctatttagggggcgtggttccacaaccaaggatctttcggccctatttggctcttcgaaaaacccggacaacagcaatactcgtaatccagaggaatattcatgcgggcatatgtgtcctttacccaggaaaaaaatctcaaagacaacggtaggccataatttatccaatagtgttttcccccgaggctggttccccccaccaacatgatcattcattaggggcccaacaacaattttagacctacattctcaattggaactcgtagatgcgggatatagaagaccgttaattcacccaaccggttgtaacacctgaatataaagcgaacgaaaaaccaggaaagaagcgggggtaatacccccaaagacgctcctttcaattaatcccaatgtaccccaaaccattccggtcaatatgcgcaattgcctaattcaatggtttcgaagatgaccttaaattacgcaatttcactttcaacgcgcctatcgatgtgcacagacaacctggattcaaaacgactccggagttgccgtgggcggtaacaccacattacacccttaggcttggcccttggaacgcattgtaaccattacccggggagatttccaacgttggtcgaacatgggagtatatagcgaccgtgtaggggttaacaattgtcgcttggactttcatgtatgggcccaaaagactccaagttagtttacgttaataaccagtaaagtttctcacaccacaacgggggtttccccaacggaagaaattcattactttcgagcagggaccggcccccaatacccacaacgcacaacccgctgcgctacctcaagtggaaacacacatatgtctgtatgccacgcacgagcacgttgtgacctcagcgcgcgcgacgaacaaacacgtgtgtgcgacgcacgacaaccctagtcacgtgttggacacaccgccgtatacgccctactat

SEQ ID NO: 585655 - DNA, 398 bp, Homo sapiens
accctaagcgggtttggagctggacctggtccagctgcatgtccagccacttaatgcttcctgggtggccctttgtcaagtttcttaaaccctccttgacgtgcgaggtgctcatgcttgtaagtcccgtcattttgggaggtcgtgactggtagatcccttgcggtcaggagttcgagatcagactggccaacatggttgaaaccccattttgccggaggctccccgtgcaaaaatacaaaaattagctgggcatggtggctcatgcctgtgatctcagctactctggaggctgaggcaggagagtcgcttgaacccagaggtggaggttccagtgagggaaaatcccgccattgcactccagcctgggcaacaagagcaaaaactcccaggcgcta

SEQ ID NO: 585656 - DNA, 377 bp, Homo sapiens
tctagaggatcccgctccaccgatggggtggggtgaagacaggtttcaagatgaagtgccactgacacagaaaatgagtgtaattcatggaaatcaggtttaacaaaaatgtccaacttgaaggttgaggatattgaggaaaacagtaacagttaagaaaaagagtctaggccgaggcgggcggatcatgaggtcagaaggttgagacagcagtgaaaccccatctctactaaaaatacaaaagattagccgggcgtggtggtgggcgcctatagtcccagctattactatacttaggaagctgaggcaggagaattgcttgaacctagaaggggaggttgcagtgagctgagattgtgccaccccgtcgggtggag

SEQ ID NO: 585657 - DNA, 368 bp, Homo sapiens
atcattctctctacaaggttaacccctattgtccatagagatgctgttcctctcttggactaacagtgcaatgtacaacgggatttagagggtcctgtgggcaaattcaaagttgaactaggattctatcttggcacaccagctatcaccaggctcgggtagatttgtcgcctctacctataaatcttcccaccatgttgctacctagacggctgtgctctattagctgttcttaggtagcttcgtctggttacgggggtctttgctttggttctccttgctgtgtttcttctaattaattcatttatgcaaaacgtataggggttcagtcctagctattttatgcttgcatagattgttacaggggt

SEQ ID NO: 585658 - DNA, 140 bp, Homo sapiens
ctttctgtatgaaacgtatctgcacatcaaaccctcacccctgggctatcccctaatttccatgacttcgaggacaacgaagtcccacatatttctataaacacccagctagtactatgtaggagtcgcccttgatcgta

SEQ ID NO: 585659 - DNA, 215 bp, Homo sapiens
gcattttccatcatgtccggaacatcatggacacatatactggaggaatcaggcctgccgtagcccaaggaaaggccggaaacaaagacgacgctcagagacaggaagcaacttgcctgaagatacacagcacaaatgagaaaattggtgcccaatagtttctgaagaccagcaactgctaagacagagacttcgaggtaacctaaccttgcctg

SEQ ID NO: 585660 - DNA, 310 bp, Homo sapiens
aaacatttccccgggcccggaaaccgtggttttttctttggttttttccaaactgggggttttaaaaaaaaaacaaattttattttggtgttttttcaaaaacaggggcccacaagaactgttggccggggcatttttccctttttttttttttaaggggggggggccccccatttaaaacccgtcaattttttccaatgtgggatttcccaatttaaaaagaatattttgaagggttttattttttttttttttttaattaacaattttacataaattccaatttaaataaaagtggtttgccccgtta

SEQ ID NO: 585661 - DNA, 429 bp, Homo sapiens
  misc_feature (342)..(342): n is a, c, g, or t
  misc_feature (416)..(416): n is a, c, g, or t
atcatgccactgcactccagcatggattcttgctctgtcgcccaggctagagtgcagtggcgctatcttggcccactgcaacctccatctttgggggtaaagcgattctcctgcctcagcctcccgagtggctgggactgcaggcgcacactgccgtgcctggctaattttttgtgttttagtagagatggggtttcaccgtgttgcccaggctagtgttgaactcctgagctcagacaatccgcttgcctcggcctcccaaagtgctaggattacaggcatgagccaccgcacccggccccggaatctgcatttcaacaagctcttctgatggttcctctngcatctggggagtcgagaagttcttgctgctatgggcctcttgaagtttgctttcgaaccccaatttcagaatnttcaacccactcc

SEQ ID NO: 585662 - DNA, 126 bp, Homo sapiens
ttccagttcgctttcgaggcaggggcctagtgactccaccagcagcttggatgaagactgctggtggagtcactagggccacatgagatgctcaaagtaggcagagagatcacccttacaagtcat

SEQ ID NO: 585663 - DNA, 960 bp, Homo sapiens
  misc_feature (365)..(365): n is a, c, g, or t
  misc_feature (368)..(368): n is a, c, g, or t
  misc_feature (404)..(404): n is a, c, g, or t
  misc_feature (440)..(440): n is a, c, g, or t
  misc_feature (599)..(599): n is a, c, g, or t
  misc_feature (691)..(692): n is a, c, g, or t
  misc_feature (701)..(702): n is a, c, g, or t
  misc_feature (861)..(863): n is a, c, g, or t
ggtggcttcagctgcgcctggttctgcagtggccacacgtatcagcgcctgcgaggtgcaccacgggggccgagtccccgaggctcagcgtcccatctgtaacttcggaggaaccgatacaacacccagtttcatcatcgggtacagatgtcttagttgagcatcaagggtcaggatagacaccgtttccctccttgttcctcgctgaccgatgaccctggaactccacggtgcctctctgaatctctgttaatggatcccgcacttagtatttgatgggaacccagtgatccaggggccagtctttgacagggtagcagtcacgccctcactagacttacactcctctccaagtgctacctccnacntgaggatgtggttattgatcatctactgtggagtgntgggcttccttgtggtcctcacactcactcactttngggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggcngtctctctagcacagcacagaaattctcaatcactgaaatgagtaactgcaaaataaatagttgattgtactgttctcatgctataaaagtnnacaggtacnntacaacaaatctgttttctcatttttatcaaatatatgtatcatcaaagagttgcatcttgtacaagtatgtaaatgtctattagatgtctgtcacttcacaatgcgacgaacagatcacttagttccccccgaaggaaaggtgctctgggtggccccnnnagcacaccacattgtggacttcatggtgtattacaataatatatatatttgggacatagtaatcctctcacaaaataaaaataaataaaataaaacc

SEQ ID NO: 585664 - DNA, 1107 bp, Homo sapiens
  misc_feature (365)..(365): n is a, c, g, or t
  misc_feature (368)..(368): n is a, c, g, or t
  misc_feature (404)..(404): n is a, c, g, or t
  misc_feature (440)..(440): n is a, c, g, or t
  misc_feature (599)..(599): n is a, c, g, or t
ggtggcttcagctgcgcctggttctgcagtggccacacgtatcagcgcctgcgaggtgcaccacgggggccgagtccccgaggctcagcgtcccatctgtaacttcggaggaaccgatacaacacccagtttcatcatcgggtacagatgtcttagttgagcatcaagggtcaggatagacaccgtttccctccttgttcctcgctgaccgatgaccctggaactccacggtgcctctctgaatctctgttaatggatcccgcacttagtatttgatgggaacccagtgatccaggggccagtctttgacagggtagcagtcacgccctcactagacttacactcctctccaagtgctacctccnacntgaggatgtggttattgatcatctactgtggagtgntgggcttccttgtggtcctcacactcactcactttngggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggcngtctctctagcacagcacagaaattctcaatcactgaaatgagtaactgcaaaataataagtgaatggacccgtcttatggcattaaaaggggcacaggcctttacaacaaatgtggttcttaatttttattaatatatttggttcaattaaaggttggatttggccacgtttgaaaagctttaaatggcggcacttacatgccacaacgagcttgtttcccccagaatgcccctgggggccccaagaaaacttgggattttgtggttacaaaataaaattgggcgggttaaaaaaaaaaaaaaaaacctcggggggccccgtccccatttcccatagggggggcttaaaatactgggccgggtttataaagggggatggggaaaaccggggttcccaatttaagccttttgaaaaaaccccttttcctgtggaaaaagaaaaagcccccccactgggttttaaaattgccccccttagggaaaggggaaattgccggctattttttt

SEQ ID NO: 585665 - DNA, 246 bp, Homo sapiens
ttgtgaagctggtgcagatgctcctgggtcagcaccagccggtgtcgctgtcaaaaccagccgcacaagagaaggtcactttgcccatgtagactgtgtcatcctgctgctcctccttggacctgaggaaggctgatgaatggaaggtggcaaagtcagtgggtactgtgagtccagggcgctgaaatactgtctccttgaggacctcatccttgagcttctcgacggtgtcactcagggacttaa

SEQ ID NO: 585666 - DNA, 862 bp, Homo sapiens
  misc_feature (365)..(365): n is a, c, g, or t
  misc_feature (368)..(368): n is a, c, g, or t
  misc_feature (404)..(404): n is a, c, g, or t
  misc_feature (440)..(440): n is a, c, g, or t
  misc_feature (599)..(599): n is a, c, g, or t
ggtggcttcagctgcgcctggttctgcagtggccacacgtatcagcgcctgcgaggtgcaccacgggggccgagtccccgaggctcagcgtcccatctgtaacttcggaggaaccgatacaacacccagtttcatcatcgggtacagatgtcttagttgagcatcaagggtcaggatagacaccgtttccctccttgttcctcgctgaccgatgaccctggaactccacggtgcctctctgaatctctgttaatggatcccgcacttagtatttgatgggaacccagtgatccaggggccagtctttgacagggtagcagtcacgccctcactagacttacactcctctccaagtgctacctccnacntgaggatgtggttattgatcatctactgtggagtgntgggcttccttgtggtcctcacactcactcactttngggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggcngtctctctagcacagcacagaaattctcaatcactgaaatgagtaactgcaaaataatagtgagcttggatggtaggtcatctggttcatcactcgcgtactaggaagtccggaccatggtagctctagcgaacaaatgctgtgtcttctcgatttttactcaaagtatctgtatcagtcaaaggtgtgcactctgtagcagtatgtaaactgctacgtaatgtcgtcactcacatgcacgacagtccttgttcccccaggta

SEQ ID NO: 585667 - DNA, 167 bp, Homo sapiens
gccggggaccgctctgacgttgtgactgggaagtgcctgtgcgttgccgtcctccgacggtcgacatctcgacgatcttacatggacggcctttgagcaccacaaagccattcttacgtcatgctgagcacgtgattgggaaggtggctgaggcccctgcatctcct

SEQ ID NO: 585668 - DNA, 290 bp, Homo sapiens
gtcgacccaaatcacagtatcagcggtcataattctcataacatgtataaaagtgacacataaaacattgtaaatgataaaatcctgtccttttactgtcagggttatcaaataaagtaacaaatactaactttctctgtgtagggtatccattaataaagagtaataggagggactcagatgggtgtgtgttgagctaatgttatgttcgtttctaggcgttctaagcctctttcccctcgatgagtgaactgttctcttattcagaagccatgggttctcatgtcgac

SEQ ID NO: 585669 - DNA, 455 bp, Homo sapiens
ccccccaccatcttctccggccgccacatcttctcccggccgccacagtcttctcagatcatccgcctgacggcactcgccggttcagcggtcagtcctgctgccaccagcgttatatcttatgtaacattcatggatctcactgcttgtccatgcacaggcccccaggagatgagtgccagagccttccctgcttcacattaggagattagtgtccaggagccttacccgcttcagatgaggaagctggggcagaaggcagttgggcctatcgcagcagcatgtcggtggtccaggctagattcaatcagcctgtgtcttatttgtcacttagctgttctcctgcccacccgaccgtctccaagaacgctgggtgcgccgcgtgtacccctagctgcgcgtctgaagaccgggagggtgaggccatcagatgtgtggatgccacatgctgagac

SEQ ID NO: 585670 - DNA, 505 bp, Homo sapiens
  misc_feature (152)..(152): n is a, c, g, or t
caaagaccgacgtgaccaattcccggggagcgcacatatattcccccagcttttatgctaaaaccaaaatcgctattagttaatccagcactctttttaaacccctgaagactataacccatctaatgggttatgacaaaccgttcactttngatatggaagaagtcgatgaaaagaaactgcatgagggtgaaaaatgaacctgttctttcatttgtgcttaaatgtcatgtattttcagggtataataagattgcctttattttgttattgttagttaatgattgtagaaacaaaacaaaacaaacaaaaaagtgtaagggctgaggacacagcaattggcactgtgtttgctgatgtgaggccctagaattggccttcatagaagcaggatgcttttgtacacttagaatcccagcacatgggacagcgaggtaggaagattagaaatctgaggtcatccttggtaatgtagtaggtttgaggttagcctggaccttgtctt

SEQ ID NO: 585671 - DNA, 1643 bp, Homo sapiens
  misc_feature (267)..(267): n is a, c, g, or t
tgctcccgcatctgccacccccgccaacctgccgcatcgtggcctccgttacgctgcctgcgtcagctttctcgctccttgtgatctgcacatcctcccagatgcagcgcctgtgtgactgacccctgcctgctgctgcatgagcctgtgtcttctgggcctgtagctgtgctccatggtgacccctcctgtgttgcccacccctcgtgtgctgtcatgactgcctgtctctgtgcatgcctgcctgcttgccatcacctgtgtccnctgtgtgtgcagtgctgtgatgtggtgtgatccctgctggtggtgctgccctgtgtgccttctgaccctgaccactgcaaggcctgcccgacctgctttgcattgcctggccctctgtgaccactggtgtgtcctctgactgctgacaagtgtgagctgtgtgcccatgcggacactgacccaccgacttggctttgcgccaccccttacggtagccagacatgacactacagggatacaatgcatcgtgatgccgagaaggaaacagagatacccttgacccgctggaaactaccaattgagcaccggaaggaatgtggcactccgacctactgaatccctggacgcctttccaacatacacctgcccaagttgacaagacgttgcactagaccctgtggccacggaacacatttgaccgcaaacgacattccacggcaccatgtggctgacacctcaaaaagaacactgctgcattgcattgcatgttgacggaaccatttacctttggagaatttattacattaatatcctacaataactggcagaccatgttgaacacacctttggcacataagccaagcctgaaagtgtgttgctgttgacattaacccatttggttcacacgggccgaagagtaaattccccccgaaattggtttacaacgattctacatatggttggggtctgggacacgcgcatctcctgtttgaggacccccagaccagactggtggggcatcatacgcccgaagtccaacgaagacatgctcatttggccatgtgaccatggacacagcacttgtgttttggcgacaaagtgaatatctatctggataatttgtgtggcatcaaggtgaggcatccacaatgagcggcggcaccaacataggcccaaaattgaaggagacaggaggcttggaggcaaaatttgtgttgggcagacacccctcaaaataattgccccacatttggaaatattttgagtacatgcgaattggtcattccgttttgaaagtcctattggagacccaccaattatatagggcttacatgcgtcctatttgggcccattttccatgttagatgcaggtcgaggtaaatttcaatgaacccgataataatatagagggatgacaaaattgttcagacgaagaaaaattcatcaaagccaagaccatcatgtgaaagtgtgagtactctgtacaccgcactcgtggacacagtgggggtgtcacagataacaggagagtgaaagattaacacacaccaccaaccggatatatccttggtgcagtgatgtgtgcaccctgagtggatgataattagtaccaacctggtacctacacgatcgcgtgctaacgagttcgcccaaat

SEQ ID NO: 585672 - DNA, 100 bp, Homo sapiens
ccccaagtgctgaatacctatgtgagtatacatttttccatctttttttcttttggtaaacgaaactcactgagaaatttgacttctgataatgggaaac

SEQ ID NO: 585673 - DNA, 185 bp, Homo sapiens
  misc_feature (81)..(82): n is a, c, g, or t
ggggggggccccgggggcccccccccggggttttttttcccccggcccccggggggggggtttgggggggggggccccccnnctcccccccccctttcccgggggccgggggttcctttttggggcccccctccccccccccccggccccaaaaaaaaaaggggggggtttttttttttttttta

SEQ ID NO: 585674 - DNA, 329 bp, Homo sapiens
tctaaggaccctgctgtctgctctggtgtacgtaggtattgtgagacagagacgcctcatgcagatataacagtgtgggaatagaagaagggaatatgaagagttgaggctgtagtttggaaagtgaactgtgatggtctcaatagcggaaataaaataaaaaggttttaagtagccaaggctcattaaaactctcaggtctacaaaggccttaatcctgcagcaaggatcaaacgaagtgggtggtcttgccccactaactgttgagatgttctcaaggtcagtgtcagtacacagacagacagagacagcagaggcaggacaagcag

SEQ ID NO: 585675 - DNA, 406 bp, Homo sapiens
gccagtatacctttgttattgtcttgtctacttcctgtctcaaaatttttcttctaaaaaggtacctcataaaagtaaattataacatatatgcccttccgtgtctggcttattcactaagcataaagtttttttttatttttctctgagacggagtttcgctcttgtccacccaggctggagtgcaatggcgtggtcttggttcaccgcaacctctgcctcccgggttcgtgcgattctcctgcctcggcctcctgagtggctgggactacgggcatgtgccagtatgtccggctaatttatgtgtttttggtggagataggatttcaccatgttgaccaggatggtctcgatctcctgaccttgttatctgcccacctcggcctcccagggtggtgggattgta

SEQ ID NO: 585676 - DNA, 441 bp, Homo sapiens
  misc_feature (39)..(39): n is a, c, g, or t
  misc_feature (174)..(174): n is a, c, g, or t
  misc_feature (236)..(236): n is a, c, g, or t
aagtagacctcaagccctcccatgttttggaggaaacantttccgcctaggggactttgcccaagtgggttaaataaaagtgcttcccagtgtctttccgtgtacaaaggcattttgcctatagagttcctcatgcaggcattcccatcaaaagatgggtgaagtcctgagtgnactggctcattcctgtaatcccccatactttgggatgctgaatggggagggatcacttgagncccaggagtttgagaccagcctcagccacatagggagaccctgtctctacaaaaaataataagttagtcatacatggtgcgtgcgcctgtgatcccagcttgaaaagtttaggtgagaggatcacttgagccagggaggtcaaagctgcaatgaactatgatcgtgccactgctctccagcctgggtgacagagcgggtcttgtc

SEQ ID NO: 585677 - DNA, 817 bp, Homo sapiens
agcggggggcgctgcctcgagcctcatggctgcccctgcttccgtcatgggcccactcgggccctctgccctgggccttctgctgctgctcctggtggtggcccctccccgggtcgcagcattggtccacagacagccagagaaccagggaatctccctaactggcagcgtggcctgtggtcggcccagcatggaggggaaaatcctgggcggcgtccctgcgcccgagaggaagtggccgtggcaggtcagcgtgcactacgcaggcctccacgtctgcggcggctccatcctcaatgagtactgggtgctgtcagctgcgcactgctttcacagggacaagaatatcaaaatctatgacatgtacgtaggcctcgtaaacctcagggtggccggcaaccacacccagtggtatgaggtgaacagggtgatcctgcaccccacatatgagatgtaccaccccatcggaggtgacgtggccctggtgcagctgaagacccgcattgtgttttctgagtccgtgctcccggtttgccttgcaactccagaagtgaaccttaccagtgccaattgctgggctacgggatggggactagtctcaaaacaaggtgagacctcagacgagctgcaggaggagcagctcccgctgatcctggagccctggtgccactgctctacggacacatgtcctacaacatgcccgaaatgctgtgtgctggggacatcctgaatgtaagcacgtgtgtgaggggcgatccggggggccacttgtctgtgaattcaacgcattggttgcagattggaattgtgagctggg

SEQ ID NO: 585678 - DNA, 138 bp, Homo sapiens
aagatgaggaattgacttgtgtccatttaatcgtatccagaagcttgctggaattttttatcagttctaggagcttttggaggagtctttagggttttccaggtatataatcatatcatcagcaaacagccacagttt

SEQ ID NO: 585679 - DNA, 158 bp, Homo sapiens
  misc_feature (102)..(102): n is a, c, g, or t
  misc_feature (138)..(138): n is a, c, g, or t
  misc_feature (148)..(148): n is a, c, g, or t
cgggaagcaggcctgcattctcatgatcaaagccctggaacttgaccccaacttatacaggatagggcagagcaaaatcttctgccgaacttgcgtcctggnccacctagaggaggagcgaggtttacagatcacccntggttatcanggccatacag

SEQ ID NO: 585680 - DNA, 676 bp, Homo sapiens
  misc_feature (43)..(43): n is a, c, g, or t
  misc_feature (64)..(64): n is a, c, g, or t
  misc_feature (79)..(79): n is a, c, g, or t
  misc_feature (123)..(123): n is a, c, g, or t
  misc_feature (256)..(258): n is a, c, g, or t
  misc_feature (267)..(267): n is a, c, g, or t
  misc_feature (295)..(295): n is a, c, g, or t
  misc_feature (310)..(310): n is a, c, g, or t
  misc_feature (313)..(313): n is a, c, g, or t
  misc_feature (347)..(347): n is a, c, g, or t
  misc_feature (353)..(353): n is a, c, g, or t
  misc_feature (359)..(359): n is a, c, g, or t
  misc_feature (368)..(368): n is a, c, g, or t
  misc_feature (416)..(416): n is a, c, g, or t
  misc_feature (507)..(507): n is a, c, g, or t
  misc_feature (516)..(516): n is a, c, g, or t
  misc_feature (525)..(525): n is a, c, g, or t
  misc_feature (531)..(531): n is a, c, g, or t
  misc_feature (541)..(541): n is a, c, g, or t
  misc_feature (555)..(555): n is a, c, g, or t
  misc_feature (574)..(574): n is a, c, g, or t
  misc_feature (576)..(576): n is a, c, g, or t
  misc_feature (580)..(580): n is a, c, g, or t
  misc_feature (594)..(594): n is a, c, g, or t
  misc_feature (612)..(612): n is a, c, g, or t
  misc_feature (664)..(664): n is a, c, g, or t
gccccctatgattcccagttgtcctcgtactcctctgcctgtngctgctgcggtggcggcagangagggatggagtctnaaacgcgggcaaaggatcctccggaaacctcaccagccccaggncctttcccagaaatgcctaaagggaaaaggctgagtgaaggtggttggagggaaaacctggataaaccagcccccggagaattaaatacaggaagaaaaaggcaggacagaattaaaatgtgccggcccaggnnngacagcagncctgcctcctacccttgcacctcatgancagcttgttgaaganatncgacatcaagtacccaccttggctcgtggctctnacttgntcctgntccttctgnttcttcttctccagctttcgctccttcatgctgcgcagttggtcttgncgatgcccccagtttggtggatggactctagcagagtggcccagccaccggagggggtcgaccacttccctgggagctccctggactgganccgggaggnggggaacanggcaangaggaaaggntgctcaggcagggntggggaagcttactgtgtncnagancctgctgggagggnagtcaactcccctcaaangaggagcccgcgctggggaggcggacctttggagatgtgtggggccgggcangacttcggcaac

SEQ ID NO: 585681 - DNA, 167 bp, Homo sapiens
tccctgcctcagctctgagtagctggtattacaggcacgtgcaccacagcctggttaatctttgtatttttaggagagatgagttatcaatatgttggccaggttggtctcgaaactcctggcctcaagtgatccagctgccttggcctcccaaagttctgggattg

SEQ ID NO: 585682 - DNA, 760 bp, Homo sapiens
  misc_feature (464)..(464): n is a, c, g, or t
gaaaaggtgtggttgatatagacagcagcacggtggctcacgcctgtaatcccagcacttgggaggccggggtgggcggatcatttgaggtcaggagttgagaccagcctggccagcatggtgaaaccctgtgtctactaaaaatacaaaaaaaaatgggctgggtgtggtggtgtgcgcctgtaatcccagctactaaggcaggagaatggcttgaacccgggaggtggaggtcgcagtgagctgagatcgcgccagtgcgctccagcctggcaacagagtgagactctgtctaaaaaaaaaaaaaaaaaggaaaggcaacaacggaaacattggggaggaactataacttttctacttttggagataagataattctttcaaaagtttgtgaacctcccgtggagattaggtggattttaattacggcagttgggggagataccttttcagaggaaaccagnggggtaaattccgtgttgagggcaaagagtatttttttcttaacaattgggcaaaatttcttctttggggccgagggtataatctccataaacctcttctaaatttttttgaaggggaaggcgcttatggggtttcgtgtattccccttatggagtgatatcccttttattccaagtaggcgtggtgatctccgcgcgagggtgtgtgcggtggccgctctcaagggtgtgcgtccgtgtgcggtccccccgttgcttggaccatcctgggggcccttcttaaatgccccccgggt

SEQ ID NO: 585683 - DNA, 146 bp, Homo sapiens
caggagaattgttgaacccgggaggcggaggttgcaatgagccaagatagcaccactgcactgcagcctgggtgacagagcgagactccatctcaaaagaagggctcctgtgtctacgtcatggtggggctagagagaggtccccg

SEQ ID NO: 585684 - DNA, 201 bp, Homo sapiens
gcgcctcggaggcgtttcaagcttgctttcaaaggatgaagcttgaccatcttcctttcccagccacttgctgtcccagaaaactctattgtaagtggacgagtacgcaaacttcgtactttctagttgaagcgtattgccacagaaggttctgctgacgctctggtgtaagaatggaagggtatatgtggtccgaactga

SEQ ID NO: 585685 - DNA, 243 bp, Homo sapiens
tttcatcttgcagcccggacatcacctcttagctcagacccatggagcggtgaatgggaaggggtcactcaagggacagcccggggaatttaacaccagagctggccagatacttagtgaagttcctgggatgctatgctgagcacaagttacagttctgggcagtgacagctgaaaatgagccttctgctgggctgatgagtggataccccttacagtgcctgggcttcacccctgaacatc

SEQ ID NO: 585686 - DNA, 282 bp, Homo sapiens
aggtccgctaagacctactaggggtcatgtggactcagtgaggtccgttttcacggggtgaatgcgaggtgacaagtagcaacaatgcgagtacttgtccttcagctcgagcggtggggtcactagtcctctgcatggatactcagggcatcatgacatctggacggtcagcggtgtgtgccgggtgtaccgagccgtgctagttgccccagctggaacagtcgccgtggagcggagtggaggacccggtcggtgacgcgcgatagtaaagtcaggcggggt

SEQ ID NO: 585687 - DNA, 129 bp, Homo sapiens
gggtgtagcaggtgcagtgcgattaggcaggtgcagtgcggttctgaaaagccgctctcagccaatattgacagcctctgcacacccattccttggagagggtcagtaggtgccaattccacagtgggg

SEQ ID NO: 585688 - DNA, 344 bp, Homo sapiens
agcctttttactgtttggctgttgcgaatacagaacaccaggacgctatggacgattcgattatggatgatcgaatgtctaaaatttatcatgaacgctgtctcgactacaccgaggaactgtctcaggtgaatcttgttccgaatttcctgtgacaacgctgaatgccctgtgtcaaccggtaacatcatgaggtctaccgataattgatgctgaagtgaaattaccttcatgctgtgatcgcatgagatcaggctcgactatggattggatggtacagctggtatatttggccatgacctagatgacctgtcacttcgtactcgggcatttggccattggcg

SEQ ID NO: 585689 - DNA, 715 bp, Homo sapiens
cgtgacatcggctgtttttaaactgtactggattacacgtgtaagcatatgccaagctttccttctcagtttcacaatttgtagtatgtttctgactataaataaactgttctactggactctctgggtgttacctatgatattgtataatgttagctaatgtcagcacttgggaagactaaaatactaactctgtgtttattaaatgaaggaatttactgagtacactctagcataatcaggtactttagtaagctgttaatattgctttctgccagttcctgaatccgtgttatgttctttactcctcatgagaagttgatgcattgtgaaatctgttttcttaagcttgtctgtcagctagccctagattagtattctagttacaggctaagaatagtgtctttcaccactgtggaagacactgatacttgtctactgtttggccattgctcttcttattattcttagttcttattcacccatattctgctctgttgacagttttagaccacacttcttatgtgtgaaatagacaaatattttccagcatattggatagttttagctgtcatctattaaatgctggtggtggaccgcagtctccagtgacaaccaaaaatatcaccgtgcatttcagaaaacttctggcatgttaatagctactattaatctgatcatagtcatttccttcttaccaaatttttaatttata

SEQ ID NO: 585690 - DNA, 102 bp, Homo sapiens
taatgcggggaaaggctccattcgaactttgtgcccaagaatgaacggctcattatctcaggatgatggggctggaggtatagggagaaaagaagaaggaag

SEQ ID NO: 585691 - DNA, 123 bp, Homo sapiens
atcttctacctcagactactgagtagctgggactacaggtacacatcaccatgaccaggtatgtattgggtattgacaaagtatgccacgtaacccagtgctgtactaatttcttttcttttc

SEQ ID NO: 585692 - DNA, 1416 bp, Homo sapiens
gctgttggtttattgtacgctaggttggttgtgttagtttttgggttggcgtcgtggttggtttcgtcctcgttttggtgttgttgatttcgcgccgggtggtgtcgcatctatttgttttgaggcgtcggtagtgcttctgcagcacttggttgttgctgctcctcacgtgtgtttctcttggactatggtttctcttgtgtggccttgtgacagggggcgctctgttctaccaggtggcgcgacctgtggctctcggtgtgaactggtggtagctccctccccgggggtgtgtcgccttggggcccccgtggtgtggttggcgcggtggctccctacgggtggttctttccagtgtaaggggcagcacgttgggtgtcacctggtgtgtgtggtttcccgggttttgtgctgcccccttgtgcgctgcaggggtgtttgcgcctctatctccgccccatgtgtggttcccttggtgtgccctcgctagacccttgtgactgggggtgccccccctgatgtggcgccgcttgcgcgtgatcaggcgccccctggtgcggccgagcccccgcgccgtgttccccccgcctgtgtgccagggccccccttagtggggcccccgccaaatcggcctgtggtaggggcagctgccagactttcttggtggggatgggtccatccgttgggggcaaccctcgtgcttacggcaatttggggagcccccccacgcgggaatgacagtagttccttaacgggccgtttccgcgtgaaaaaccactggggcctcgtggatcttgtccacgcccgtgggactctctatggtttggggagccacgggccccacgatggcctctcggggcttgtccccagttcacaggcggggcgcccccacccccccatttcaaaagggagaagaatggggggcgaattagcctggggacactggggggggcccccctgggagagaccacgactcggcgagggacggcgtgatcaaccctgtccgttttcccgtgtggtggcaactgtcggtttccacgtgtcctttagcgcacaaattgggaatgccccacagagggagctctccaatcccctgggctctggggtgtcacagacaacacgtccacgcatatgaaggttacggcggccccttatgggcaccctcgggcctgatatgtttccacttgaatcccgaccttcttggccctggcccttaacttggttgccccaagcttctttaagagccttctccacagtttgcaacctgtgccccacgccctccacctcactctgtccctgcagcaccaccacctcgcacccctcgcaccttccattttctccccagtgcttcagcacacttccaggcccttttgcttatagagcctacctgtatccccctaaccaacacctgaaaca

SEQ ID NO: 585693 - DNA, 230 bp, Homo sapiens
cagtgggcactctgcccacgagctgccgaccatcaggatgcctgcagacatctgcccagcctttgttgatgtcgtgactggaaaatactctccgcgcaaatccatcctgaagtctcgaagtacagagaatagtgtgtgtagcgacactagtgaaagcagcgctgctgaatttgatgataggcggggagttttgaggagtatcagctgcgaagaagccactcgcagtgaca

SEQ ID NO: 585694 - DNA, 417 bp, Homo sapiens
  misc_feature (118)..(118): n is a, c, g, or t
  misc_feature (294)..(294): n is a, c, g, or t
  misc_feature (378)..(378): n is a, c, g, or t
gagtatcattcctgtcacccaggctggggtgcaatggcacgatctctgcccactgcagcctccgcctcccaggcccaaatgatgctcccgccccagcctcacgagcagctaggaccanaggcgcccgcaccacgcccggctaattcttgtatctttagtagagacggggtttcaccatgccggccaagtctcgaactcctgacctcaggcgatccgccgccccggccccccaaagtgccgagattacaggcgtgagtcaccgcgccaagtaatcacttactgaacacccaccantgggccagacattgtgcgacgtgttagggctacaaacctgattacacatggccctgaacttgagctcagcctacctggaaagcnaaacacgtaaacacatgacttacaaaatgtgttacatga

SEQ ID NO: 585695 - DNA, 535 bp, Homo sapiens
gggagcggcggtttgcatgagcaagtagaacagtgagctgcagagtgagtatgtgcccggagagcagaggtggtcagagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacatggtggccccatctgcagaggccatgcgtatctggatggatgtcattgtcacaggggctgagggctacactcagttcatgaactaactgccgtgggcctcctggcagagcacaactggcgcttttgtataagacgac

SEQ ID NO: 585696 - DNA, 1009 bp, Homo sapiens
gaaacaggcgactccaaaggtgtatccagttggtaatacagccacacagtaagttacaattctaagtatatggccattataattccatgtaaatttaaaattgtaatgggactataatgtacctagtgggatttactctaaggacacaactgcaaaaaatcttgggttgttttcttttatcatatcgtcggtacagatgtttattctgagactatgggtgtacggataaagtaaatgagtaattatgtcagtgtcatgtgagaacagattttgggcttgagatacagatgtcacctctccgaagattcagctaaaagctacagtcttagacttaactggacaaatactcagtaggaaatcatgatgaacgttctatatttccaaaatacaaaatggctgacttggtccacaaacacagggtctcagagcaatgaccataaactgcagctccaatagagtcatgtgacaacggactcaggagctttcactgtgtccaggtttcctccattgttcaaatatgggatagttaacgaatcacacgactaataacctgagtgactggaaacaaacaaattatatcttaaactaaagggctctttaatacttacatgaaaaatctcagcaattaccttggcagaggatatcagaaaaccagtcacggtgtgggaaacgtaccgtcgcaggggacaagtcacgcctttactccggccccattcgaaagacgcgacataagaaaacaagataacaggggggacacccaaacacggagcgaaatagcacacggaacaccacgcgacgcccccataccagaagcgcgcaccaacacggccacacacagtgccgcgcagcgcagcatcaccaccgggacaaatccccaggagctagaccatgaaccccgcaacaagcatgactgcgatcacgcgggcaaaccaaacgcccgcgccgtcacatgggcaacagaaaaagacacacaaaacacaacactcacacaccaacacagaccagacat

SEQ ID NO: 585697 - DNA, 229 bp, Homo sapiens
tgtcagtattctgtccccacattagtgcttacgagacagatgcgattccctggacgtctaaaccaaagcacgtttcacctgctacacgaccggggtgtctactacgtgtcaagtgctctgaaatcttgtggagcaaaccagagtttcatggccatcgtactagaattaattcccctaaaaatctttgaaataggggccgtatttagcctataggaccctcctcttttgg

SEQ ID NO: 585698 - DNA, 108 bp, Homo sapiens
actgctcggtctctccacgccgaacgtctgtggacctgccggtctttgagatgcttctggctcccatcccgttgcttgggttgacgtcagggggtaccgcgctcgact

SEQ ID NO: 585699 - DNA, 861 bp, Homo sapiens
tgcagtggctcagacctgcaatcccagccactttggaaggccaaggcaggcggatcacgaggtcaacgagattgagagcttccagatacttgggaggccaaggtagtacggatcaagaggtcaaccagaccgcgagaccagaccgggcgtggtggctcatgcctgtaatcccagcgactttgggaggccgaggcgggtggaacaagctgaggcatggaggataagctcttattcagagcattgagaggaaattgtgaagcttgcagtgagccgagattgtgccactgcactccaggctgggtgacagagcaaggactctgtctcagaagagtggcccgaaaacattgtgccataggctgtggagttccggaggacagtgtagtccccgctccatatgacgggacggtgccaagaccaaagcaatagctccgtgtgtagaacccgaggtaggcggaaaggtttagtcgattgactccgacaactggaaccactgtcgtgccacccatgggggagaagacagaactgctgctcgaaacagaaacagaggcagcgcagggtggaaccggtccggaaccgcggcctgtcacggaacacgtcccataacgatcgcgacggagaggcgtcagacgtgcaggtatcgccgtgggaggcacccaagacatatctagaggagccgcgccggagagacgacaagatatgggccagaaaccccgggagacgcgggagatggtaacaaggaatgaccgcgacaggcatgaggaccccaagggaactcccagactaagggagtagcatcggatggacaagcgccacactctacaagacaccaaccataggcgaacccatcgagaactactaacg

SEQ ID NO: 585700 - DNA, 168 bp, Homo sapiens
gtgtctcattgaagctatgagtattcttggcatcactgcagctagtaattgcttctggagcctggcactgtgttgctctgtttgtaccatttgactgctccataccaagagtccaagtggcacaaattctgggtcgttgtccatcacaaacccgaaggtaccgagctc

SEQ ID NO: 585701 - DNA, 288 bp, Homo sapiens
tggcatataaaagggggattttttaattttaggccccatagattgtggtaagtgtgccctgaaggctagcctttggtatttaaggaaattggcccttccccctttcaatgcttgtgttcccagttagggggactcggctccccctttaaatttcctataggaaagctttttataaaaatttttcccatgtggctaccctttctccccttgtttagatggggattaaaaccgaaggaacataacctttgtcccccccttttgttggtttttaaactggaaaaccaaaag

SEQ ID NO: 585702 - DNA, 157 bp, Homo sapiens
  misc_feature (27)..(27): n is a, c, g, or t
  misc_feature (36)..(36): n is a, c, g, or t
atcagctctgtaccgtctatagggcantagggatantttcgtctaattggttctgggaagcttcattcaagtcctcaatggtcatctgatcaaatggaattaagttcttcatcttctccatctctttctcatattctacaatcttggccttatcgag

SEQ ID NO: 585703 - DNA, 118 bp, Homo sapiens
tctctattatcgaccttccatctcgttgtgtgtgagtcgagaagggatcgtagctccatgctgtgcgagtagatgcgtgggctagcaacacatttaacaacatcatgtataaccagtc

SEQ ID NO: 585704 - DNA, 189 bp, Homo sapiens
cccaggcacaggattaattgccttgaagtcttattatgtaggaatacacttggtaaggctatagcttgccatagataattattcttctgatgaatctgggcaaagtaaatcgacaaccttctgaaaggattcagcagttctagagtgtcatataagaatatttggtggttcactgggagcaagatcaaa

SEQ ID NO: 585705 - DNA, 715 bp, Homo sapiens
  misc_feature (247)..(247): n is a, c, g, or t
gctctgtcagtcgcgagcgaacgaccaagagggtgttcgacatgctagagccgagggacgcgatgtcctaaagtcaaaggaactgggtgttcgttacaagacttcttctgggcagtgagtctctgacatgtgatgggttgaccaaagagaggttaacaggaggaaaatatgcaacgtggctcgcagaaaaacgcgtgtaagaggaatagtaaaaggacagggtgagaacttgcgagaagccctggtncaatctttctagatcaggaagtagtagccagtcagaggatgagtaacaattggtttctaggagttgggaaggatggaggtacgttagatgtgcgagattttaaaggcgaagtgtctaaattgaatatcagagaatatggcatggggatcctgaatggtgatagtgaatagcaggaagaaagggtatcttgttgaaatccagaagaattggagccagttgaaggaacagattgcgtgagcattgaggatgcagtaagaagaactgtagtaattcgagccagtagttaattaaatactctgtactgttactagtggtggaaactcgtgtctgttttacatgtggttgtggtagatctagagatgtgctccaagctatgggtatgtcaggatggcagaagaattctgtacgatgaatactttttcaagtgtgccttattaacaatatggaggtgaagtaaatgtgtgtacc

SEQ ID NO: 585706 - DNA, 256 bp, Homo sapiens
  misc_feature (122)..(122): n is a, c, g, or t
tcccagcaagggcctttttgtttaagatgtcccccttttttgagggttggacccacccatttttgtccctggggcctggtcccagccaattaggcccgctttggccaggggagagagagctnccgggggttttccctgggccccgtctccctggttggttctcccctcccttccctggccgggtgccatggccaggaggtaagggcctttttgtgggcaaccccttaccctttttttgaaaaacctgttttcagga

SEQ ID NO: 585707 - DNA, 815 bp, Homo sapiens
tacgtgatcccctctttagcacccctacgccccccatatccctaaattcgcgtgttcaatcccctgtgagcactctttaatagaatcttaacggctcctttcgctgtccctgaaacccgacagctgttttataaattatcgcgtcaaaatttcctccggcttctttgatgcagagctcgcacaggaatatcttccactcaactggggaaattctgcggggttctcccacctccacgttcaccctcgcgagttattacaacaacctgcggtacctcctccccccattcttttattatcccgcgggcgttttctcccccccgctccgagaaaacttattacgccccctggttttccccccatcatggaatagaacaatatctccccactattctctccacgcacggcgtaggtagtaaaatactaacctcttcgcgtttgctactatttgtatagacgcactcgactcgacacacacgttgtaatgtaataaaaataatatactgccatattatacttcctaaaaaatatctccatttataacataacatctttgaaaataagtagggtattttattgtgtgagacacactcctctcatctcgtcaatcaaagtgtggagtaaatatggcatcctgtctgtatatatatgtgtgggctaacaggcatttttcaaacagctgtccacggagtgtacccacgattgttccaacacccacggaggggcgagccaatagagctgggggaagcacgacgcggcggttgcccccttatgtcgaccaccacgtaggaaacgtcggcaaaaaaacccaacataac

SEQ ID NO: 585708 - DNA, 118 bp, Homo sapiens
ggggacctaaacccacaaacacgtagctaacagcatagcacccaaatctaacttgcatcaactatcgttctccgccgccggaaaaaaaggcgggagaagccccgcaggcttaaagcac

SEQ ID NO: 585709 - DNA, 308 bp, Homo sapiens
  misc_feature (105)..(105): n is a, c, g, or t
  misc_feature (145)..(145): n is a, c, g, or t
  misc_feature (157)..(157): n is a, c, g, or t
tgactctacaggatcttcttcttaacgccccaaactcactccagtgaatgttgttctctatgaacagccataacacactccagtgaagggttctctctgaacagncctaacacactccagtgaagggttctctctgaaacagccntacacactccantgaaggttccctctgaacaggccttaacacactcccgtgaaaggttctctcttcatccaggcctaacagactcccgtgacgcgttctctctgaacagacctaaaacactccagtgcaagttttttctctgaacaaggctaacagactccag

SEQ ID NO: 585710 - DNA, 830 bp, Homo sapiens
ttaatttcagtacgctggccgggcttacttgtacctccactgtgccgtggccgttccatttacaatcacctcgcctctaccccactaacatcccagacttaaaattcagtacatcacatgtacaccgaaaaaaaaaaaaataaaaaaaaaaaaaaaaagaaaaaaaaaaaaaaaaaaaaaaaaaaaaagcagtaggaagcgataagtatcttcacaggtacagaaacgaaacagagttactcagcagggacagtacagaagtatgtagaggtatattagtcacaagccccaataagttatagtaatacgaacaggtagtatgatattctaccacagcaagcagaaataaaacagaaggaagatacaataaaaacagcagacacacagcagatagtataaaaatagaattatatattaatgattatatgttgaataataaatgaaataaagaagaaataagaaaaagagatagaatagaaaaaagaagaagatatgaatatgagaaaaaaataataaaagagaagaataagaggataggaaagaaagaaaaaggaaaaaaaaagaaaaaaaaagaaaaagaaaaagaagaacgatcacgaacaaacaaagagaaaaagaaacagcgagaaaaagacgacgaaaaaagaggacagagaagcaaaacaaaagaaacaaaaagacaacgacaaaaaaaaaagcgaagagagaaaagataacacgaaacgcagagacaaaaaaaaaaccaaagccagaaaagaccagaggaagacaaaaacaaaacgaacaaaccaagaaaagacgacaacgagagaacaacaacaggaagaaga

SEQ ID NO: 585711 - DNA, 260 bp, Homo sapiens
cccccccccccttttttttcccccctattagaccccggggccgttcccccccccgggcttttaccttggccccggggggggttaccattttccccccggaacccctttttccctttggccttttttgggggcccttttaacccagttttttccaaaaaaccggcttggtcccggcccggttttcccgggtttttttccccccccggtccccgggcgggtgggggggcccgtgggcgggccggtggggggcccggttggga

SEQ ID NO: 585712 - DNA, 475 bp, Homo sapiens
  misc_feature (10)..(10): n is a, c, g, or t
  misc_feature (16)..(16): n is a, c, g, or t
  misc_feature (36)..(36): n is a, c, g, or t
  misc_feature (80)..(80): n is a, c, g, or t
  misc_feature (117)..(117): n is a, c, g, or t
  misc_feature (463)..(463): n is a, c, g, or t
cacctcctangctganggccttcccctcaatgtggncccctaacccttgaaaaaaccctacttggtcgtcaaaatacccnatatccccatctgtgtttaagaacttttttcaacccnagatgtccccacctacagtgtctccttcccagcttgagaaccctgtaattctttaggtgtaaagaaggtcccaccgggtgctgtggcctcatgccctgtaatccccagcactttggtaggccgaggcaggcggatcacgaggtcaggggatcaagacccatccctggctaacatagtgaaaccccgtctctgctaaaaatacaaaagattagctgggcgtggtggcaggcacctgtagtcccagctactcaggaggctgaggcaggagaatggcgtgaacctgggaggcggagcttgcagtgagccgagattgcgccactgcactccagcgtgggcgacagagaanaaactccatctc

SEQ ID NO: 585713 - DNA, 524 bp, Homo sapiens
  misc_feature (42)..(42): n is a, c, g, or t
  misc_feature (59)..(59): n is a, c, g, or t
  misc_feature (103)..(103): n is a, c, g, or t
  misc_feature (115)..(115): n is a, c, g, or t
  misc_feature (143)..(143): n is a, c, g, or t
  misc_feature (174)..(174): n is a, c, g, or t
  misc_feature (177)..(177): n is a, c, g, or t
  misc_feature (184)..(184): n is a, c, g, or t
  misc_feature (201)..(201): n is a, c, g, or t
  misc_feature (207)..(207): n is a, c, g, or t
  misc_feature (267)..(267): n is a, c, g, or t
ggccgtccgccagtcgattaccctcctagggaacaagctggnctcccgcgtgcggccgnttagaattgtggtccccgggtgcaggattccggccgcgtcgatncggctgcggaancgacagagggactccgttgacacaaatngactcgaagtggctttaactatctgaacacncantgctagncccaactgggattagtnccccanttgcttagccctaacctcacagttaatcaacaaactgctcgccagaacatacgagccacncttaaaactcaaggactggcggtgcttcatatccctctagggagcctgttctgtaatcgataaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacactaccccagaaaactacgataacccttatgaaacttaagggtcgaaggc

SEQ ID NO: 585714 - DNA, 154 bp, Homo sapiens
ttcgattgtcgggcacttatcaaggacggcaagctgatcaagaacaatgcctccactgactatacctatcttgacaagagcatcaaccctctgggtgctttgtccactatggtgaacgtgacccactgactttagtctggctgaaagggctgat

SEQ ID NO: 585715 - DNA, 962 bp, Homo sapiens
  misc_feature (279)..(279): n is a, c, g, or t
  misc_feature (514)..(514): n is a, c, g, or t
gccgaatcaagcgagtggaaccggagaagctcaatgctgggcgtcgatgtcagcagggtaatttcgcagagtggagtagggtgctctggggcctgatgacgaacgtgtgctttccttttgaacggaagatccgtggactgttccccagggaagaagcgtgcgcgtgctgcagcaccggatgaccgaccatggcttcgcccttggccagcttgcattcctgggaggcggaggcgcgaggactgcgcggagcacatgaacgaacagcagaggttctcgcancaagatctgtcctactactggcatcggtacctgtcgggccaagcgaatgcaatggtgaactttcgcgtctcaccaatagacttgcttttaagcacaatcagaaaaggaacatcgtgtacgatgccactcataggtgttaacgcccacggagcataagagctgagcactaggcaagcatgtgcgtgacctattaactcttatcaacccactagcgggtccaagcaccagcgtgacntttggagcgactagaccgctatctcacgtgtgctctagcgcgaacgaacactcgagcgcaacgggcttctctgtcgattcgcactttcattacaaggtttcgccaactccttagttcctaggatagggttggcgcacgtagacgtaagagacatccacttttaccctcgttggttgaatgggccccatgtatcttgcggcctataagaaccacgggagattattagagccaacgaggcagagggagagacttccacatttgacttaggaacttgtctaatagtcacacttccttggcttggttagctcctcttactggatagttaaagcggaagcccgttcggctttgaaaatgccatagtggctattaccctaacggaaaaacaccacattggagagttccacactagatttcggctttatttgcaacgcaatgggcctgtgtattc

SEQ ID NO: 585716 - DNA, 174 bp, Homo sapiens
cacatggattgaagctgtcctctggtgctgagtcagttcctgggtgggggccacaagaccagatgaaccacatttatcaatctggttagggacagctgatccatcgagtgcagggtctccataaatacctgttatctcggaggagcaatttgggaggggtttagatatcttgcc

SEQ ID NO: 585717 - DNA, 1781 bp, Homo sapiens
aaatggcgcgttcgtccttgtaagtgatcgagattgccagctgagtcgcgagaccattagtgagtgtcgctgactcgtgagtagcgttcataacatcctaggtggtctagaccgtgctcagagtaatattacatgccatgtactggcgagggaacacgaaccttcattcctcaaggacatagggtagttaggtaattagccaagaggcattaagacctcttgtataacccgtatatgacctaatgcgaggtccttccaaaggactagtgatcatctgccaacgtgaggacgctacgcagcagaacagggctctcgctcacagcagatacctaggcgagcccagtcgttgagctcgtagctggtatactaggggtttagacatatgaatggtcaggaaactccctgtttttggtaagtcgttgcgcggacattgcgcccatccaagtaggcgccactgtggatgtcgctcgtcacagggttccggtaaagaagcttgcataaaaaaagtcgcgttgatcacccgtaggggtgtgcgtcgcgtttgtgcgttactcacatagcaatgtagttgataactcattcaggcactacttaatgtaggatgtcccaacatagcggtgatggaattggcctccatatatgggcagggagacaagacggtccattggaccgaaaagaggacccatggcgtaacaatattaacccggcgggtaatggtattataccacttcgacattgagttacaaggtaacagattgtgcgcctatgaggtggactgtggatgaggcgattagatttgtcttccattaaggtgaaataccatagaggaagtagattagaggaggcactttctgttgagcagaaagagatcgtggggttacaggcccaaaatagggtcttaggttggaagcacaacaggatttacttttgaaagggattattaaataaagagagcctatattaaagtagaacgtatatttggaagagggaaaaaattgggcgattaggtatagtacgactccattacagtatagctgcgccaatctatagaccgtaatcgaggatcaaattgcgccaaagattaaattagctttcaccctcgcagttacaatcggtgtccaggcaagacgtaaaaacaattgagagaaagactagatgccacatataggggagatggcagtaacataggcgcaatgcacagtatccaaccactagtacagggcgcactaaacgcacatcacacttttggcacacagacaaactattaataccgatctctattagaccaagtgaagaacgccaagggacgatctggcacgacaagggagacgacgaccagacctagttcaccaaggggctcggatgcacacacaccggtgccgaacgacaaatatcaatcactggcgaagagacacgacacacaggcgcgatggcattataccacaccaccaagatgatttccgatactacaaggaccgtacgggcgcgtgttcaacaacacgacggcatgcggagtacagatcaacggcacaggcgccgagcccggcaaagaataataaacaccccagacagaaagcaacaaccagcgaaaataacagagacgaaccacagataaagcagaacgggcacccagcacacacgcaatgaagaaaaaccgacaaccacagagacccactgcaccacagcaagaacaacgggcgaagcactctcaacaagctagtacaacaccacacagagctcaacaagcgaatagcacacgaaggtgagaacgcacagaccag

SEQ ID NO: 585718 - DNA, 195 bp, Homo sapiens
ctgttctagaggataccttcttgtgctggcgtgtggtccttggtgtggcttcggtggtggcttgggtgctggcttggtggtggtttgctggtggtgatggcttctggtgggcagagggtagtaattctctcaacacagagaaaacattagtgtgataacaatgaatcaaagacagggccagacaagaaccacacg

SEQ ID NO: 585719 - DNA, 278 bp, Homo sapiens
ttcattacaggcgtgagcgacatgcccggcgtggcctatcatgtcttgttttgttttgaaacacagtttcattcgtggcccaggttgaattgcattggccaaatctcggttcactgcaacttctgcctcctaggtccaagcagtcctcctggttcagcctcccaagcagtaggcataacggccatgcaccaccatgccgggataatacacccattctttgcagtagagaccgtatttcttcatgtgggccaccttggttccgaactcctaaccacttt

SEQ ID NO: 585720 - DNA, 742 bp, Homo sapiens
  misc_feature (159)..(159): n is a, c, g, or t
ttcaacgttatacaagagttcacagtcttcatgtaccggaacaaaatcttctgatgatctgcctttagagcatctgtgaagctccaggagagtatcagtgattaagtaagactatttcaatgtggtccacaggtgtccgccatctcgcaggagctgganacatctcaaatgtgtcaccagtagtgctccttatgaacgacgagtgtatcacacagtatggtgtcagtcaccttgcatccaggacagcaggaagagactcgtggatcacatgcagaggtgtggttaatccttgcaagttatcatcgagaggggggtatcttttgcacagagtcgcacatgctctgtgtctgtctaggatattacacagacctatcaggcagaaactggggatcgccaggcatatacagtgtggggtgtgtgccattccatatgtctgtgccagatcagagagtcagttgtcaaatgtatgtccagcaaattttatattcaaggacgcaggagagtacttcccgtgtgtcatactccatgcagggcttatattttttttagtcatatagacagagtagctacatgtctgatagaccacagagagattggtcacgcatttgcgtgatcgtcattaatactcatttgtaggttattaccagtcgctcgtaggaatagccgatcaataggaagttttcttctcccacagctatgtgcgcagagtagaatgataatgcaacctaccacacgttagcac

SEQ ID NO: 585721 - DNA, 244 bp, Homo sapiens
tgtattaacgaagaactgcacgccacctctgagacggagaaccacgtgcacggtgcactcttttcgcggggcgtcgtcagacaggcagcgaccatcttcactgtgcttcccgatacagatcaacctctgctgcacaagaaaaacgccttccttatcttgcatctttgccttgacattctctatggtgtcactggcctccacctcgagggtgatggtctcaccagtcagggtcttcacgaagatc

SEQ ID NO: 585722 - DNA, 173 bp, Homo sapiens
cgtcctgaatagggtacgatcgtcgatggtgtaaaatcgctccttcctcaggagtcagctgggctcccttctggcggcccaggggcagcgcatagggggcatcggtaccaccggtcggtagggggtgctggtcaatgagcacgaggcaatccttcaccagggtctgggaaggg

SEQ ID NO: 585723 - DNA, 965 bp, Homo sapiens
  misc_feature (779)..(779): n is a, c, g, or t
acttagccagtggtccataataatgaaccaattctgaactctgctattatctaatcgcctctatcacaatcttccttagatattatcatcgttcgcagccacagaatgaatcagatagttataaatgctatcttggaggtacacatttagtcacctctacctttgcgttgagtcatcatcccggattggcgattcagtcctagactagtaatcgccatgaagcgtcggtcccattacttcgtatgcatagactcacttagtagagcttcccattctccctgactcaattgcgtcgaaataagttgcatgctggagaaacatcccttagggcccggtaaagattactgacatactctattgctttaactgtccaagagggtatataatactctctggaagtagacatagttaggtgatgcattaggttacaaaatagttgttatagataatagggtggctactttcacggacttactcatttcatgagtcctaataagatcatgatcagaattgtccctgaatagagagggttcataagtactatgactgagggtaattcttgaaacatagggggtgatgttcataatttacgtcctctactcattcttaatacgcttgtgaatatacacgtacgtcattaaccccttgccttgtaacttagccctatgagggctgatgctaacgaggtgtcgatttgcttcgagactggacaaaggctggtgatggatcccttgcatcaggcagttagcccttgtcgttgcggatgttgataccaagcncctaaaattcatcgggacaatttgtcatagtggccaggttggtccactattatgggcgcgactaaaaatatgcccaagcggataacctccaaggtaccttttcccatgcttgtggtccaccccaaacagtactcccaaaaagagcacggacaatcttgagtatataacagaaaacactctttacag

SEQ ID NO: 585724 - DNA, 134 bp, Homo sapiens
tccagatcagagactgagatcactgaaccatgaacctggacatcagcatcgctctcctgctaacagatcttgcaggtctcccgtagggcagcaggtgaccagcactaacggacatgcctagtaggaccagagcc

SEQ ID NO: 585725 - DNA, 774 bp, Homo sapiens
ccacagcgtactgggcctgtctgacatgcctgcctgaccgtggattctgagaactggattgaagtgaagaagaggcctcgtgtctatcccctagatacggcccaagaagtcagaggaggtccatgattttcccacctgatcctctctgcctcagcagctgccttcccagcagctgtatgtccaaggatcaggatgagcacgaggagctggattttctgtttgacgaggagatggagcacgctggatgggcggaagagcaccttcagctgcctggtctgatgaggaatctgactatgagattgatgacagggatgtcaacaagatcctcattgtcacccagacagccacattacatgtcgcctgggcacgccagggggggacctgctacaggcaaccacaacctcgacgtgccatagtatgagcgccgaactggccacaggctcgattacatgatggcctcattctactatgagcatggacctgtgggctgaaacagtttgaaacctgtagtatacccatgatcaagctaatgaagtcgtagaacttcatgaccatggtcaatctgatcagccgggagcgaggtttgacgcactgacccctgagccccctgtggatcccaaccaggaagttcctacctgggccacctcggttccagcatagttcctacggatgccctggacaacaagttgtatggtgctcctgagccctccaccatcgcccgctctctaccaaccactgtcccagagtcaccaaactaccgaacaccaggaccct

SEQ ID NO: 585726 - DNA, 304 bp, Homo sapiens
  misc_feature (1)..(1): n is a, c, g, or t
nggtcagtgaattgtgatctcgagagatacttaaggataaggaaactgatgcctcagtagcaatacagactagctctccagagtcagaccagaaaatatgtttgggctgaatttcaattcttcgtatgagttctgtatagtcccagtcatagaaggctaagccatttacagatctgactcccaataagaagccgccgtagatactttctgctccaaaatctggtttaaatgattttttttccctcccttggtttttaaatagagacagtgtctcacttggttgcccaggctggtctcaaacacc

SEQ ID NO: 585727 - DNA, 320 bp, Homo sapiens
gctgtatccctgaagctgtaccgggagctcagttgggtaaagggtgtcagaagaatcaagctatgattttctttgttaaaactttattgtagagcagttttagatttacagaaaagctgcaaaggatgcaatagacagttcccatgtccctcaccccgtttccccattgttaacatcttccattactacggtacatttgtcacaacaaagaaaccaacactggttactcactaataactgaactccaacctttatttggatttcaccagtttttccattagtaacctctccccgggatacagctgtatcccgcgatacag

SEQ ID NO: 585728 - DNA, 3060 bp, Homo sapiens
agagtcttccctcagcatattttacgatagagaagatcttgttccaatggaagaaagtgaggactcacagagtgattcccagacaaggatttctgagtcccaacactccctcaagccaaattatctttcccaggccaagactgacttctcagaacagttccagttgctagaagatctgcagctaaaaatagcagcaaaactcttaaggagtcaaataccccccgatgtgcctccacctctagcttcaggtctagtcctaaaataccctatctgcctacagtgtggccgatgttcaggacttaattgccatcataaattacagaccacttcggggccttatcttcttatctatccacagctccaccttgtacgcactcctgaaggccatggtgaggttcggttgcatcttggctttaggctgagaattgggaaaagatcccaaatctcaaagtatcgtgaaagagatagacccgtcatacggagaagccctatatcaccatcacaaaggaaagctaaaatctatactcaagcttccaagagtcctacttccacaatagatttgcagtctgggccttcccagtcccctgctcctgtacaagtctacatcaggcgaggacaacgcagcaggcctgacttagtagaaaagacaaaaactagagcacctgggcactatgaattcactcaagttcacaacctaccagagagtgactctgaaagcactcagaatgaaaaacgggctaaagtgagaaccaaaaagacctctgattcaaaatatccaatgaagagaatcaccaagcgacttagaaaacacagaaagttctacacaaacagtagaaccacaatagagagtccttctagggaattagcagcccatttaagaaggaagaggattggagcaactcagacaagtactgcctctttaaaaagacaacctaagaaaccttcccaacccaagttcatgcaactgctttttcagagcctaaagcgggcattccaaacagcacacagagttatagcttctgttgggcggaagcctgtggacgggacaaggccagacaatttgtgggcaagcaaaaactattatccaaaacaaaatgccagggactattgcttaccaagcagtatcaaaagagacaagaggtcagctgacaagctaacgccagcaggctcaaccattaagcaggaggacatattgtggggaggaacggtccagtgcagatcagctcaacagccaagaagagcttactctttccaacccagacctcttcgactgcccaagcccacagattcccaaagtggtattgctttccaaactgcctcagtggggcagcctctgagaactgttcaaaaggacagtagtagcagatcaaagaaaaacttctatagaaatgaaacctccagccaggagtctaagaacttgtccacaccaggaaccagagttcaggcccgaggaagaatcctacctggttcccctgtgaagagaacctggcaccgacatcttaaagacaaactcacacacaaggagcataaccaccccagcttctatagggagagaaccccacgcggtccttctgagagaacccgtcataacccctcttggagaaaccatcgcagtccctctgagagaagccaacgcagttccttggagagaagacatcacagtccctctcagaggagccactgcagtccctctaggaaaaaccattccagtccttctgagagaagctggcgcagtccgtctcagagaaatcactgcagtccccccgagaggagctgtcacagtctctctgaaaggggccttcacagtccctctcagaggagccatcgcggtccctctcagagaagacatcacagtccctcagagagaagccatcgcagtccctcagagagaagccatcgcagtccctctgagagaagacatcgcagtccctcccagaggagccatcgcggtccctcagagagaagccattgcagtccctctgagagaagacatcgcagtccctctcagaggagccatcgtggtccctctgagagaagacatcacagtccctctaagagaagccatcgcagtcccgctcggaggagccatcgcagtccctcagagagaagccatcacagtccctctgagagaagccatcacagtccctctgagagaagacatcacagtccctctgagagaagccattgcagtccctctgagagaagccattgcagtccctctgagagaagacatcgcagtccctctgagagaagacatcacagtccctcagagaaaagccatcacagtccctctgagagaagccatcacagtccctctgagagaagacgtcacagtcccttggagaggagccgtcacagtctcttggagaggagccatcgcagtccctctgagaggagatctcacaggtcctttgagaggagccatcgtaggatttctgagagaagtcacagtccctcagagaagagccacctcagtcccttggaaagaagccgttgcagtccctctgagaggagaggacacagttcctctgggaaaacctgtcacagtccctctgagagaagccatcgcagtccctccgggatgaggcaagggaggacctctgagaggagccatcgcagttcctgtgagagaacccgtcacagtccctctgagatgaggccagggaggccctctgggaggaaccattgcagtccctctgagaggagccgacgcagtccccttaaggagggactcaagtacagtttccctggagagaggcccagccatagtttgtctagagatttcaagaatcaaacaactctcctcgggaccacacataaaaatcccaaagcagggcaagtgtggaggcctgaagctactcgatgaggcgaggtccgcccctattattcattgtcctaagtcttcatcgtgctgccctttccaggcttctttcctgctcagccactgcctccaattcctgcgcccccagcgtggaaaggcttccatttctctctaccgggggggaggcgggtgagaatgggtctgtaatttctctaagatgaataaaggggcagttaatt

SEQ ID NO: 585729 - DNA, 124 bp, Homo sapiens
cagatgcggtgcgccttgaccgcctacgggcgcgggcccggggtggcgccgccgcagggtgccgttctcgttggctttttggctcctccccccgggacggtcgcgcgccgggacggggtcccgc

SEQ ID NO: 585730 - DNA, 501 bp, Homo sapiens
ggactgttaaatcaagcttaccaagttttgcgaacactatttactgtgctgtgttgctaaatggttaaccgaagtctagtatctacgtgataaatataccagtttattttaaaagatgctgttgtgcctatatcatgaagaacattaatttctcatgtaaaaaaaatagctctaaaatttgtttacaacctaaattggtaacctgagatttatatctaggcatgaattcattatggtaatacacatatgtgaataacagtacatattgtgacagtattctaccattcagtaattttggttaatgattttaacacttctcagtgtatttaatatcaacttgttatattaattggtataaatagctgattagttaggacagatgtgtcttgaatgtaccattataagaagaattctatgtatcttaacctatgatcttctaaaataatataaccgtaagtacttctgtggcctagagtataaatacaaggtcaactgtagcct

SEQ ID NO: 585731 - DNA, 812 bp, Homo sapiens
aacaaaaatgaagatacaaaagtgaagttaggaaatccttgtaaagaaaatcatgaatgaacaaaggtaatatgtctagcactgcactgaaaaaggacttctgcatttctgacatagaacactggaatcccagtgaggaattctaaggtgaacattccttatagaaacctttcacatgaatgagctataaactgagagctttaaatgagctgtgaagtgtgttaaaatgtgttttgatacagtaatatataaatatgtctatatagtatgaggaacttgtgttttttaaatggtggtcaggtagaggaactagaaaagagattttgttgcgctgttttctgaccatcatgtgttattgtctagctgagaaactaaggatatagtaaatttaactaaaactacactgtcaccatgttaggtaataaacagatctgccttgaaagagaaagaagatctgagaaagaaatattgtggtcagtgttgttaatatagctcaagaattgagtttatatgtgcagtatgctataaatgatagcgctcctatcataagccagcgatcacacagtgtgtcgtctaatcgaaaaatgttggctgtgactattttatcatttggtagtatttcttccagaagaagctaagataagactggacttacctgaagtgcattaattaaagccaccactaaaataaaaaaacacacacacatccaaactttttggggcgctttggcccgtaaaaagtttcttaaccctgggggggccgggggccccaggtaaggaaacggccaggggtcccagaaactcggcaacaag

SEQ ID NO: 585732 - DNA, 341 bp, Homo sapiens
ggtcgacctccatctcaaaacaaaaagcagctaggtgaggggccgggcatggtggctcatgcctgtaattccaacacttcaggaggctgaggcaggtggatcatctgaggtcaggagttcaagaccatcctggccagcatggtgaaatcctgtctctgcgtaagatacaaaaatcagctgggcgtgttggcaagcacctgtaatcgcagctacttggaaggctgaggcaggagaatcgcttgaacccaggaggcagaggttgcagttagccaaaattgctccactgcactccaggctgggtggcaggagtgaaacttcatctcagaaaaagaaagtcgacg

SEQ ID NO: 585733 - DNA, 191 bp, Homo sapiens
ggtatgttgaatggcctagcatgtctgggagtatggcctgggacagattgagaatctgcagtcatgggggatggactagaaacttcccaaatgttacaacacaggccagggctcaacccagtcagcagcgcagcagcaacaacccccgatcccagagaactccaaccctaacaaagcccatgagggagaac

SEQ ID NO: 585734 - DNA, 232 bp, Homo sapiens
cagcttcggagagggattttggcaaagccacttggagagaattaggctgcagttttcacttggggccaggttagttagttacgcacaagagccctacttacttaaattagtagagagtgtaagtgtgggaaactttaaaattaaaaagagagcacatgctagagcccctcacattcacaggtacaggattagaagagatctacccacatttagagaaagagacacgctttct

SEQ ID NO: 585735 - DNA, 125 bp, Homo sapiens
  misc_feature (88)..(88): n is a, c, g, or t
cctcgcggtttcatgagcatgttccgtggcctcgcccaggccgacggcaccctcatcacatgtgtggattctgggattctcagagtcntgcatgacaaggacaaggacacatcctctgacccact

SEQ ID NO: 585736 - DNA, 398 bp, Homo sapiens
gattctgttggcactcgtaacgacaactggtagcaagattgctctcgcaagagttcgaccggacatcgcggagacggaggctcgcctacctcaagatcctggagagctcccagactttgctcagcgttctcaagagggaagctgggaacctgaccaaggctacagccccagaccagaaaagtagcggcggcagggacagctgaccagaccacgggcaggccctgccctccgtgtgcccctcagctcagccccagcaagtgtgtgctcagagcatctttgttcttcacggcagcagataccttccctcactgtctcaggtgccgagaggggcagggtgccaagcctccactggcatcagtgacgagtgcccagcgggttaccgagctccgaatcgtaca

SEQ ID NO: 585737 - DNA, 579 bp, Homo sapiens
taatatctttttttttatttaaaaaaaaagaaataataataaaaaaaaaaaaaaaaaataaaaaatgaaaaaaaaaacaaaaatataaagaaaaaaagaggacagggcaatgaaggatgggatgggggtagccaaagggtaaaggggggtaaaggaagagacaatggggacaaaaaggcaaagaagaagttacaaggaccaagttaaagggataaaaaaaatttttcaaaaatttgacaaaaaaggaaaaaatcttgacctaaacaaaaaagaaccaagaattagaggaagagaataaaaaatatatggagaaattaaaagtaataacgaaaaaagtacaaaatatataaaaatataaggcaaaacaatatggaaattaaatagtgggaatgaaaattaaaaagggaaacccaatgaaaaaaaaaaaaaggcaatgggaaacaaatttaaaattattgaaaaccggcataggaaatttccaaggatgaaaaaggtattccgacaaaagttaaaacgtaatacgagaccagaacaaataaaaagtaaaaactggggtgacaaaaggggaacctcaattaa

SEQ ID NO: 585738 - DNA, 1564 bp, Homo sapiens
tccctgtctgcctgcggagggggcggggtgcaggaacgcgcaactcctggccggaacttgtccggggtcgtgagcctggtccctgcacatttggtggcgcggctgccaccacattcgcgggtccaagagcgcaagaccgcaattcgaggttgggcgcatcgcgagtcatccaagggcaccggagccggggaaaggaacgggcgaccgggggatcataggccggacagcggaacacaccttccggagggcacaacggagcgcaggagacgaccagacaaaaacaccgcacaggagacagacaggcatagtagccccaccgcggagacatggcgaggggacacaccatacgtggacgaccggattattaaaaccagaggtgcatccacccaagaaggcctgaacagggccaccgcaaacccacagtgggccaaagcgagaccccggacacaccaacgcagacaaacccccccggagagggataggcacccagacaggataacgcgaaaggataggagcacccacagacgcccacggtcgggaaacaaaccgacacgcggaaacttaagaaaagaggtcccccccgcggcagaagcaaaacggcgcggcgccccccccaaagaacccgcaggaaaaaacactacacggaaacaaacaccaggaaacaacatgtagggaaacccacgcgcccacagggtgggcgacaaacgaacacaccgcaccctggagcgaacagccccaaagacggcgcaacaggcgaggatacaacaaggacacacagccaagaagaacggaaggaataaaacgcagcaaccacggcagcacacgaggacgcaagcgactacaaaagcggcaaacagacgcggccacaacacagcaccttgacaaagcaaacacaaaaagcacacggaccaccaagggaaagaccaaagggcatacgaggggaggaacacaggggcacaacagggaccacccataaaaggacggagatctcaacaccaagagtacaacacagaaacacccgggggaaaaaaatcccccacgacgagagcaccacgaagtaggtgtgaactcaccaaacgagaggcgcaaatacgagaaggccagaagatgatcaacccagggacaacacagaccgggcaaaaatgcaactagcatcaagagacacgccaccccatccgagagacgctcaaacaaaggcgccaaaaaaagaacaagccaagacacaacatattgaacataagacacacaatataacaacgcacacgagcgagaccagattccacaaaacaaaggtaacaaacagcgcgagacacaacacgccccgtgcccggggcaaaacaaaccaaacagcgggcggggtaacacacaaatcagagacgaccgccaagagagacgcgaaacaaagaagaagaccaaaacacaatgtgtggagccacgccgagagaaccaccatcgggcccgcgacaacaaaacgaactagcacgacaggacagagctgcaacaaaccgcggacggagatagtgtgtaaccaacaccgaacggcgcaaggcgagcaacagaacaa

SEQ ID NO: 585739 - DNA, 333 bp, Homo sapiens
gcttatcgagatcatctccaatgcagcagagtatgagaacatttccattccgcacatgagacatctctgaggcagttggctcagaaggtcccccacaagctgaaataaccctaagttcaatgatccgcacgtaaagaccaaccttctcctgcaggctcacattgtctcgcatgcagctagtcctgagttgcagtcagatacgaggggaatccctggtaaggcaatccgcctctccacggctccgtggagttctctcaccactagggggctcacccccctctgcagctattggacttgccccatggtaccacgcatgttgtcaagactatactg

SEQ ID NO: 585740 - DNA, 1055 bp, Homo sapiens
ggtgggcggccggtgagtcatggacggcgagtggacccttcagctgccccatctgcctagagccactccgggagccggtgacgctgccctgcggcacaacttctgtctcgcctgcctggtgcgcgctctggccgcatctgtggcgcgagtggagcctggcggaccctgtgaggcgcggcctgctgccctgctgtgccagtgagcccttccccgacgtgcttcagctccgcgaagaaccgacacgctgtccgagctgctgcagctcctgccagggctctgggccccgggtccctggcccggcccggccctggcccctggccccggagccctcggcacccagcgcgctgcccaggtgtcccggagccgtcggcgcccctgaggctcccgagccgtggcccgcgggcgaaggagccagtgcgctgcgacgcgttgccccgagggcgcgggcctgcccggcggagcttgtcccttgccgtcatccatggacgtcgaccattcattataggcccccaggagaagacttggggccccgaaacgaaagcggcagcacccggcacccatccgcgagaacaaacggacttggtgcccggacggattgggcctgggctaagagggaagaagccatgtgacacgggggcgcagcataaccgggccggcaccgaaggcggcctacaatagccggcagcgggaaaccggcagatgtttgtcgttgtggccgaagcgcgcttgcggccgacaaccatggaaagcacacggggagaccaccgaaggctaggatgcaccggattgcgaagccaggggaagccgccgcagccatacaaggagaagtgttggggcactcggggggtgaacgagtttggtggcttgaggaagtgccaaaaggttccttgaaggcggcggaggggagggaacggaaatgttgagcgaagcatgggttagattggggattgggacaggtgcgagggaagacagcaggaaggcgcataatagagaagttgaaggccggtaatcaagaggtggaaaaggaggataggcgagggagttattgaagaatg

SEQ ID NO: 585741 - DNA, 1068 bp, Homo sapiens
agcggggaaatggcgtatggtcaggtacgcagcttacaacaagctacgttagacttttctttctaaatatttgcaatattttccagttatcgtttaactactagcctttttttctcttgtctgtctcgtttcttctgtcttgacgacgagagtcgtcgacctccgtctgctcagtgctggaggtgcaactggttggtgacactcgggtcactggcatgctcctgccgtcgcggttccgggcgagtcttcctgccatcggactcctgggtcaagcgtgggacttaccatgagtgacaatgtgcacaccattgcgactgtgttaaatgtcgtatggtactacatcaagtaccgaagaaccggaaagtcttcgtcaacacgttaagagtaaacacgcctttcgaacatctttgcccaagattgaagtcataagaaagaagcctaggaaaaagccttacagtaacttttggtaaattagctgaataataatccaccaaatacataccgccagttagattcttcggacgtgggtgaaataaatacaagtcaaaattctgaagccgccttatatgcatgtgggaagaaaaaacaacgaagaaagaaacacaggttggaggacaacccaggtacacggacaaagattgcgtttacatattcaaccccggtgactccaattcgagacccaatcctttacatcgccaggataattcaattaccttgtgacatggatccaataacacgaaaggggacgtggatggtccattcagagattggtacaaaaagcaatgacaaggagaaaagcatgagcgcgaaaaggcacaagcaaagggaaaatcaacacacaccaagaataggaacacataaaggaacaaatgaccagtagagcagcaaagaagcaaacacgagccaggaagcaaaccgaagaatgaaggaccggagaacacaatgagatgataaggggaacaatggaataagatagaccaacaacgagaacacaacgaaaaaccacagagcggacacacatgcgtgaagatccacctcaggaagagcaaaaaaaagaaccaaggcaac

SEQ ID NO: 585742 - DNA, 819 bp, Homo sapiens
gtgaatagaaggatgaatcctaaggtgctcagaagcactgcagacagatcattatcatatttgcttccgtggcagtgtggcgagtcagctaaataactttggacgccggtggggaatagcgatgattactgtgtatgcggaagtcgagaatactgctcgctgctgtctacgtctattcctagctgtatagatactatggtgtgctcactagcgatagaaccccaagtgaagccaagttgatatcatagattcataacatacctatgtatccaaatggttctttgtgtacaccgggagtaattctagtaataagtatgtggagattattccgacatgccctggtatgggattagagacattatcaaagcttcgagcgtgtgagccgactagacatccggaactaaggttgtgagaggcatctgaacttgggtgcactgaactccttctcggttggacgcttcgagatgacgaaggcccagttgcatacgacgtgatctggcgcttgccaggttcctgtatcgcactgaactgatcggcactggactatcttcagatacttggggagtatcattgggtccccacagggtacaggagttgctgggagaaaatttcgggatcctgtggcccttcgcacgacatcagaagcgccacgtgcaaagctagttatgcgattggcccaggcgcgagggtgtgaacccctaactgccagctgttggaatgcagcattgaccccattaggttggcgcgccccaacacgtcactgggggaaacccctagtttgctgtggtcactgggaccagcagcgcagcaatggcgcca

SEQ ID NO: 585743 - DNA, 103 bp, Homo sapiens
ctagtatgcgtggctgtagtgcagtcctgggggcgagatgggggtagaaatgcattttattctttacgttcacgtaacgatacaagtcctggctacatcccag

SEQ ID NO: 585744 - DNA, 167 bp, Homo sapiens
tccggagtgtgcatttaagatgcaagcttcagagcctgaaaatgtctaaaattagaccccatgactgacaactggcctaggctcaatgtctatggaatgtgctctactaaatttgctaccatttgactgtgttccctccaaaattcaggtgtagggcgataacatca

SEQ ID NO: 585745 - DNA, 142 bp, Homo sapiens
ccccaaatatcttgttacagttagtgggcactggtctttgagaatcttctctggagacagctctctttggttccacaactctatccatccatcttgttgtgagccttgcattcatagctgcatccacccccccagcaaagaa

SEQ ID NO: 585746 - DNA, 314 bp, Homo sapiens
ctaaaatcagaattctgaaatatcactagcctcaagggtttcagataagggactgtggactgaaaatttggaggaaaaaataattgattttagctggcatctaatttatttttgttaaatttttgtgctttaaaataaaagtgacatacttaggtttttaaagtgagtttgaaataataggcattaactatggaagcatatataagtctaaattgaaacattcttcagaccaataactaatatatgatactttacattgttacaatttgggtcagaaacggagagatctgtgttaatttttgcagaacttactg

SEQ ID NO: 585747 - DNA, 194 bp, Homo sapiens
cactaccacgcccagctaatttttgtatgtgtagtagagacggggttttgcaatgttgaccaggctggtctcgaactcctgaactcaagtgatgcacctgcctcaacctcccaaagtgctgggattatgggcatgagcaccgtgcctggccttgctcccaaatttcaaagtccaagaactcctttgaacaattg

SEQ ID NO: 585748 - DNA, 107 bp, Homo sapiens
  misc_feature (11)..(11): n is a, c, g, or t
  misc_feature (70)..(70): n is a, c, g, or t
agcagatccgngccaccattgagcgggacggctatgcacagatcttgagggatctgggtggcattgtcgnggccaatgcttgtggcccctacattggccagtgggac

SEQ ID NO: 585749 - DNA, 1879 bp, Homo sapiens
  misc_feature (740)..(740): n is a, c, g, or t
  misc_feature (1525)..(1525): n is a, c, g, or t
cctattgttgactgttgctgctaggatggttagctgatgcagctcgtgactatgtgttggtgagtctagtatgtcgctgtcttgtgcatgttcgttcgctgctggtgcttgtgcctgcttgtctgtttctgctcgtccgtcgtagtggtgtggatggacgctatcgatcacatcctgttgtgtgctgtacaccactcgtgttggggtccaccatatgttgctcgttgggaggccccacacgggtggtgcaccgagaaacgccggcgttgtgtttaactgtcgccgcctctcgttttcttttatcacccggttcgtcttagaggtagtccgaaggctcctttggggggtcgcaattttccctgcatcacgaatggtgttgtgctcgcaccaccactgggccgcggtgtggggcccacgaacctccgcgccccccttgtcctgaaaaaggtccgggccatcaataaggggggagcgccccccacagaaaagaaaaaatgtggtgtgtgtaaacacccacaacgtttttctttaatagacaaggattttggtgttaaatcgagagatgtgggtgaagacgcgaaccccgtgcgctatatgtgttccccaaaatatataaaagagaaagatttattgttggggggaaatagaacccgcgctgttcgtgtggtctacacacaccgggggactcctccgatacgggggaaccgccgaacagaagttgttggcgactatctctcganatgtgggtgttttaccacaaaaggggttctcacttgtgttgtgtttgtagaaatgttgaagattttctcttcgccctcggaaatgttgtgccccacagagaatgttgaaattggaaacaagttggcaacatgtttttatagaaagtaaattttctcgcacagccttctgagtatttatcccgtcggggaagaaatgagttttctccaacagggcggtgttatataatctctcggcccccttcggagatcttataagacttggttcccacttcggccaccatggagagatttcttttattacccccgccgggagcacaccacaaaaattgggggggtttcccccacctcggggttacacaacaaaaaaatattggcgccacacaggcacacacatggaggagtttgagatgggcctcccacacgcgtttggaggagaggtgcccaaagagagctatacccgcagattgggttgtaaacatctggtgcgttttgcgtcctctgttgtctctgttgttttgggggtgtttatccctatataaaacacgcgccaccacaatctcacgagtatccgcgagaagacacctcttttatatgggctctcacgcgcaccccaccatggggtctccgcgcccagaatctccgcgagaagagaagaatgagatgggagaatctcatagtgacaccgctgagagagaggtggcgcagacgaccacaatagtgacacttgtgaaagagaagatggggtctcacatataaaagtatgtgatatctccagagaccagacncacttgtggatataagagacacatatagagaaatagagcgttttgtcccacatactttgatatgtgtatctggcttctcccatggatagtctttctcgttgagagaaaagatatataaatagctgtaagaaagccccacagatgttgtaattggggaagactctcatgggagcgcttctcatggtgtaagagccacgatagattctctgggaaagaccccctggggacagtagcacaccggtggcttaaattgtgtacgagctgatggatatggaccccccgtctccaggatctgtgtttaagattccagaaccttccaattagtggccacaattaaaagtgctatttgtgtgt

SEQ ID NO: 585750 - DNA, 120 bp, Homo sapiens
tgaagctgcatcatagggacatacattcattaggtattagctatctattatacattacgctatcaacatttatttatactagtgctcgggtagtagcaggtaaccacaaggatacttaat

SEQ ID NO: 585751 - DNA, 210 bp, Homo sapiens
ccttatttgagcatgctgaacagttgctgcctatgatgcgttgaaactctatgactggtacaatagtaggttacagtctatttatacctccagttaggttacagttcaccatgtacagagaaaccttcaggacaaacttaaaatatgtaaggaggcagttttcggctagaaggcagttttaacaaatctccccaatctgtcaatcataat

SEQ ID NO: 585752 - DNA, 391 bp, Homo sapiens
  misc_feature (6)..(6): n is a, c, g, or t
  misc_feature (18)..(18): n is a, c, g, or t
  misc_feature (41)..(41): n is a, c, g, or t
  misc_feature (81)..(81): n is a, c, g, or t
  misc_feature (85)..(85): n is a, c, g, or t
  misc_feature (95)..(95): n is a, c, g, or t
  misc_feature (155)..(155): n is a, c, g, or t
  misc_feature (159)..(160): n is a, c, g, or t
  misc_feature (165)..(165): n is a, c, g, or t
  misc_feature (170)..(170): n is a, c, g, or t
  misc_feature (175)..(175): n is a, c, g, or t
  misc_feature (177)..(177): n is a, c, g, or t
  misc_feature (182)..(182): n is a, c, g, or t
  misc_feature (184)..(184): n is a, c, g, or t
  misc_feature (190)..(190): n is a, c, g, or t
  misc_feature (193)..(193): n is a, c, g, or t
  misc_feature (200)..(200): n is a, c, g, or t
  misc_feature (205)..(205): n is a, c, g, or t
  misc_feature (213)..(213): n is a, c, g, or t
  misc_feature (215)..(215): n is a, c, g, or t
  misc_feature (240)..(240): n is a, c, g, or t
  misc_feature (254)..(254): n is a, c, g, or t
  misc_feature (264)..(264): n is a, c, g, or t
  misc_feature (275)..(275): n is a, c, g, or t
  misc_feature (286)..(286): n is a, c, g, or t
  misc_feature (292)..(292): n is a, c, g, or t
  misc_feature (305)..(305): n is a, c, g, or t
  misc_feature (311)..(311): n is a, c, g, or t
  misc_feature (318)..(318): n is a, c, g, or t
  misc_feature (321)..(321): n is a, c, g, or t
  misc_feature (339)..(339): n is a, c, g, or t
  misc_feature (350)..(350): n is a, c, g, or t
gagaancacgagctgtcnggaagatcacaagccagtcatgngtgaccagcgcgaccttatatccaacacatgagcaactgnccangctgggccgncgccctggggccccggagaggaagtgcagccgcggagccctgtacacaagcttttccatnctgnngactntggtnctcgntnggcangncaccancgnctacttnctgtnccagaagnanggcccgtggacctgacacggacctnccagaacctggagntggagaaccngcgcatgaagnttccaaggctnccaagnctgtgagcaagangcgcangggcacnccnctgttgatgcaagcgctntccattggagncctgtcccaagggcccatgcgctggcaccaagtatgtgctg

SEQ ID NO: 585753 - DNA, 855 bp, Homo sapiens
gcccggtgcgtgtgatgttgtccgctcggagcgggggactgcctctcgatggtgcgagtgtctggctgtggactgggcaaggaacgaacccggagagatcccaagccacgaggcaccggttccggcgcattgtgaggtcccacctttcccgccgactgaggtcgcggcggctgctctttccctggagcagcgtccctggaggcgctgtccagggggtgaggcagcccattgcgtgcaccgtatgtaccccccagagcggcgcttagaacgactcgcatgagtcgctgccttgggttggaaccggttactccgccgcattcgtactggactgcaaagtaagcacagtacttcgccgggcatgcggttgccgagcccgtgtgctacggcgagagtgtgcttagcctagagccgacgaaggacgatgtccccaggactccctttccctcccagattgcgtcccagcagatggagctttccgtctgtattaaccagcagtgtattcctgatgcctgaccaggcgctgaactattgtgtgaacgaatcaatgtgtagcgtaggactgacgacagtccgttgaattctggaagacgggctgatttagtatagtgaagcaaattgatgcacttggaacttcctgaccatgagctgaccttttataggaacatcaatggcaagtcaccggctggcatcttagcaaagcgtagacttggtcataactttccccttggactgtgctgccaagacccttagtcctatatcggggtgggaccttgaaagtcttaacgttctcgaccacccgtcggcgggaaggttctgagaaagggtcgaggccgagcctcttctctgatatgcccc

SEQ ID NO: 585754 - DNA, 153 bp, Homo sapiens
ggagagcacaaggtgctgtgtgctctcaccatgtggttggggagtctgaggccaatgtcagagaaatctttgacaaggacccgccaagctgccccctgtgtgctattcttgatgagctggattcgactgccaaggctcgtggaggtaacattc

SEQ ID NO: 585755 - DNA, 241 bp, Homo sapiens
  misc_feature (190)..(190): n is a, c, g, or t
  misc_feature (193)..(193): n is a, c, g, or t
  misc_feature (225)..(225): n is a, c, g, or t
  misc_feature (227)..(227): n is a, c, g, or t
  misc_feature (232)..(232): n is a, c, g, or t
acgctccctctcggcaaatccctgccagcaggatcggcaccgcgccgcgcagcacctgccagagcgggaagttccacggcatcaccgccagaatcggccccagcgggcgatattcgatgcgcgcacgctgcgcttcaacctgggtggcttcgctgccgagcatcagcgggccatattcggcgcatgtttnacnagatagctgttgcctgcccaggatttgccgangngggtnccgagctcg

SEQ ID NO: 585756 - DNA, 666 bp, Homo sapiens
aagcacaggcttacgagaaccgaataggaatgaccctcaaatcaaaatttctttgggggacaaatatcactccacattgaagttttacgatcctgaccaaccaaacaatgatccaatagaggaaaagtataggagattggaaagagcatctaaaaatgcaaacttggacaagcaagtgaagccggacattaaaaagagggactacttgaataaaatcatcaactacccccctggcactaaattaacagcacatgaaaagggttcaatatggaaatataggtattatttgatgaacaataaaaaagctcttacaaagttattacagagtacaaatttgagagaagaatcggaaagagtagaggttttagaactaatggactcatgggcagaaattgatatagacgacgcattagaactattaggctcaacttttaaaaacctttcagtgagatcgtacgccgtaaataggctgaagaaggcatcagacaaggagctggaattgtacttattacagttggtagaagctgtctgttttgagaacctgtccactttttccgacaaatctaacagtgaattcactattgtggatgccgtatcttcgcaaaagctttcgggtgattctatgttactatctacatcgcatgccaaccaaaaattattaaagtc

SEQ ID NO: 585757 - DNA, 116 bp, Homo sapiens
tgtgagctccttgatgatcactgaggatacgtcttcttttctttaatgattttttccatctggttgaaatactgacccattcggggcttggctttttcaaagctccaggtctttgc

SEQ ID NO: 585758 - DNA, 159 bp, Homo sapiens
  misc_feature (10)..(10): n is a, c, g, or t
cccccccacnccccttttcccctttaccttcccccgcctcctccttcttattctcccccccctcgcctcttccctctttattcccccccaatgcctctttccccttgatctccccccaccacacgctcttctccttgatctccccccaatgcctcttcc

SEQ ID NO: 585759 - DNA, 176 bp, Homo sapiens
  misc_feature (24)..(24): n is a, c, g, or t
ccttcttaagcgcggcgtccttanatctcaatattaggttagaaataaatttttagattagacggtcaaatcgcaaaaggtggttgacccctcgactttgaaagtgtccgaagtgttagaaaacgaatccactgacggtaaacattccgcggaatcgtcgtcggtaacgtcagaaa

SEQ ID NO: 585760 - DNA, 372 bp, Homo sapiens
  misc_feature (21)..(21): n is a, c, g, or t
ctgaataggtcaaaatccaanagtagtgaggttaggactttgacatgtgagttttggggagatgcagttcagcccatagcaactcccagagcccagcacaaagtgctgtttggagaaatccttcttctcccacctttggcctctgtccacagcatggaagtctgtgggctctgcacatgggttggaagaagaatttctggactcagatagggtgaaaagaaagaacagtttattgagaatagaaatgctgcaagtatagcaggatgacttcctgtcaatcagggagaaccaacgccaagcatgtggtcatgtctgtttgtataacccagggagaggagaggtctgacacacccactgacctgctgactggtt

SEQ ID NO: 585761 - DNA, 347 bp, Homo sapiens
  misc_feature (20)..(20): n is a, c, g, or t
atagtattgccttagttccnggactggattactgctgaagtcccctaggtcccatttgttcaaaccactgtttgtcaaactatgcccatggacccaaatcaggccaagcacctgtccttgtaagtaaagtttaattggaggcccaagtgcaggcgcggtggctcacacctataatcccagcactttgggaggcgaaggcagagaccagcctcaccatggtgaaaccctgtctctactacaaatacaaaaattagctgggcgtggtggcacatgcctgtgatcccagctactcgggagactgaggaaggagaatcgcttgaatccggaaggcgaaggttgcagtgagc

SEQ ID NO: 585762 - DNA, 682 bp, Homo sapiens
tggggtagaggctgggccggcacccccttctgacctccagtgccgccggcctcaagatcagacatggcccagaacttgaagtgacttgtgcgtgtgactggctgccctgccgtgtgccccgtgggctatggtgcactggccctgacagctgtatgctggtggtgcctggctgcctgtggctctactgtcgtgtgctgctgaactcttgttgttcacctgtgtgaagtgctgggcacatgagccaatcttacttcaatctggatctggttggagatgcatgcatggacaactatcctgtgcctgagtggccttcaacttcagtgatcccttgtgttccagtacccccattatctatgacattcgtggccagacctcgaaaaatctccatcccactacagtgctccagaagacactaccagatgtgtggaattatcatcccctgcagaggtgtatgtcatcgacgccaatgctcatggagcttccgtagcaatgtaccagcgcctagtgtgctggactacgagtgaacgagttgttgcctgtccatctgtcaacgagtgtgctcaaggagtgttggtggcacaaggtttcaaattgcctacgacaggcttggattcaaaacccccaaggctgggggggccccaaggggtaattccccttggtttgaatcccagccgggaagctg

SEQ ID NO: 585763 - DNA, 928 bp, Homo sapiens
aaaagctagtagaggctgggctagaatcggccgaggtgtgtgcttcatcgaggtgccacccctgagggcatattcctgcgtgtgcctactgccagctatgatcttgacctcttcaccatgacctggggccccactatgctgctctctcttatgtcttgacaaaagccttgaggagacaatcatccagaaagccatctcaggcttcaggaagtgcgccatgatctccgcccactatggcctcagcgatgtgttgacaatctcatcatctctctatgcaaattcacagctctcagcagtgagtctattgagaacctggcccaggtggatttgggagcgcaccctcatagcgcatatagtcggccaacgagaagtagttccaccagtgggccccgatcgttcatggtgacatcctgcgggagggctggaagaatatcctgggaggccatgctggcaggctccttccgaaggccccaaattaatggcccagggctatgatagaggtagaagatttcggggatcccaatgtggcaagatctctctacagcgggaagagacaccatcaaaccgaggagagtcaacagtgctgagctttgtgagctggctaacactgagtggtcctgagcagtctagtgttcggggccatccactgaaaaccaagaggccaagagagtggccttagagtgtataaagcaaatgtgacccagacaaaaatgatcacaggaaagcaagtttcctcccagctggagtccactacagggagctcatgaaggctctggtcttcagtgacaccagatgaagagactttgatgaggaagatgctgcttcctgcctaagagatgctggtaagcgtttgggtggggacccggatcgtgtggctgggtttggaattgtcgaacatttaaccacttggtttcggccagatttgtcc

SEQ ID NO: 585764 - DNA, 1438 bp, Homo sapiens
cccacggcgtacgcggacgcgtgggtcgagccacgcgtccggagatgtgatataggaacatgtctttaatagtaaagttagagatgtcattcataggcagctatggcgtatcattcggccacagagagacgataacgtgacaaatgtgagcacgctgtctgttactccatgcaggtcgaaagagtatagattgtatgtccctcaggtcactgggtttcctagaagtatcctgtagctccaacagtgaccacttgtgtaatctcgagtatgacggcgtgtcagaaggttacctatctctaagtgggatggagtcactactcaagcctggacgcagacttatgaccaatagacacttcacagcagcgcaaggccactgtgtcagccagagcctagtctcgacctgtgcgcaagtgctgagtctcgtgtgctcaatagaatttgcccgacctctgccagagagcgcccagtgacagcgactgacaagacttaaacactaagctctagcaattgtctgcagtgcaactcagtaagagcgccgagtacgagcgagcgagacgtgtctcgagccagtttatagaaggacagactgacctagcggtccagggcccaaattgcccgcctgggatggggcatccaaccgccccttgctgacacatcctccacggccagcttccctgggggcaagggccggactggctcgggcgccagcggaactccgaaccctgcgcgacgggctcccacgcggcagatctcccgaacgaaccgccgaagccccctgtggcgcacaaacacaatcacggtcgaaaacaacccccctggactcgtgcctaccttaactgcacgcaggacacacgacagacaccaaaaccgaagcgcgcgcagctgaccaccccgcagacgagcaaacccccccattcgcgatggggtcccccaccagacaccggttaacccgcgccgttcgacaccaagagagcaccctgcctgcggtccacacagccccactcgaggttccccctaaaatcaccggcgagaccatcgcgcagctgcaaaaggccaatagcgcccacaccgacacccgcccagctgccaccacaccacacgacaacggccggaccggcgcggcagacaagctgggcactcagcacccggcgcgcacccacacccagcgtgcagagcgagccacaccccaaactccctgcggagaacacctcacagacgacagcctacgggacaaccccccaacccctacgcacaccacaaacaccccacgccccacaacccccaccaccaataacaccacccccccacgccgcgcacacacacctccggcggcagcccccccccgcctcgccccaccgcgaccccagcccgccccgccaccacccgcccccccccacccgcggacgacacacctccgcacccacgatccacgccacgg

SEQ ID NO: 585765 - DNA, 839 bp, Homo sapiens
  misc_feature (261)..(261): n is a, c, g, or t
tgtcgcaagattttcctcgacgaaggggatgccaccggcactatggagagccctctccaaacctattccgcggtgcccgacattggtggtgcccaccaacagaccccttgtggcgggcccccccgtcttggcggacaatacgtcggttttgtatgcgtagacgccccccgacaggcggatagagtatcgttggccccaccacggggcgtacaatatcttctcgtggcggcgccacatctcttcattagcgtcggtctcacnttcagagatacacccggtgcgcttgaaccactctgggtcgcccccctgtcttgttggaatcagacgcaacaaatatccacgcttggggaaaggatattgttcgaaacagagtggttctccctcagtttcttatatgaagctgatttgaccaagtccggagagcaaagaaatgggagtatatatgtcctccacacttagtgggcatggccccaaggagtagatatcaagcgcagtgccgcggtatcagcaacaattcatttctcgcgcgcctgacacctcgacatatcagcgccaacagatagatatttctactaagaacgtgatctcacaaccgtaagaacagactacacagtgtgctctatgcgtgtaccagggcaccgcacataatgacagaataatgagtacaaactgctaacaagattctgcggtggacatctgaccccgcttcttgagcagtgaacgccgcgctcttctggcgggccaccgagtttgcgagcagccgcgcttatgacgccactccagaagttgttcaggtccatccttcaaaagaagaaaaaaccccaacacaacaaaacaca

SEQ ID NO: 585766 - DNA, 230 bp, Homo sapiens
cccttgagcagcatgggattgaagtgtgcaggcccactaatatgtggattttcttccacctctgacaaccctgagacagcaagaccaattgtcctcttctggttcctcatcctctacatgaagacaatgaggatgaagatctttatgatgatccggaaatgatggattacattcattctgtattttctttccggttacttggaatgtgactccagaggcaggacaagcag

SEQ ID NO: 585767 - DNA, 128 bp, Homo sapiens
caaagaacaaatgcgagaagataaagagaaagaacggcacagaagaaaaggcagaagaaattacaaagaggttagaagaacccgaagaactaaagtgctacaccagaagaacaattagcagatatact

SEQ ID NO: 585768 - DNA, 396 bp, Homo sapiens
taaaaaaaaaaaaaagagccaggcgcagtggctcacacctgtaatcccagcactttgggaggctgaggcaggaggattgcatgagattgggagtttgagacgagcctggaaaacagcaagacctcatttctactaaaaattttaaaaattagccgagcatggtgggggagggtgaagaaggaggatagcttgagcccaggagttagaggctatagtgagctatgatggcgccacttcagtctgagtaacagcaagacactattaaaaaaaaaaaaagagccaggcgcagtggctcacacctgtaatcccagcactttggtaggccagggtgggcagatcgcctgaggtcaggagtttgagaccagcctgacgaacatggagaaaccctgtctctac

SEQ ID NO: 585769 - DNA, 308 bp, Homo sapiens
atatttcagtcaactggactaacacacagaccacggtgtattccttacagaatgtttaaggttgcattatgcgtttctctgcatttacactgttgagattataagcaaaagtcccataatgatctgatgtgtctttagattcccccctccccaatccattctatatgtcaggttaattatttgatcattgcagtatcttagaatacatagcagatgcctctctgtcttttactgcataaagcccaagctatctgtaagactccaatctctccataattgttccggctattgaaacttctaaaactagg

SEQ ID NO: 585770 - DNA, 1061 bp, Homo sapiens
gctcgcagcagccggccggaccggggatggatgtagggcgccgggcccgccatcgccgtgtctcgtgggagcccagggtaaatggcagcagtaatgctaagcgctagcaagtaaactgacacgcgtgacgactggtctcaaagggtcccggacggcagccacacgggtccgaactcgaccctcggacagggtttctgtgacgcgaccaaacttgcatatgttaaacgacggttgccagcacacttgcaagcatcacatttcaccatgtgtcaccatgtcacacagtgccattattcctgcatcccaaaccacagcttccattgttgtacccagctcacaccagtcaaccccagcatgcagaggattacgatgagcaaggggttggcaacacatattccaggtgatggaacacttgaaagttgaccagatgcagtacaaacatggtggccatcccccaaaagatgaaaattgccgtgagcaaaagcatctgggggaagcacacaaaacatccacaagcagacacaggggagcaacatcatgtcctggcaggttgtatctggagcagcaaccaattcccaatatgcattgggagacttgagccttgggggctaccaccacaaagaacacaatttaacagggaatggtacagatatagagaggaattataaaaccataccaatgagaatttaccttgaactcctacaaggacaatacagggactggaatcacagcatgacagtattggaaaggctggaagaaagaactcaatatggagcgggaccaagcgacgggaacttacacggcaactacaacagggggcatgaacttacagttcaaaaccgtttactggccaagcacaggacgtccaccagggggacagacaagggcaggcgccccccgcgaaccagggagaaaagacagggaatgaacaccaacaccctgtacaccacacaacgcacacgtaaacacccaccacaaacccggaaacctcaaagcgatcgcgtgccacagcccacggagagatggcgccccgcgacggcacacagaatgaccgaacagcg

SEQ ID NO: 585771 - DNA, 151 bp, Homo sapiens
ctaacactcagcacttgggaactccctggcaatgcttttcaggcactggaaaacacattaacttctcgggtggttaaccattccttctgcagtctgaccatgcagttaaattgcttatgtatctttgtaatagagtgtgtccaactccaga

SEQ ID NO: 585772 - DNA, 386 bp, Homo sapiens
  misc_feature (90)..(90): n is a, c, g, or t
  misc_feature (109)..(109): n is a, c, g, or t
  misc_feature (113)..(115): n is a, c, g, or t
  misc_feature (301)..(302): n is a, c, g, or t
tcttttgcacatgtggcaggttctgaagttagacacacttggttcaaaccttagctctgccatttactaggtaggtgaccctgaggaagntacttatttatttttttancggnnntgtagtgccacaataatattgcttaacaaacaacttcagcacctcagtggcatacagcaataaacatttatttttgctcaagagtctaggggttggctgggtggttctgctgaacctggctgggctcccttatacttctgtggtcagctggggagtcagctgggggctggctggttgaagatgatnncagatagaatgattaatatatgatacgtgagcgtttatatatattaggatagtaaagtgtttttaattgagggaaagaggaatt

SEQ ID NO: 585773 - DNA, 161 bp, Homo sapiens
gaccactgcagagtaaagatgattctgaagaatggcatgagatggatcctatcgaactgcacttgagcagcggtcatccacccacagggccaatgagctgaagcctggatctaccatgaaagatctctgaatccaggaagagagactgaactgagcaacat

SEQ ID NO: 585774 - DNA, 110 bp, Homo sapiens
gatcgagctggtacccagcatccctaacagccaggcgatatagtgagacaccatctctacgaactgtaagaagtaagggaaggaggagaatacctggttggggatgctgt

SEQ ID NO: 585775 - DNA, 982 bp, Homo sapiens
  misc_feature (809)..(809): n is a, c, g, or t
aggcagcaagcaatgcggtctcccacaggcagttaaacagttcctcgtcaattttctgcttagtaggaacagcaacttgcaagcaaggcacaaacacaggcagtcaggcgcacggtacaagttcagctgtgggccattgcaagcatgcatgcacagcatctttgctactttcacacatggttggcaccaggccatgcatatcatttgggcacaccaaagtgcaccatacattatttgcatacacaccaagcacatcataatcagacctagcaaaagatcagccacattgtagtgtaccttctaaaaatcacccacaggcacagcatcccaatcacagtccgagatatcatgcattctttgctacaaccacacaacacatatccacaattcatagcaaacctgtgcaaatcaaaacataaaattacacaagatgggtgcattgggtttgggcatagctctctgtgccagacgatcaaccacaagacgtctcagctaacacactttgtgcacactacatcatatcatttatgcatgcccatttacacaacatgtataagttaacgtatgcgaacaagtcaggcctacaaaagacactgggtcttcgatttgcatttggtccccaaatagagcaaaaacaatcattagcacaaggcatattcactcaactaaggtcctaaatctcttagatagtgtggaactataagaagcgatatttaacataacaacgcacaacactagtaaacaagatttaataacacggactggcgcacgatcgatcgcatatcaaacatatgggatatgttttatancattttcagctaccatacgacccatattcatatagccattccaagtggatataaactgggatcaccttagcactgtacactaaattatttccagttcaatatggtcatcataataagttaaccatccaatctttaccaggtatacacagagaaggcaaccatttacccatcag

SEQ ID NO: 585776 - DNA, 146 bp, Homo sapiens
gccatcatgaacgcaccgtaactatacgcactagaagttaatgaacaaacgactacttcagaggagacaaatggtcattgatgtactacccccggggaggcgcaagtaactaagcacggaattagggcaaaacgtgccccatgtcc

SEQ ID NO: 585777 - DNA, 168 bp, Homo sapiens
cgacgaagggagtactcgcgctttgtctccctatccacacttgagcaaatgctcgctggtctactgccaaaacccatttcaccaaccatatgtccctcgcccataccccctctccctctcaaaccctggggacaaattcaaggacccaggggtgcccttttaaaaaaa

SEQ ID NO: 585778 - DNA, 160 bp, Homo sapiens
  misc_feature (2)..(2): n is a, c, g, or t
tncttacgcacacggtggatatgaggtcagagttggtaggctggggagggtacacgctgagcccgtacaaagggtgatggacatggcaccacatgtgccaggcaagggcctgcgccacagggcgcaggggagggcattcaggtgggagtcatgagctgtc

SEQ ID NO: 585779 - DNA, 979 bp, Homo sapiens
aattttcatatctgttatttatttctatcagcatgccctatgatttccgtcccgatttctgtcagtgtgatagtgttttgaactccgacactagcctgggtccattgctaacgccttagtcctagtactttgggaaccacttaagcaggtgatcacctgggccaggacttcgtagatcctgcctggccaacatggcgaatccctgtctacttacaattctatgattggctgggcatgctagcttgttgcctgtagtcccagctgtcctggggggtttgtaagcagtgaggatcatttgagcctgggagccagcatggttgcagtgagctgagatctcaccatctgcactccagccctgggtcaacagtatgtcgagactctgtctcggacacttactacctagagtcctgaacatgattgtggaagtgtgcttgctctttcaagttctatcactttttgtttgcaaagttcaaagctgtaattgtttggtacatataccatgtaggtttgccaagtctttgtggtgaattgactcttctgtcattatcgtgactgtcatttttttgccttttaatagtcttgctcaatactttacctgatgttctcatagtgactcctgcatattttgaattaatgtattgcatggttaatatttcttcattttattttaaagcttacctgtatcattacttatgaagtcagtttctttgaacagcatatacctcaggccatgctttttttaattcattccgcatatgtctctcttaaattggtaatgttgaaatgatttacattaaaataattaattgatattttagggaattaagtgtgcccttaaatgatttttgtgttcttttttaattgttcatctgtataatttggggttgtttactagtcttcctaataaggattacttcacctttttttttttaataatttgatttgataatatatagtgtctttgttagtatagatcctt

SEQ ID NO: 585780 - DNA, 292 bp, Homo sapiens
  misc_feature (237)..(237): n is a, c, g, or t
acgtgtaaggatctgtgggcagtgtctcgtgtacctgccagggtcttttccctcaaccccctggggcaggtccgaggcagcctctcatcagagaaggatacacggggggggaagctaccgcccagctaccactcccttcttaacacagcaagttccccatacatgctgccaggaggtcatgaaaataaatccatagcattaagaccagcttgctgaccatggacggaggctgtctcncctgccacaccggtgtttggggtctatggctctgccaggggtgtgtacagggacc

SEQ ID NO: 585781 - DNA, 1072 bp, Homo sapiens
gatttgttggagtaaccggatgtcctagcgatgtactccaaaaatagtgatgttcatcgattgatattgggggaggctccgaaaggactgaggatatgtgactacagaagactcagccacgaaacagagctcataagcaagaatgactcgaatgtgagctatgcagatggacgactgactagtcggtacaatgcacagatagcgaggaactactatggcacaagtccgtggcagagcaagtacacagagccatcaatgaccagacaaatcagcagcagtggacctttggttcgcttctttgaagcatcttggactagttgccatgaacattgggacgagatctagtacctggagagagattttcttgaagtccggcagagttgtttcaaaaagcctcttccgtgatgagtcccgaaggtcaagcatattgcgactggtttaccaaacaccgttgggtcatagataatgtcagttagtttctccagtttgttattgttctgaactgtacattcacgaacgttatgtttctttgagattcaatagatagtggggggaaaaaaggccgttgatcaggaaaattatatgtgaaagtgagacagttgattggcatagatttcgttgtgtagaagtgctgccatccacttactataggtccttccaggaactcaaacactgtaagtgaaatatgggagtatagttcttattatttcttcttttccgtttgtcctcagtaagtatactgcagttgttcaggaaatcacgcacaaagcctgatagtactttactaaaatgactgcatactttggattccttcagtctatggttcaaagtcacgtaacagattcgttgaggttgagtccttatgagaaacagcagtatgactctgacggttctgccgtcctaatggcagagctctctgactggggtgtattgctggcaggctgggtacttcataccttgatgtcttgtgtggtttaaactatgaatcaggataatttttccccatacatttttcacattgttcccttaggaccctatcactccccttaaatggtgcaccagcggtaataac

SEQ ID NO: 585782 - DNA, 611 bp, Homo sapiens
agcgggcggccgtggtctccggcgtcggcgggggcagcagacagctgaggcagcagctgaggcagccgcgacggccgcgcgcacacacgcggagaacctgggatgtaggcgcagaggacacacgatggacgaacgacgcaccagaggccgggagcagacgaaggagagaagatgacaccgaaaacagcagagacgagaaagccagcacacaagccacacaaaagcacacaaagtagcaacaaccgaacacacagacacagacgagaaaaacccacaacggaacaaacaccgaccgagacggcgcgggcgccggaacggagacacggccgacgacgaggcgacgaaagacgaccacagcaaggcggagccaacgagagaacagacggacacggaaaacagaccacacaaccagaaccggcgtgcgaccacagcgccacacggccgacaggcacaacacgaccaacagacgaaccacaaaagaccaaaaacccggacacaaccccacgacgccgcccggacccacacgcaaccaccgaacaccagccaccacgaagccccgcacaacacgccacatccgagcatcgcgccacaaacagaaaccaggacgccaa

SEQ ID NO: 585783 - DNA, 735 bp, Homo sapiens
ggatgtgtctgatatcttgtcatatgacattgttccatattatgctgcggtagcatggcatcgacactggtagtattcgctgttgtaacgcacgtgtgtctcaggtgaaatacaggcgactggatggtaccaatgtccaaatttcctgctctgctgcttaactaatcgaaaagcaacagtggggatcaacatcaacttggattcgtccttttacaagtccacctctcacgagaagaaataatggcaaataactttttccttggatgagtcataagcatatcactgactgaacattcttagtatgccatgtagaaatatcattttcactttaggaaaggccttctagatgtaaatctcatcagtgccagttcacaacatctggggatttgaatgctgtaacatgtgacttggaagaaagatggtgaacaacttgagaataacttatcttgtcagtgctacaggaagcaccttggtatacccaatacaggttcaccatcattaatagcaaacaaatgggaagtctattcttggtttctttcgagaggaaaaggaaccccggggaacatttaatttcaaagtccctgaacttcatgggaaaaacaagccattgatctcttacgtaggggattctactgtcttgacatgttacatgttccacattgttttcctttaaaattggacctggtacagtagtaatgggagttgtaaaggttctggtgggtgttcaaatgaata

SEQ ID NO: 585784 - DNA, 100 bp, Homo sapiens
atgtcgtatctgttcatatattgaaagtttgtggcaaccctgtctctactaaaaatacaaaaaaattagcctgggcaacatggggagattttgcctcaaa

SEQ ID NO: 585785 - DNA, 1011 bp, Homo sapiens
  misc_feature (68)..(69): n is a, c, g, or t
  misc_feature (76)..(76): n is a, c, g, or t
gcaatgctggtggactacgcgcgcagcgtgcacgaggagttttgagcgcccggccgcgccccgggccnncccccangcaccaccggggcggcctcgcgggtgactccgggctccgtggctgtcccgggaccccacctcttccctgccggcccggccaccgggccgaccggaccggcggttgccccaagttgatgagccggcgtgtccccttctgcagcgcgcaccccgggcgggggctttgcgctgtgacgcgggtcgggggctgcggggctggggcttgtggccccgggggcgccggcttcctcccctggtcccttcgaaatcggtggcatctcacttcgtgagaaccgaaatctcgcttcagtcactctgccgaagggcgctgagggcatcgcggccggaacctctgggccgggcccctcccagggccgccggctccggtggggacaaaaacaggctcctccaatttccttggaaaaactggaccgattattagcaattaggattaaccttcggctgggaattgcgagtagccagggaagctccaggggcgaggggtgccgggggtcctttcccggggcctgggctgtgtcgggagccacccaggtcccggcagcttgccggttgcagaactttgcaattatttggtggtgaccagggaattcactttacattttacgtttaacatttatggttggcctttttttgggggctcaaaaactaacaaaacaaaacactaaaacacaaaacagaaaccaaaaaaaacactggggagccaaataaaagggagggggtgggtacaaaacagagcgggttaataaaaatagaggggcacaagagtgtggcaaaaatagagatgatgtgcagagagagagcacagtttttttgtgtgaacaaaggggggtgaaaaactcaggggggggggacccacaaaaagagggagagggggagaaaaatgtaaaaaagaggggtacgataggaagagagaaataaaagagaaaaagcagagga

SEQ ID NO: 585786 - DNA, 662 bp, Homo sapiens
  misc_feature (112)..(112): n is a, c, g, or t
ttcatcgtcttccatcacagcacagatcacagagcatcgctgctgcgcacattcagtctcatcggcttcgagattgtgagatcaggtcatcccctcgtcccaaccatgcccngaggctttcttcatggcttacagaatcgaaagagactccgatggtgacgaataagactcctcaatcgcatcttgcttcttataactatgctgtttctcacccaacatggtcaccattaaaagaaacatagtatgaatgtcaaattgaccttttttcctgttatttactacattgtagttcttgtaagggttgtgctgtatttttcagttgtatttgcactagtgtataccaaattttcacagtgaccattagtttttaagccatcggccttgggcttactttccaatgtaattggattctttgctgattcccattccctcactcaccaattttagagcataatatttatggttggaatcccttaagcaacaatgtatgtagaattatggttttcattgctgatatgttgattctttttactgttgtcttcaagttgttttgtttctaaatctgtgcatgagttttggagtttttagttattacttcaataggatcggtctgcatgtttgctacagtgtgcagaataaaaatgctccccctacactaaaga

SEQ ID NO: 585787 - DNA, 437 bp, Homo sapiens
tgaaacctgggaaatgaaaccaaaacaaaacccaaaatccttgatgctctaccctctgggacccctcttcctgcctcccttccctattttataatttcctctggggcacttttcaccatctaatatatgtcttaacacacctaatatttctctaatcagtcgggcttatcgcctgttacctcaactacaaggtctgtggcttggagccagtactttacctgtgtcttccatgttctacaccctaggaatgtgcctgggaaatagtgttgcttgatacctccttgttgaatggggaacatgaacacatgcatggactcagacaagcaatggcagacggtgggaggacatgtgcccagggaatatgggcagggagtcgatggggaacagtgctgataaccacggccccttcagtgtctgtgtccttgtctcactgctgt

SEQ ID NO: 585788 - DNA, 290 bp, Homo sapiens
gtatgttatcgcccaacacagaatgatcttggcttgggtaagttttcctgcttgtgtaatttttgataaataagacgttaatactgttttaatgaaaacagttaaatattgaattatttagtaaaataaccatatatttaatcttaaggtttctactcacctaaatatctgaaattcacaggctataaaatggttgacagggaaataactttacatgatgactcacagttttcataaataatgcaggtaaactattagtataaaataattaggtgttggggataacatca

SEQ ID NO: 585789 - DNA, 235 bp, Homo sapiens
  misc_feature (12)..(12): n is a, c, g, or t
  misc_feature (36)..(36): n is a, c, g, or t
  misc_feature (75)..(75): n is a, c, g, or t
  misc_feature (144)..(144): n is a, c, g, or t
  misc_feature (156)..(156): n is a, c, g, or t
  misc_feature (224)..(224): n is a, c, g, or t
cctcgtgcaggnagggtgctgggaacggcaaggcgntctgggggatggggaggggcaaaggtgagagatcacctnccctatcctccaccttcccgcaggagtgccgaagccaggtgccagggctggggtcgggacacccatgtnctgggcggcttnaccccaaatcccagaccccggaagctccaggatcgggatgtgtcctgagcacctgtcccggccccctnctctccagcct

SEQ ID NO: 585790 - DNA, 666 bp, Homo sapiens
  misc_feature (487)..(487): n is a, c, g, or t
agcagtgtctcacacctctaattccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgggaggtagagcttgcagtgagctgagatagcaccactgcactccagcctgggtgacagagcgaaactccgtctcaaaaagaggcagcagaatcactagaagctgcgaggcaaaggttgcagtgagctgagattgtcccagngccctcctgcgcaacatgagcgaaactctgtctcacaaaacataaacacgaccaagccaattttcccattaaacatgtcattaaggacaatacgtagcaccatattataaactaagcgctcctttgtttgctgcatcgaattctgttcagcgccccctttattatacgctttcaccccc

SEQ ID NO: 585791 - DNA, 123 bp, Homo sapiens
ggaacagcactttacctttgccaacaattttgtgtggccttcaaacgtaattggtactttattttggtcatttttactagtggcttctcgttcccaatgggacatttttgcttgttcccgctg

SEQ ID NO: 585792 - DNA, 962 bp, Homo sapiens
  misc_feature (7)..(7): n is a, c, g, or t
  misc_feature (109)..(109): n is a, c, g, or t
  misc_feature (205)..(205): n is a, c, g, or t
  misc_feature (275)..(275): n is a, c, g, or t
  misc_feature (316)..(316): n is a, c, g, or t
  misc_feature (341)..(341): n is a, c, g, or t
  misc_feature (356)..(356): n is a, c, g, or t
  misc_feature (380)..(380): n is a, c, g, or t
  misc_feature (391)..(391): n is a, c, g, or t
  misc_feature (463)..(464): n is a, c, g, or t
  misc_feature (468)..(468): n is a, c, g, or t
  misc_feature (478)..(478): n is a, c, g, or t
  misc_feature (480)..(480): n is a, c, g, or t
  misc_feature (536)..(536): n is a, c, g, or t
  misc_feature (549)..(549): n is a, c, g, or t
  misc_feature (582)..(582): n is a, c, g, or t
  misc_feature (594)..(594): n is a, c, g, or t
  misc_feature (623)..(623): n is a, c, g, or t
  misc_feature (691)..(691): n is a, c, g, or t
  misc_feature (694)..(694): n is a, c, g, or t
  misc_feature (696)..(696): n is a, c, g, or t
  misc_feature (699)..(699): n is a, c, g, or t
  misc_feature (701)..(701): n is a, c, g, or t
  misc_feature (708)..(708): n is a, c, g, or t
  misc_feature (720)..(720): n is a, c, g, or t
  misc_feature (723)..(723): n is a, c, g, or t
  misc_feature (726)..(726): n is a, c, g, or t
  misc_feature (728)..(730): n is a, c, g, or t
  misc_feature (739)..(739): n is a, c, g, or t
  misc_feature (741)..(742): n is a, c, g, or t
  misc_feature (744)..(744): n is a, c, g, or t
  misc_feature (760)..(760): n is a, c, g, or t
  misc_feature (765)..(765): n is a, c, g, or t
  misc_feature (769)..(769): n is a, c, g, or t
  misc_feature (781)..(781): n is a, c, g, or t
  misc_feature (790)..(790): n is a, c, g, or t
  misc_feature (799)..(800): n is a, c, g, or t
  misc_feature (807)..(807): n is a, c, g, or t
  misc_feature (813)..(813): n is a, c, g, or t
  misc_feature (837)..(837): n is a, c, g, or t
  misc_feature (873)..(873): n is a, c, g, or t
  misc_feature (894)..(894): n is a, c, g, or t
aagtctngggcctgactataggagccagagagagccagggccaggggccaaagaggaagctgctgggatctctggccctgcaggaagaggaagaggaggcgagcatggnccccagtgcccctgagccagcctccagaggatgagctggataggctgacgaagaagctggttcacgacatgaacccacccgcccagcggggagtantttggccagtgtggtggctgcggagaagatgtggttggggatggggctggggttgtggcccttgatcgcntctttcacgtgggctgctttgtgtgttctacatgccgggcnccagttcgcggccagaatttttacnccgtggagaggaggncatattgcgagggctgctacgtgnccaccctgganaaatgtgccacgtgctcccagcccatcctggaccggatctgcgggctatggggaaggcctaccaccctggcnncatnacctgcgtgntntgtcaccgcggcttcgacggcatccccttcacagtggatgctacgagccagatccnctgcattgagaantttcacaggaagtttgccccaagatgctcagtntgcggtgggcanataatgcctgagccaggtcaggaggagantgtgagaattgttgctctggatcgaagttttcacattggctgttacaagtgcgaggagtgtgggctgntgntntcntntgagggngagtgtcagggntgntancnnntggatgggnanntnttgtgcaaggcctgcngcgcntggngcatccaggagntttcagccnccgtcaccnntgactgntgagtnttcctagaagtacctgctgggttntcagttccagttcccatcctttgattgatcactctncctgacatccacctgtatgantttgtcacccaatgctgtcttttctttttcccatcaagaaattataatccctcgagtttaccaaacca

SEQ ID NO: 585793 - DNA, 195 bp, Homo sapiens
  misc_feature (195)..(195): n is a, c, g, or t
ggtcactctagaggatctcatcccggttctgggtagatacaacctgcaaaggattgaaccataagaaatgcaaaacctgagcagaacgatgagaagtaatgagactgaagatatatttaaaagtatcccagcaaagaaaagccagagacctgatggtttcactgctgaatatttttttaaggagatggagtctcn

SEQ ID NO: 585794 - DNA, 482 bp, Homo sapiens
cagcagagctttgtcgtcaccaggggtccaggccaggagagtgggcttggcaggtggtcatcataaggaaaagtctcagtttggactaattctctctctccctgtaaaaagtaggccaatgacaccaaaaaagctccaacaaaatatctggagacaaagcaacacatcagtggtgtaggcacttcaaacagtaccagtgattatagctggtcagtaatgtaattggcaacgatccttggaagggtcaatggatgcaagcacagctgtgcttaggtgcacctgtgtttcaggtcctaagagcttgggcatgctgaggcctgctctggctcaggtgagcagcagcagtccgtaatggagcacttgcgtgccagagcattgtgggcaaaatcttggacattcaagatcggagcaaaacttgcttgcgggctctgggggccaacagcttggagcttaggtgctggggccccaatggaaaaagctgt

SEQ ID NO: 585795 - DNA, 635 bp, Homo sapiens
gccgccgccgcctctcctcctccggcagccgcggcagcaggagcggcagcgccgtggccccacccacctctgtcggctccggctgcggctccagcctcgactattattttatttattatgggtcgtgcacaagcctcagtgcctgcagtccggcctcctcgggccgggggcctcctcccttggctccggagccccagaaccggtcatcctcgattcgagaaccccagacccctgcagctgccgcgagtctccgctgctggaatcttgttagcggctgtcttttaggagggttctggtttccgcgacatttttgttatccagcccaggagaggatactcgtgattttcccacccttgagcccaggctcgtgctctctggggaggggtgcgggggcgctccaagccggggaagcccgtgccagacgagtcgtgcgggctgtggaagcggaaggggccaccatgggatgtactctgagcgcagaggagagagccgacctcgagcggagcaaggcgattgacacaaaacctcaaagaggatggcatcagcgccgccaaaagacgtgaaatatactccattgctcggggcctggagaactcaggaacacaagcaccatgtgtgaagcagcatgaacgatc

SEQ ID NO: 585796 - DNA, 934 bp, Homo sapiens
tgtcgcgacatgatggtggatgtcgatacaatcctgggttgtccgagtcctgtgaatgtcactttctggcataaatgtaatatccacactttagtgatgtccacaggaaacgcaaactcatgttacttactacgctttgctattcaaattgactcacgtctaatgtcccttcaatgggcacatacgagtgagaccgattccctctacgttcagcgaggtatttgtggccctactggtgctattgggtagctacttaggactgtcctgggggacgaatatggttggtcacacacaccctttggaaggcattggagtgcttcacaaggataattactagtgacctcatatctggtgttgattaaaatattgaccattattgccacactttctgatccccattgtgttggtacctgggggccaccagactttcttgttacctgggattgtggacgcttgaggagataaaaaggatttaaatcgcgacgagtagtacacacacacagcagatgtggtcatcaagcctcaatctgcgaccgagacttgggaaaccaaaaaatacatttgataacgaggatagtcttggtgtcgaaaagattccccaatgccaaattgcttcaaaatagtccaagggtaaagcatggagttgaaacacttttcatttcatgtttcacatctgaaagtgcagaactattagaagttcttctagaatattgaagaaaataagggctgttggagagaacgtagtgaggaaatgcctaacgaggaaagcatttatctgtaaaatggcgggggacatcttttggaaggaaaggattagattccttaatactttggaagtatgagtctgggtggtcctatcacgcctttggttacttggggtggaacaagttaacaaaccagtttttttgtgacatggtttcaaaggcctgccacg

SEQ ID NO: 585797 - DNA, 281 bp, Homo sapiens
tgtctctgcactaggtggcaccttgcaaaccagatggtgagagttagttagtttgacatagagtctggagggcagtaccagtagccaaggtgtttcttccagccttccttggtctttcttcttacccacctggaggactttaacacaagtaccctttccaaccaaagagaagcaagctttagagtccaagccgtgccactaacacttaaatgtgagtgcttagaactgtaatcctttgggtcagacttctccttgcctcaaataaaaacttgcttttgtga

SEQ ID NO: 585798 - DNA, 898 bp, Homo sapiens
ggatggtcttgatctcttgacctcgtgatccgcccacctcagcttcccaaagtgctgggaggattacaggcatgagccaccacgcctggccagtagtatttcatttttagatatgtgataatttaaccagtaccctactgatgaaaatttacagaatagaaacactccaacctggaaagattttactaaaatactgtaataactatccttacaaatctttgcttcctagaagcaagtcttctagaaatctttgcttcctagaagcaagtcttctagaaatctttgcttcctagaagcaagtcttctagaaatctttgcttcctagaagcaagtcttctagaaatctttgctttaaatatacatgtttacaatttagatattgtcaaattgctgcttccaaaaagatataggaatgaacatccactattgggaagagtagatttctcctacccttgccaaaactgattatcatcaatccttacaacatttgccagaggaatcctattttcgtgtttttcttttaggtgttttagaccatatcagaacttttggttgttttgagacagggtctcacactgtcactcaggctggagtacagtggcatggtcacagctcattgcaggctgtcaacctcccaggctcaaacgatcctcccacttgagcctccttagtagcggagaccacagatgtatgcgcaccacgtgtggctaattttcgtatttttcttgtagagatgggatttcagcatgttgcctgggctggtctcaaactcctgggctcaagaatccgcccgccttgcctcccaaagtgtggggattacaggcgtgaccacaaaccaagctcttcaagttttatgccgggcaaatcttagcttccacgttatggctcacttatgtac

SEQ ID NO: 585799 - DNA, 1034 bp, Homo sapiens
tcctccctgtcgcccaccgaggtcgcacgcttgaaatttctccgccgaaaacgccgccgcgaattgcgctacgttcgccttccttacctgtgctgtggctgtgcccttagggggcaacttccttcccccagcgccagaggacttcaagaagatcttggacagcggtgggttactcgaggcggacgacagaccggctctaaacagggttactcagtggcagtctggatatggggcacaaaaaactattggacagcactgtctattggcccgagggttattgcggcaatgtctttgccatgttgtcaccttgctgggtgggggttttgtacgccgttcttctggtctggccccgggtcttctggaagccccttgctgttgctgtggttctctgtgcccccgtgtctgtgccaccaaagagagtgccagacaaaacacagagatatgccagaacacaaagagtggagagagagtatcttggaagagaagtttcgagatagtgaagtggcacctgttgggaacttctgggcgccatatatggaggcaatatcaacattccccgtgggtcccccccctgtggacaaaatttataaagggcccttttttttaacacacacactttctaaagcgaaaaaacaaaaaaacaaaaagataaaaaaagagagatcagactaatcgagagaagagagatctaaaatatatctagacgtagggggtgacgctgtgaacaaaaaacaagacgcggcgggtaaacctgaaaaaagatgtagtcaaacattgtggggtcataaaaaaaaagtatgatatattcactaatcaaagcacccccaagcagatcatattaatttggttgaacaaaacacaacgagggttgctacaacagatacttattgcgagcgcgatattcttccccacactaatatagtaggagcagggagagagcgctaatatatataaaaatctttcattaacagaaaaagcaaacgcccacaagggtgttaatcaaccacccacagaatgactatatacaaagaggg

SEQ ID NO: 585800 - DNA, 121 bp, Homo sapiens
cagtacacttgggacaggtaggtgagggtcggcgggccgcagtgtgccgggaagagcattgctggggtgcaacactgagaggcaggaaccacacggcgaggctaggacgggtaccgagctc

SEQ ID NO: 585801 - DNA, 532 bp, Homo sapiens
ttagcccagagaattatatgctagcactttttaaatatatactacttctatgaaactgaagagctcagcaagtttggttcaagtctagctgctagcggtgggcaccatatgcagtgttttatgacttctcatgagtctggtctccttacaaaccctaagtgtgtggtcctgagctgatttacatatcctacttcaaccagagaaacttcttgctaatgagaactagcctaggtagctttagtcctgaatctaatcacatggaaatatattcttgatccatgactgtattgtcaacatatccccatttgcatagtatgatccacttgagagctgagttgtcggcaatatttttaaaatcgccctgaatcatgtgttaattcacactcactaacagcatatgcttgcattaatagcacccgtctgttcaacatcataatcttctaatggtgtctgtaatataaaacttctcttccaaatataagtttcgacttaaagtcagctccttagtatatcccttaccgatggaaagacg

SEQ ID NO: 585802 - DNA, 149 bp, Homo sapiens
tatctatatctagtccataatactaccttgccagagcactgctagtaccagagaatgcccagtcaatattcactgctatacactgataacgattattctgcgttatctagtgactcctaatgtgcacacataaaaatctaataactacc

SEQ ID NO: 585803 - DNA, 632 bp, Homo sapiens
  misc_feature (29)..(29): n is a, c, g, or t
gctggccccctgcatgttagtaacaacangagtcggatctccttcaactaatgcacaggaaacgtcacccatttctgcccatgactgcactctaggtctagagggcactgcaagacataccgattcgtctgtcaatgtagagacacaatatctgatcatgctgggacttgtaaacgacatcaatccgtggatagactgggttgcatacaactccgaaagacatgtcgttgagacagcaaagtaccggacttactctcgagcatcatgcaactctcatgacacgcaaagcagggggtggaaggctgatctgctgtaatggcgaacgcgagtcacacagagctgcatctggaccaacattatcttctctgataaccagcgctgtactacaccagcggatttcatatgggcagcaatatatgcctttatagagtctcagtgtctggagagagttcacaccacaggaagacactaaagtgtatgtagctggtcaaagacttcgcattgtgcatgcacaatggcaagtagcatttcctggtactgctgggcacatattagatatgaatccattggtacaagaactaacagatcttggctactctcaaattgagggaatgattgaacctgcatccagg

SEQ ID NO: 585804 - DNA, 380 bp, Homo sapiens
gccatactggctcacacttcttttgtacagacacaggtcctttttgccaaaccaaaataggtttagacgtcaaaccctattttcaacacacttctcccaagaggaggacacattctatacaaccatgataccattcccacattaagaaaattcttcctttaagggttcaaatatttgcctggttagtatagccatggtttacatgtcttcagacttaagtgtaggcatacaggctatattcacatttccctgtgtctcaaaaacgtgcattatgccttctacactctcacctccaatcacaaagtccaacaaaagatcacatggaatacagctaataggtctatagtcttcccatagtctggcacagtctcactgtttcc

SEQ ID NO: 585805 - DNA, 1896 bp, Homo sapiens
gcacgaattcgcggccgcagaaaatgtccctttttattccatacgcaaataagtagattcatttaaaaaaacaacaacccggaggctgcaacgtctgcagagagccccagcctgcctgctcctggaacggacgatgggacccacaggtccagggtcctttctccaccagcacccgcgagaggggtagcacagccctccgggccggcctgctgtctgggtcccaggaaagggacgtttagtgttgggggcagtctgtggggacagtcaccgctcagccttggacagccggttcgtagttttcctttgttgcgctgggcttggcctgagggcagctgccccgggtggccatggccgaccgctcctcgctgaggccggggggtggccgtggcgccgggggctgcgcagcccagagtctctgcatggccccctgttcgagtggggatccagcctggcaaatgggtggggcgtcccattacattctagaggcgctccccacaggagctgaggcccgcccggccgcggcctgcgctcccgaggtatctaggaggccgcaggagcgaccatcccttccctaacgccccctgagccctgcgcctgccgctgaatcgcgcgtccacacaggtccacagggtcgtggggagagggcccggcaggcggggctcacaccaggccaggcatctgcgcccgcagaaagggcacggaggcggcggccgggaaggcggccagcgggtaggcgagggccccggagaagccgagcagcggtgggggcggcgcgggcgcggcgggcgccagcgggaagggcagggtggccgggggcccagcggcggccgcggccggggggctttcgtggtagagcaccggcacgcggaccaggcgtgcgctcccggcggggacaggctggccgcctccagctcggctgccacgtgccgcttccacttgttgcggcggttctggaaccagatcttaacctgcgtctcggtgagctgcagggaggcggccaggccggcgcgctcggccgtgctcaggtagcgcttcaggtcgaaggtggattccagctggaagacctggctgcgggagaagactgtgcgcgtcttcttctttcggccgccgcccacgccaacgccgccgcgtgtctccccagccgccgcagggacctcggccagctccgagcctcctccgtgccggccgccgggccacgcgccgccagctccgctgcctcccgctgcaccgctccggcccgggcctcgcggccaggcgccctccgcacggcccatctcctcgcccgtctccggtgagtcccggtcgctggtgtcaggactgaggccgcctccatagccaccgtgcgcccgtgggtaccagcggcctgcgcctccgcagcccagagcgaagggcggcccgggaccggggggcggccgaggaccgaggcccagcgcgcccgcccgagcaggcacggcccgcgcctccccgccgggcccggtgcccgcgagcaactgtcgccgccgctgtagccgtcgccgccggcctgctcggcgtcctcgtcttcggggtcgtcgtcgtcctcctcctcgtcctcccggctgccgtcgccctgggtcgcgccctgcgcccttggcctcggccgccagcaggttctcgatgaggaaggaggaggcgcgggccggcgtggcgcgcccgggctccgtcagctcgtcaggcatcgcggccgcgggcttctcgggctcggccgggctcctcggtccgctggggatggtgggcgcggctcccggcgcacgcgcgggccggccctggagctgctacccggaccgctggcgtcggcgcccgcagggcaggcggcggcctccgcgccgggctgggctgggccgggccgggagcgagtgcgcgccgacagctgatcgg

SEQ ID NO: 585806 - DNA, 437 bp, Homo sapiens
tgtccactagccgggctacggagacgggtaacggtttccgagcatttggcttcagcacacactcgctgtgaaaccaccgatccccaacctcccttccgaggcgtgcccctcccagccttggggcggggtatccaggtccgtccccgcacctcagtcttggttctgtaagacttagaatctggacctttctgttcctcagtttccccataatgagggcctacactatgcggtctgcgagtgttcccatgccgtatcactccccctactttgtatccagtgatagccacctgctaacagacccttatcaccgccgccactagggcggggctaagggcgcgaccaagagggcgccgagcatcctctgcttcctccccctcctgtgtcctgccctctactgcgcggatcctccgtggtccgggaacccccccgctctgggt

SEQ ID NO: 585807 - DNA, 400 bp, Homo sapiens
  misc_feature (348)..(348): n is a, c, g, or t
  misc_feature (385)..(385): n is a, c, g, or t
  misc_feature (391)..(391): n is a, c, g, or t
gccacgaggtgagatggaaaggatcacctggaactccaggagtttcgagttcccagtcttgcccaatattagttgagaccctgttctctaaaaattgaaaaaaaaatggaaccaggctgggcgcaagtggctccatgcctgtaatcccagcactttgggaggctgaggcaggcggatcagatgaagccgggagttcgagaccagcctgggcaacatggcaaaaccccatctctactaaaaaatacaaaaattagcaggcacgatggcgggcccctgtaatcccagctacttgggaggctgaggcaggagaatcgcttgaacccgggaggcggagtttgcagtgagccnagagtcgcgccactgcactctagcttgggcaacacangcgaantccgtctca

SEQ ID NO: 585808 - DNA, 795 bp, Homo sapiens
gcacgaattcgcggccgcagaaaatgtccctttttattccatacgcaaataagtagattcatttaaaaaaacaacaacccggaggctgcaacgtctgcagagagccccagcctgcctgctcctggaacggacgatgggacccacaggtccagggtcctttctccaccagcacccgcgagaggggtagcacagccctccgggccggcctgctgtctgggtcccaggaaagggacgtttagtgttgggggcagtctgtggggacagtcaccgctcagccttggacagccggttcgtagttttcctttgttgcgctgggcttggcctgagggcagctgccccgggtggccatggccgaccgctcctcgctgaggccggggggtggccgtggcgccgggggctgcgcagcccagagtctctgcatggccccctgttcgagtggggatccagcctggcaaatgggtggggcgtcccattacattctagaggcgctccccacaggagctgaggcccgcccggccgcggcctgcgctcccgaggtatctaggaggccgcaggagcgaccatcccttccctaacgccccctgagccctgcgcctgccgctgaatcgcgcgtccacacaggtccacagggtcgtggggagagggcccggcaggcggggctcacaccaggccaggcatctgcgcccgcagaaagggcacggaggcggcggcctcactgggggcggggagggggaggggccagcaggggcggggggtcgcgggctgggccgggagggcggcccgctgagccccgag

SEQ ID NO: 585809 - DNA, 707 bp, Homo sapiens
ctgcggcctcctccgccatccagaggctcccactgtcacttctgttaactttgtatttatcagctttggtcacctgcccctctccacactgcacaggctgaggtgtaatcttctgtgtgctgtcaggactgaggccgcctccatagccaccgtgcgcccgtgggtaccagcggcctgcgcctccgcagcccagagcgaagggcggcccgggaccggggggcggccgaggaccgaggcccagcgcgcccgcccgagcaggcacggcccgcgcctccccgccgggcccggtgcccgcgagcaactgtcgccgccgctgtagccgtcgccgccggcctgctcggcgtcctcgtcttcggggtcgtcgtcgtcctcctcctcgtcctcccggctgccgtcgccctgggtcgcgccctgcgcccttggcctcggccgccagcaggttctcgatgaggaaggaggaggcgcgggccggcgtggcgcgcccgggctccgtcagctcgtcaggcatcgcggccgcgggcttctcgggctcggccgggctcctcggtccgctggggatggtgggcgcggctcccggcgcacgcgcgggccggccctggagctgctacccggaccgctggcgtcggcgcccgcagggcaggcggcggcctccgcgccgggctgggctgggccgggccgggagcgagtgcgcgccgacagctgatcgg

SEQ ID NO: 585810 - DNA, 1548 bp, Homo sapiens
gcacgaattcgcggccgcagaaaatgtccctttttattccatacgcaaataagtagattcatttaaaaaaacaacaacccggaggctgcaacgtctgcagagagccccagcctgcctgctcctggaacggacgatgggacccacaggtccagggtcctttctccaccagcacccgcgagaggggtagcacagccctccgggccggcctgctgtctgggtcccaggaaagggacgtttagtgttgggggcagtctgtggggacagtcaccgctcagccttggacagccggttcgtagttttcctttgttgcgctgggcttggcctgagggcagctgccccgggtggccatggccgaccgctcctcgctgaggccggggggtggccgtggcgccgggggctgcgcagcccagagtctctgcatggcgcgggcgcggcgggcgccagcgggaagggcagggtggccgggggcccagcggcggccgcggccggggggctttcgtggtagagcaccggcacgcggaccaggcgtgcgctcccggcggggacaggctggccgcctccagctcggctgccacgtgccgcttccacttgttgcggcggttctggaaccagatcttaacctgcgtctcggtgagctgcagggaggcggccaggccggcgcgctcggccgtgctcaggtagcgcttcaggtcgaaggtggattccagctggaagacctggctgcgggagaagactgtgcgcgtcttcttctttcggccgccgcccacgccaacgccgccgcgtgtctccccagccgccgcagggacctcggccagctccgagcctcctccgtgccggccgccgggccacgcgccgccagctccgctgcctcccgctgcaccgctccggcccgggcctcgcggccaggcgccctccgcacggcccatctcctcgcccgtctccggtgagtcccggtcgctggtgtcaggactgaggccgcctccatagccaccgtgcgcccgtgggtaccagcggcctgcgcctccgcagcccagagcgaagggcggcccgggaccggggggcggccgaggaccgaggcccagcgcgcccgcccgagcaggcacggcccgcgcctccccgccgggcccggtgcccgcgagcaactgtcgccgccgctgtagccgtcgccgccggcctgctcggcgtcctcgtcttcggggtcgtcgtcgtcctcctcctcgtcctcccggctgccgtcgccctgggtcgcgccctgcgcccttggcctcggccgccagcaggttctcgatgaggaaggaggaggcgcgggccggcgtggcgcgcccgggctccgtcagctcgtcaggcatcgcggccgcgggcttctcgggctcggccgggctcctcggtccgctggggatggtgggcgcggctcccggcgcacgcgcgggccggccctggagctgctacccggaccgctggcgtcggcgcccgcagggcaggcggcggcctccgcgccgggctgggctgggccgggccgggagcgagtgcgcgccgacagctgatcgg

SEQ ID NO: 585811 - DNA, 199 bp, Homo sapiens
ctagaggatccctcgcgcacccgactgtcaaccaccaccccaactcgcggaggtcgatgagagctgacaacatcctgcaaacgattggcaacacgccccatgtgcgcatcaaccgcctgttcggcgccggtgccaatgtgtggatcaagtccgagcgtggcaaccccggcggggttaccgagtctctacattcgttaat

SEQ ID NO: 585812 - DNA, 425 bp, Homo sapiens
agagactgttatttcttaggagtggccctgggcgacagagcgagactgtcttaaaaaaacaaacaacaacaacaaaaaaaccccaaaaacttctttactcagaagtaccctcctttgcattggagatacatgtaaagagttgcttagcagttgaataactcaaaattgcattttggaagcttgctaagtgacaagaccttcttgtatccttttgtgaacccccaaaatatgagacaggcctcagttaatttagaaagttaattttgccaaagttgaggacacgcgtccatgacatagcctcaggaggtcttgtagacatgtgcccaaggtgatcagggcactgttggactctgggcactgtttggactctgggcactgtttggactctgggcactgtttggactctgggcactgtttggactctg

SEQ ID NO: 585813 - DNA, 197 bp, Homo sapiens
acaatgaggtaaaattatgacgctgcttccacatgtttacttcgtaagatgatgcataggagtgaaaaatcatgagatgctggaatgatggacaatagtaagcactatacactccttcccttacctgacagccagtgtgggccaggctccactctacacatacttcacaccctgcccttgctcccagtatttccatt

SEQ ID NO: 585814 - DNA, 183 bp, Homo sapiens
agtgaggacaaagcatagttgatgacgtagtgtctaagcggtcgaaatcaaccatgagcagcatggtgaaaccccagtctcgtactaaaaatacaaagattggctgatcatgggggcgggatcctgtggtcccagctacttgggaggcttaggcacttgaatgagaatcacttggacccagga

SEQ ID NO: 585815 - DNA, 1046 bp, Homo sapiens
  misc_feature (1)..(1): n is a, c, g, or t
  misc_feature (33)..(33): n is a, c, g, or t
naccagtacaaatagataagagacacgtgtcanccaaaacataccgattatcctcgcccgtcgcccagctgcgtgcgctgcctgcacgccccgcgtcgtatgtgggaaggtgtctccgctggcgcataagctgccggcgcgcgtcgaggtggtggcccgcgccggggaggtattcacaaaccggcggttccgcaaacagaagcctttctcggagggcgacaccccctttttcgggcagggtgccccacgccgtggcaatattccaatggcgccccgtccccccatcggggtgaaaagagcgcgcccgcgtgaaaaacagtgagggccaaaatcgcctgtgtgttagacatgtcgtctcgttggggtggcacgacaatttatatattacccgccgtgtcttcagtgagcacaaagaccttcccgagggcaccacggtctggtgcagtatggggactcaccggctttgtgggggcggagcaccccctgttactggcccaaacccacgagtctggtgtttctattaagcatgggtgagacaatcgtcggctgagaacccccgttggtgccagcgtgtacaccgctggtccaagaacctgctccttttactggtgccttcatggcgctcactagcctcctacttcttcgccacgcccctgataaactgttccgcccaagctatcgccaccctggtgatgcccatgagggttcccgcgtgatgtacgcgcctgacgtctactgccctcgtcccccagaacatgttctggataactctataatcacacgtggaaaactccgtgtgttccctgaagataagttccaagaaaattttcgagaggcagggcgtgaatcacacagcgtgcgaccaccaaaaatgtctagggttacaaaaatctttaagaccaagaaagtcaccacggcactttattttacagtggctcacaattccttaatatccccctatgttgctgggtgggacaactggccaggcgtgggtcggctcccccggctaaaaaattcaccccaccccttttgcggcaacaaaaaca

SEQ ID NO: 585816 - DNA, 700 bp, Homo sapiens
  misc_feature (435)..(435): n is a, c, g, or t
  misc_feature (439)..(439): n is a, c, g, or t
  misc_feature (471)..(471): n is a, c, g, or t
  misc_feature (607)..(607): n is a, c, g, or t
  misc_feature (630)..(630): n is a, c, g, or t
tcccccggactgcatttattcggcacgagctttgaagccttctttggaaacgggagtatcgtcacataaaaatagacagaagtattcccagaaacttctttgtgatttgtgcattcaactcacagagttgaagcttctttttgatagagcagttttgaaacaccctttttgcacaatctgcaggaggatatttggagctctttgagtgctacattggaaacgggaatatcgtcacctgaaaactagaaagaagcattctctgaaaccactttgtgatgtgtgcattcatctcacagagttgaaccttccttttgatagagcagttttgaaaccctctttttgtacaatctgcaagtggataattggagcaaattgaagccttctttggaaatgggaatatcttaaatctattaggcagaagcattctcagctacnttgngatgtgtgcattcaactcacagaattgccttncttttgatacagcagtttgaaacactctttgtttagaatctgcaagtggatatttggagcacatttacgcctgtggtagaaaaggaaatatcttcacataaaaactagacgggagcattcttagaaacgaatttgngtgtgtgcattctactcccatangtgaaaattttttttgatagagcagtcttggcactcttgttctacttgctgacattttgagcgctttggg

SEQ ID NO: 585817 - DNA, 950 bp, Homo sapiens
  misc_feature (423)..(423): n is a, c, g, or t
  misc_feature (629)..(629): n is a, c, g, or t
  misc_feature (660)..(660): n is a, c, g, or t
  misc_feature (687)..(687): n is a, c, g, or t
  misc_feature (715)..(715): n is a, c, g, or t
gcgagcggggcgtacgaggctgacggcggtcagcaggaggatgattctggagaaggagaggatgatgcggagggttcagcaaggaatgcactgcgataaattgtaccaccgcggtgatgatatgcattggaacacctccagtcgttcagacagctctgacagcagcgtattaccatggcatgggagggatcgtccgaggagcacatgtatactccgagcgtcgtgtatctcgaaaagctagcacactgctgtgggccagcagacgtagtagaaggcctgcgtggaccgatgctggggtcgatgtacagcaccagtgtgattaggagacctagatgcaagatgcttcacgttgtagaaggctggtgagcgagagatcaacttgtgccaagggagctcgaggctcgcattcagagaaacattgtntgtagagaccacgcgccggcacatagtcgacgcacttgcgtaacattcttctgacgttgaatgaaaggcgacggaagaaccgcacggatgcggtggccatggcatgagcataggagtggagtctagcaaacactaagcaacacacgttcgggctgaggaaggcctgcgtctgtgttagatatatagacctaggggctaggaggagncggcgcattcaacacgaaccatggtagtgcntgactacgccgttgcaaccttatgcancactgactgtgagaggtgccttaatccntctctcgtacatgacgagatgaggattacactacgtgtgtgcgaacgactactacatcagagagtgggtcggtaccccaccgacgtgcaagtcgcggacgatgtcaagtctataaacacaagatggatctgcgtacagacaagagaacgattgcagttgaccagcggaacgcattcgctcgtcgaagacgttcagctaaactgttcactgaggaacgtggagcaggtgaacgcac

SEQ ID NO: 585818 - DNA, 90 bp, Homo sapiens
tggtaatggcttacaacgctgactcttccctcctggctcaagaattactccgaagttagtctgcagaaaataaatatttagtatgacatg

SEQ ID NO: 585819 - DNA, 1626 bp, Homo sapiens
  misc_feature (1626)..(1626): n is a, c, g, or t
ggctccttagtagcagtacaaccaacttcagggaagacaattttacgcaaaaatataatgtatagcgctgagtaggagagattgagaacctggcctgcagatagcatagtatgtagcgcgtcgacagggcatggacggatggatgaattatatagcactaccatgcagtcactatacgcatagggtaagcttgaaccgcgccttactacgcgttcgtgcaattaggagtgagagtgtgaagctgagaagagtaagcatgtgtgccacacgggagacgcctaaatgtcatgaggatcccttccgaaagacggctatcatctgaggactagcgcataagaggaacacgatgtcctcatgagacttgcacgataatcaatcccccagttacgtaagtcggtcaagccatatagagagtaaggtttggggggcaaagaagtgtctaaatatggggctaatgaagggggcccgaaagcgagagatccccatgaggcgcgcacgaccactagcgttggtactgacgcccttggggttcgcctctgcaaaaggcaaagtaccgttataggtcttgtcacgttttcccgaaaaatgatcttgtctaagaggaaatgtcttgtgcccctctaggcggacaggaaggatcccccagtgccattcatagactgcacctgcggcggtattggataacaaacctgttgtttaaaaggcttgggaatttcgaaggatgcgcaaagaaaattgcaaagggaaaaagccggatgcgttgcggtcctctagggaaacaccaacgtcaagggtggacacactggagatggcctattgggggttagggccaacgtcagggtggcgggttatatgaccaccacagttgtttttaggaaacgatgccccccgaaaatcacgggttaaggaggcctccggtctaaaagagcagggggccacatgtttcccacagccctggaactccttgtgtacaacggcaacaatgagatagggcgaggttatctaccgacagacagggcggctttcagagagagggccagtgggcctcctagaccgactaaagtcgcgggttaaagcggcaagacgcagcagctttcttgcgccgagtaaagacctacatttctaacataaaagtggtgcggcaccaccgctgttccccgtttcccaatcggaagcgcctgccagaaaccgtacgtgaggggaacccccaagtaccttcacttccacgttacgaagcaccccctttaatgtttagtgtggacagaacggaaaaaaccgtcacatatggtaggatggccacacggttccatgggtcacacaggtgtcgtaagaatgggaaccatctgggcacacaccacgagcaacagagattattcccccttgctgagattactccggcggtcacactttataaccgggccgccaattgaggggggagacatcggacggcacattttgtactaataggaatcgaccccactcggaggttgcacttggggtactccaagagtgtcagaagaccatataagcgcactccaagaaagatagggtaccgtggagacacagcgcaggtgccaaacatacccgtcaaaaacacgcctataggaggggatcgcacaccctcan

SEQ ID NO: 585820 - DNA, 197 bp, Homo sapiens
  misc_feature (196)..(196): n is a, c, g, or t
ttttcatctaaaggagagaggcaggctcagctcctgaaggtcgcagagcctcagtagtcctcctgagtgcgtctaactaactaccatcaaaaaacaaacaaaaaaaacatcacaaaactgaactgccgccatcaccactacaccaagtatgtgattgaattattcaatgatctgttttcgcggtagtgaccaacanc

SEQ ID NO: 585821 - DNA, 156 bp, Homo sapiens
ggcgcctagaggagcgttatacacctatacacctgatacaccgggaactacatactttagaaagagctctgtcacatggctagaacaacaacaacaacaaagaaaacccacaaaaaaccgggagaaaatatatctaaatctctgataggtctctta

SEQ ID NO: 585822 - DNA, 1108 bp, Homo sapiens
aaatttagctagtagaggccggtgtaatcggagaggtcaatcaactgttaatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagtaaggataatctttaacattggcagtttagttcctggtaaattaaaaaggtttatccccattaaaaa

SEQ ID NO: 585823 - DNA, 973 bp, Homo sapiens
aaatttagctagtagaggccggtgtaatcggagaggtcaatcaactgttaatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggtgatgttgagtaggaaaaaatgttattttatgtttttataaattatagtgatttttgctcatgtaaattttttatatatggttacatgtataggtgatacagtctagaaattatatttatttctttgatttttaagttgtaaaatgtatgttacaataaattattaaaagataaaaaaa

SEQ ID NO: 585824 - DNA, 443 bp, Homo sapiens
cggacagagtggtatacccatcatgcgctgttgcaccggatcatgggcagcaacgtcaagatgggcatcctgtcctacatgatgcggcaggagctctgtgggtcaccgaggaagtaactgaaggccgtctcattccatgtccaccacgtatggccgggacttcgtgcaggaagaaatccgtgtctccaaccacactatctaaccatcacagacccctttgctatcacttcacggtcccagcctggtgcaaatgtgtgcatacggccctgtgtactgccaggcactgtgcctgtgggtgcctgtgggtgtttacacacatgcctacaggtatgcctgattgtgtgtgtgtgcatggcgtgtcccgccccctgtctcccctatgtgtcttcctggccctgtctcccactctgtgtgcctgcccctctgtacgtgctgccagtgac

SEQ ID NO: 585825 - DNA, 112 bp, Homo sapiens
gcagatcatttatattgctccgttgagatgtggcgagtcagttaaatactttgacgccggctggggatagcgatgattatggtcgtggatgtccaatctactcctgtggatc

SEQ ID NO: 585826 - DNA, 103 bp, Homo sapiens
cccctgtcctttggggggttttttttttctttgttgctttaaaattccatccaaaaaagttgttgcctgtaggggaaataaagttaattccattttgtgttta

SEQ ID NO: 585827 - DNA, 124 bp, Homo sapiens
cgtaccccgggcgggctgggagttgtttatggatagtcaagcaatagtcaagctgatgagatggacagaatgaagaaggaatacacagactgtgttgttaccctgtctgcttttgcaacggaag

SEQ ID NO: 585828 - DNA, 926 bp, Homo sapiens
  misc_feature (221)..(221): n is a, c, g, or t
gcatctgtcttgctattccccgagctccccggccatcccctgtgcgggtcgtggccgcggtgcagctctgggcttcgatggccgtcgatggttgtgcctggccgtacgcggagacgcctgagtgcgctggcgctgcgccgcgcgagaagctgtgggctgcggcttgtactgatcaacacgcccccgggagaccacagagaacgggcggaaactggtggctnggggtgcctgtccccggtgatgacaggctggccttccgagagggacttggagcaggccgtgcggtatgccaaagccctgtggctgtcccagggtaccccgttccagccattcccatcccttgtgaccccagttgaccctgactgcgcgtgtacccgggcagctcgaggagcgccgggactcgttgagcacgggctctagacagtttcgtgaaggccccacttggtattattcttcatggccatcgtggcgtgtcctggttcccgtatacaggctgcagaagtatagcgcggagacccgggaagttatgcgaagtcggttcgtatcggtaacattggcacaagcgtcaatcgtaagctagccgaagcatcctatataccactttgcgttcaatctccctcaattgccgtcgggaagttccccaacattggcttttagagaaaggccttccacgtccacgttgcccgataatggggcaccgcaagttcaagtggaagccagtcgttcgcgaccagattatatagccgaaggagtggctcagcccatgtctgtgatcggcgcagcgagggcgctcccttattatacgctaacgtggagctggcctttaggtagggcgaacgtcgaggcggggcttaggggaacccttgacaagccccccttgtgcctatcgcgaggtccatatcgacgccaccccggccatgccttta

SEQ ID NO: 585829 - DNA, 182 bp, Homo sapiens
ccggtcttctggcatacctggacttctggcatacctggacttctggcatacctggaccttctggcatacctggaccttctggaagacatggattttctgcataatgaattaactagaaatagctttggctctccttgcaaagttatttctagttaattcattatgcagaaggtccaggtatg

SEQ ID NO: 585830 - DNA, 118 bp, Homo sapiens
caccgtctgctattcatcggcacctcgtctattcatcggcacctcgctattcatctggcacctcgctattcatcggcccctcgctattcatctggcaccagacttgccctccaatgga

SEQ ID NO: 585831 - DNA, 566 bp, Homo sapiens
atatccaacacccctggcacagagtcaagtatgttttaagctctgatggcttaacaatatccccagtcatttgcttctacattcacgcatatgcaaaaatatgctggcctccaaggacttagattcaaccccaaagtatactaggctctcactacagttgaaaaaaatgacttaaaagtatctcctcttacagcgtatcaggcatgaagcatccaaaggcagttttcttgcaatacagacattcttaagaactcatggtgatctcacactaaatgggatacataagttcaccaggatgaaaaaaaaaataaaccctcctattagaagaaaaggactagtaaccattgaaaaaaatacctgggtatttacacaacataacttgcttcatccacatttggagggggggagctaaaccgaaaggtctagaattcagtccaagaaccccccttgggaaaaacacacccaaacacacagaccccctttcttttatattctcgggaaaaccttatggatctatttggagaataaagaggttaatttcccccagaaaatattaaaattccccc

SEQ ID NO: 585832 - DNA, 1269 bp, Homo sapiens
tcgcatgaggcgccctctcagactaaattgtttgtattcccccccccttgccttgtttgcctcctttatacaagggggggcccctttttcctcgtctctctctctttggtgtgactcttctccctcgtcgtctaagccaccacatgggtggtggttctgtattcacttttctccctctctccactctacattagcggtcgctctctctcttcgtactgtgaggggcggccctcttttgtttgtgctcccaaagcagcctaccctccttgtgtgtccccctatattgatgccccccacctcggttgtgggtggcgccgcccgagttgtgttttttcctccactcgcggtggtagttgtccgcacacaacattgtctgctccggtgggctcccctgtctactgatactgcacgcaccgatcgctgtgtggtctcccccattaggcgcgctttttgtagttacccgcggcgggaatattctctccctctgtgtgttttatctcccccccccacagaaagtgtttgttttttcttttcccccccgcgagtgtttttttttggaggccctctgttgtgtctcacgctcaccccgcgcgctagggcgccgctcgtgcccccccctctcatatagagggggccgctctgtggcgccctccaccacgcggtttttcttcccccccctctttttatattctcccctctcgagaggtgtccccacctctctctgttaacacactctctctgcttgttattctctctcctctctctcgcgcgtgtgtgttcccactctcacccgcgggggtgttcgccacctctctgttcttatatatgtataacacacccccccgcgcgtccccctccattatattttctacgcacacctctcgctctatattaccacacttctgtgttctcgcggtgttttctatttttctacctctctcctctccgaagcctctctccgcggtgtcttctgtggtttcccctcttccccctctttctccgcgcggcgtctctttcgcgcggcacacacactctcttttgttagaccccccgcggttttccccgcggttttccccgccctcttttggggcccacactcttttcccccattgggttcttccccccccaagatttccctctttcatcccccccactcccctcttgggtttcggagccccccccctggttttgggcctctttttgagagagatggggtgttgtggcttttttttgtgtttgtgttcccctcttttttggggggggttttta

SEQ ID NO: 585833 - DNA, 471 bp, Homo sapiens
  misc_feature (13)..(13): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (34)..(34): n is a, c, g, or t
  misc_feature (37)..(37): n is a, c, g, or t
  misc_feature (55)..(57): n is a, c, g, or t
  misc_feature (60)..(60): n is a, c, g, or t
  misc_feature (64)..(65): n is a, c, g, or t
  misc_feature (68)..(68): n is a, c, g, or t
  misc_feature (82)..(82): n is a, c, g, or t
  misc_feature (86)..(86): n is a, c, g, or t
  misc_feature (304)..(304): n is a, c, g, or t
  misc_feature (321)..(321): n is a, c, g, or t
  misc_feature (384)..(384): n is a, c, g, or t
gtagctgggattncagncncntgccaccacaccnggntaattttttagtagagannnggntttnnccntgttggccaggctngtcntgaactcctgatctcaagtgatctgcccacctcagcctctcaaagtgctgggattacaggcatgaaccaccacacctggcctcatgtgagcaccatgattttcagattatttgtccatcgcgtagagattctctgtgacattattgaaagacggtgattatgaggttttaaatatgtttattatgactatgtgatacctatgttgcataatgatttgnagaatgtttaatctggntctgtaaacaatgggtaacccggcattgtataagcaggactttagggcacactcggaaaacancttacttctttcccccactgtccgttctattaataatgcactcactgaagctccttgcttttggataaaatccagggcaagtctcac

SEQ ID NO: 585834 - DNA, 329 bp, Homo sapiens
atgaaaaactctaatgtttatatatttcataaaaatttctgtaaattcggccgggtgcggttgctcacgcctgtaatcccagcacttttggaggccgctgcgggcggattcacgaggtcaggagattcgagaccacggtgaaaccccgtctctactatataaatacataaataattagccgggcgcggtggcgggcgcctgtagtcccagctactcaggaggctgaggcaggagaattggcgtgaacccgggaggcggagcttgcagtgagctgagattcgcgccagtgcactgcagcctgggtgacagagcgagactccgtctcaaaa

SEQ ID NO: 585835 - DNA, 423 bp, Homo sapiens
aacgggtgatgcggttgccgcagcgagccgagatcacgccattgcactccagcctgggcgacaaagcgagacctgcgtcaactttttttttgaggcaggtctcgctctgtcacccaggctttacacacaggtctcgctctgtcactttgggaggctggaacaggaggattgcctgaggccaggaattcaagaccagcctgggcaacatgggaacacctgagcctccggagcagctaggaccacaggcatgtgccaccaaacccgactaatttttttgtatttaaaaaaaatttttgaggccgggtagggtggctcacgcctacaatcccagcactttgggaggtcgaggcgggcggatcacaaggtcaggagatcaagaccatcctggccaacacggtgaaaccccgtctccaccaaaaatac

SEQ ID NO: 585836 - DNA, 267 bp, Homo sapiens
tcgcgagcagattacaccatgctgaggctgaggaccagatacaccatgctgaggctgaggaccagatacaccatgctgaggctgaggaccagatacaccatgctgaggctgaggatcagatacaccatgctgaggctgaggaccagatacaccatgctgaggctgaggatcacatacaccatgctgaggctgaggaccagatacaccatgctgaggctgaggaccagatacaccatgctgaggctgaggaccagataccatgctcgt

SEQ ID NO: 585837 - DNA, 262 bp, Homo sapiens
gggagggaagattacaatggggcatgagcaaacttctgggagtaatgaatgaacatgttcacaatcttgattgttgtgatggtttcctgagtgtagatatgaaaacttagcaacctgtacatttcgaataaatacagtgtattgtatgtcaattatacctcaataacactgatttttttttttttttttttttggcaaacagagtttcatttttgttgcccaaactggggggcaacaacgtgagctcggttaattgaaacct

SEQ ID NO: 585838 - DNA, 734 bp, Homo sapiens
  misc_feature (1)..(1): n is a, c, g, or t
ncccagtccggaagtagtgctgttgtggcgccgtactcgagtgcctcatttgtgaggccgcgcggggttaaccgtggccccgcccgattaaacacttctcggtcttgcggcagccacccgcctattttcccgagacggttgctcccgtcgtgccgcggtgtcccgttgagcaaatatttgcgccgccgtggaatttcttgcgtccctatttctcggcctcgtggtctaatctctctgcgcgatcgccacctccccgcagtaacgtgttgcagaataagctgcctcccccagctgggatgagcttagatatgtccgccccaatgtagtttgcggcgcgcgagtaatagatgacgttaagacgagatatatatgggagcctgacctgctcgccgccctaatatatctacaacttctccgtgtgagattttgtgcttcccgctctctgtgaggatatctttcggtgaggagacggcgggcgccctccgtcggttttatagtcctcgggaataactaggcaacgctctcgtgacgaaccccttcccccgcgagctcgcggggacacaccacccacaagtcctgttgttcaaatttgcccgccacgactgcgcgccaatgcttctcttattatcgctttgttaaccaactttgtgggcccaatctccgtccgggcactcgtgtgcgcgcacaattcacccgctattgtattctcaaaaggaaacaaataacaaaaaaca

SEQ ID NO: 585839 - DNA, 1024 bp, Homo sapiens
aatcctcctactcctcattgtacccatgctaatcgcaatgggcattcctagagtgcttaccgaacgaggaaaattctagagtgtatatacgaacatacgacaaagggcaccgatacgttgtaggcccctacggggtacgtaacaacccgcttcgctgacgccgtagaactcttcaactcaaagagcccctagaactccgccgagatctacgatacacctctctacatcacctgcccgccgatcgtgtaagacatcatcaactcgataggcatctgcgtaacaaatgaaaccaccatcgtgccaccacaataggggctaaccccacgcaggggtttcctaatcttcccatacacattagggcgtgcctcatatcatttcgtatgcaacgcattaattttagtcagtaactatagatacgctacgtaggtggagggaggattcaggtcagaaattgagctagatgcgctcgctccggtgataaagagtagtcccaaagggtcgtatacgggtatcttggcccaccagacttcccccatatgacatggactttcatgagcaagaatcaggactcttagcaccctgtccaactttaaattctaactctcaaatgacaacggagaagatcgagaacgtcatagtacccagagtaacgctatgagatttgtatcgttagtatccccgatgccctcgataaacactaaaggttcctttgtcaagtggcgaagtccgaactagatcatcagggacacaacagtgggaggacgccgcaagccaaactacgccgaggcctaaatagcccgaagtacaccccgcgtttgtgtgcaaagcgaccccaacaaggagacaggtacataagaacaacgatatgacggacgctaacacagagtcatcacggcacaatgcacccggacctagtgaagccaccagctcctggcagggacagcgagccgcaaccgaagataaccgaccgcgagaagaatagcgctcctgaacctgcacgggcacgccaagtcaggccccaact

SEQ ID NO: 585840 - DNA, 168 bp, Homo sapiens
  misc_feature (46)..(46): n is a, c, g, or t
  misc_feature (54)..(54): n is a, c, g, or t
  misc_feature (87)..(87): n is a, c, g, or t
ctacctgcttaaccaagctcatactgcctgcctaccctcagatganccaggaanccagtgaaagctccctaccctttgcactagtgnctctgcaggttgctggttgtgttgtatgtgctgttccatggtgttgactgcactaataataaaccttttactcaactctct

SEQ ID NO: 585841 - DNA, 117 bp, Homo sapiens
acaagatggcggcgcgaaggggagcctcttggtgaggaccaactgggctccgcgctgctgctgctgaccatggccttgccgaggttcgggaacccttcggctgaagcatttactggt

SEQ ID NO: 585842 - DNA, 630 bp, Homo sapiens
  misc_feature (65)..(65): n is a, c, g, or t
  misc_feature (147)..(149): n is a, c, g, or t
  misc_feature (153)..(153): n is a, c, g, or t
  misc_feature (156)..(156): n is a, c, g, or t
  misc_feature (160)..(160): n is a, c, g, or t
  misc_feature (171)..(171): n is a, c, g, or t
  misc_feature (173)..(173): n is a, c, g, or t
  misc_feature (180)..(180): n is a, c, g, or t
cacgactgcagttatggcgggcaagtgggaggcagcatcctcagcctttcggtcttgcgggggcntaaagcccgggacgtaactgtgacacgggggcgccacgagttcacctatgcactgatgccgcacaagggctctttccaggannntggngtnatcnaagtgccacancntaaactnccccctgttggttttgccagcccccagcccagggcccgccacctcctggagtgcgttttccgtgtcttcacccgcggttgtattggagaccgtcaagcaggcggaaagcagcccccagcgccgctcgctggtccttaggctgtatgaggcccacggcagccacgtggaatgctggctgcacttgtcgctgccggttcaggaggccatcctttgcgattttttggagcgaccagaccctgctggccacttgaccctttgggacaaccgcctgaagctcaccttttttcccttccaagtgctgtccctgttggtcgtggttcagcctcccccccactgagtccctgggggtggggttttgtttgtaaaaggctttggggactcctaatttttgcttccccagcctaaagcagggatcagtctttttttgtggaataaatccttgggtcggga

SEQ ID NO: 585843 - DNA, 1476 bp, Homo sapiens
tgcggtggctcagcggccctgtaatccccacctttcagtgaggccaatgacaggaagatcacatgtatcgccccgcagagatgttcaacgcaccagtcctgggagaacttgcgtggaaccgcatcacgtctagcaaaacaactagcgcgaaactcagttcatcatgtagttgcatgcatcctgtggtcccagactactcgaaggagggctgatgcgacgaggatggcgttgaagccccacgaggatgctcggttgctcactgtagccagagatcatgaccccatgctgctccgacgcctggtgcaaaacagcactcggatgcgccctggtttccattgacacagaactaaatcaagactgaatgtccattggtgcgacatccccagtaccagaattcagacgaatagcatagttgcactcgtggaaagacgctcaggcaatggctggcgctttgtaaccgttctcaagtagtcgcaatctgcagccgggcttgggaaccagatggtatactgggaacaaaggcacataaacgcatgccattacacggtacctagacgcaggagcagggtccatgaggcctggcctatgaaacaacaggccccaatgtgagcattccccagcagaacttattagcatcgccagaggtcctcttaaatcagcgccttgccaagcattacctattcacttcacctcgtatctctgggtaccgtgggtggccctgcttgtctaggatcgggtactactaggaccgggcctcgcgagttttgtaagacaaccgtgggttaagaccctacagaacattatgggcctgacaacaaaacctcaaagtcaagctcctcacactcagatatctctcagagggtctacacataattcgctcactcactactttttactatttctcttatcctctcacccactcgacaccacaacacatacacacaacccacaaccccgacaaaacacaccacaccacccacacccacacccacaacccacacccaccacacacacaaccagacgagataaggtacacgtagaacgacacaacacaacacaagaggccacaacgaagccacgacgagcccagcagaagaaggagagacgcgagcacataaacagagcatagggcaacaagataagaggcacgaggcccagcagcagagacagggagggagagtaagaggagtaggaggcagggcgaggggcgaggtgaggggcagcagagcgagaggagcagcgagacggcagggggaggcgcgagtgaagagagaatgcgagaagcggggtgcgacccgccgcagacgacacgaaagaacgcagagacatagcacaggcggaattaaacaccaagacaccgaaacccacaacgcccccgccacagcacagcaccacccacaccgccacgaccccaacccccaccaacacaacaacaacgaccacacacaaaacacgacacgacagcgcgtgaccggg

SEQ ID NO: 585844 - DNA, 351 bp, Homo sapiens
gaaacggggtccctaattttaattttaatttttttgagccagtcttgctctgtcgcccaggctagagtgcagtggcacgatcttggctcaccgcaagctccgcctcccaagttcacgccattctcctgcctcagcctcccgagttgctgggactacaggtgcccaccaccacgcctggctaattttttatatttttagtagagacagggtttcaccatgttagccaagatggtctcgatctcctgacctcgtgatccgcccacctgggcctcccaaagtgctgggattacaggcgtgagcccccgcacccggccaaaggcaggattatttgttaagcgggttgcagtgttc

SEQ ID NO: 585845 - DNA, 1244 bp, Homo sapiens
  misc_feature (1225)..(1225): n is a, c, g, or t
gccgagatcgtgctactgcactccagtcctgggcaacagagcaagactccatctcaaaaaaaaaaaaaaaaaaagaataggaaaaaaatgaaaatttggttgggggatgatctaagtcgcatttgggtatggctattaaagtataagggaatatctgaggtgggataattgataatgaacaaaggggttattgggctcagcagtctaatggggcatctgcattgggcggagggccctcagggctggcttccacttcctagttggaaaggcataagggggagccctgtctgtgttgccagaagaatcacagtgggtggcgaggggaaatgcaatagaagaagtgtgttgggagaaggttgccagaggactctgttgtaagccgaaccaaggtctcttcttcaaagaaagctaattgaaagccaagaaagcgcccatttcaagccttcttgaagacgagagggcgtttgaagtcgtatttgcatggaggggattccacccttccagcacaaacaaacaacattttccccattgtgtggtcccccagttttccacacattgtggggggaattcaccatttttcattccaggcgagagcgatatgaggtgggggggaacaccaacagcggcggtttaacatataagaagattattccttttaaaattacgcccggtggacggcgatgttggcacctcaacagccccgtgttaaatgtatcccgagcgccactttatgtgtgtgaaagggccacagaagtgcccggagggccggcgacaattcaccgagagcgttccggcggcaacactcggaaggaaccaaattacgtgtggccattacacacgcgggtgtggacaaacccacgcagttcctctatactttaaaacaatttacccaggcaaacaaaaccaattttagtcccgggggtccatttggatgtgcaaattgtgcacccgcttattttgtgttccccaaaggagtataactccggaggaaggggccatgatagtgactgtggaaaaaaattcgggtgttgggacaaccacccaggggaatagcggcgggtagctgttttgccaaggtcaacaggcctggggtggcatttttagccacccccaaacttgcatcactaccaagacctttgggtgggcgagcacacaaaaccgtcaaagcactaggtcggtcttcaccaaccaacaacaatcagataaagtacaataacactactcngagcgcagatctatactcg

SEQ ID NO: 585846 - DNA, 731 bp, Homo sapiens
agttcccggtacccggtcgggggacccgtgcccccttctatcgggttgtccgcccgcgcgtgtttcgttatccggcctcctattggggggttatttcgcccacctggtgtagctcgggccccagatactcctatgtgccgaggtccgcccccccgaatcttcgtgtggttgcgccgccccttatacggagtttgccccctcttgccggttcccggagaatatagcgcccccggaattctccgcccctttctccgctccgggggtcgtccgcccccggttatctactcccttttgtgacgctcgccctatagtaggcggcgcacatgtgccccacgtgccccgaaaactctgtggggtctcgccggctaatatcggggcccccccctattggggccctcctccccccgcaaacttggcaaaaacaatttcttcatcttgctccacgcaccgcaacatacaacatttcgtgtattttctctgccgcaaaccccacaatatagagaccaaccttcttgggatgatcgcacacttcggttctcctctgcatagagaacacacaatcggcgttgtcggtcgctctagtgacatgcaccaataccacccttccactctgttccctcgtaggtaatctcccccacctcataaagactcaaagaggtactaaaaccccataacgccccttttttttttggaaaacccccggcccaaaaaaaaaggggtaaattaaccca

SEQ ID NO: 585847 - DNA, 188 bp, Homo sapiens
taagtttcttcttggtaaatatcctattgggggggtaagatttactatatcttaagttaaattctgcggtgtagactctggcagctgcctctatggtgacgaaacaagcttttttttttttttttttttttttttccataaacccgggagaaaatagggtgttccccagggcttcactctacgccata

SEQ ID NO: 585848 - DNA, 365 bp, Homo sapiens
  misc_feature (7)..(7): n is a, c, g, or t
  misc_feature (62)..(62): n is a, c, g, or t
  misc_feature (77)..(77): n is a, c, g, or t
  misc_feature (95)..(95): n is a, c, g, or t
  misc_feature (126)..(126): n is a, c, g, or t
  misc_feature (214)..(214): n is a, c, g, or t
  misc_feature (356)..(356): n is a, c, g, or t
gtttccnggttttttaattttggagaaaggagtcttgctctggtcaaccaaggctaggaagncaagtggcaacagtnctcggcttcacttgcaancctccgcctcctgggtttagagcaattctcntgtctcagcctcctgagtagctgggattaccagcatgcgccacccacgctcagctaatttttgtacttttagtagagacagggttttnccatgttggccaggctggtcttgaactcctgacctcaagtgatccacttgcctcagcctcccaaagtgctgggattccagacatgagccaccgcatccagcctagttttatttttctgcgtatagttatccagttttctcancaccattta

SEQ ID NO: 585849 - DNA, 792 bp, Homo sapiens
  misc_feature (484)..(484): n is a, c, g, or t
gagatctgaacctgattggtgtgtgcaccgggtctccagagagtcccggatcccagtgagcctgtccaggggcctgggggatgggtctcgtggtctgttgctctgcagacgagatccgttacgatttcggccactcgtagatgcgtggggttgtgtgcagtgtgtgtctagcttagtcggttctaggggggctgtgtaggctcccttcgctcgcgcctagtcatctctattggtctcgcttcatgcttccttccaatactgccaggccgagcgagtcgagacggctgcgcggctaagactggtgtccccgaagacgatggaatcagagacgtaagtgcatgagagccatcggagctctggagttgattgcgtgatccggggatctctgctagacagattctttgtgccgtgccgaatgacggtcgaactgataggacggaggttgcagtggccagtcactggtaaggcctgacagagagcagancctcatgcgtagtggggccagagtgtagcgacctaagttgcgacgcagtacaggttatacccagaagatgttgctggatcgaaggacatgtggaaaagtttatactctgagtgagtatctctgttggaggtgaagggaccatgggagcgagtattcattgatcgatatcaattccgcgaatggctttgctgagagatgctgacagggaagatcttaaaggagacattatgttgctgtgctggacaaaaaatccaatggagatggtgcaagaagtctggacagagtctttgagggaaaagcaggtgtgc

SEQ ID NO: 585850 - DNA, 86 bp, Homo sapiens
ccatctttatttgtaaaaatccagatataaaacgtaatctttcagtctttccaggttttccttttttacaaaaacaaaaaggcacg

SEQ ID NO: 585851 - DNA, 398 bp, Homo sapiens
tctactttttagctattgtgaataatgctactgtgaacttaagtgtacagatacctctttgagactctacttcctttcttttggttatgtacccaacagtggaattgcagtagtaatggcttatagaaaaattaggaaaatacagaaaaatatgagtaataaatttaagtcatccattaagctgccttccaaagagaacaattaccagtattttgttgtttgcaatatttagtgaatttttttctgtgtatagttggaattaagtactgtaaaaactattttatgctcttcttttaacttagctaccataatgtaagcatttccctctcttttaaaatttttccagagaatagtttatttgagatgtataaaataaatcagtgctatacaaaaataat

SEQ ID NO: 585852 - DNA, 278 bp, Homo sapiens
gagcgtatagctcagacctctgtgcactccaattatcagcccattgcctaaggcagcagtaagcttctcccagtaaacaaagatccaggatatacccagccccagtggccacagccactcctacccatacacaccatctactggcttgtgggtcaaactgcacaccccgatataaaacctgccgacagaagtgcataaggctctagaggcaaagccaaaagaccccacctagtactcacaacagtcacagccccctaccagggttgggtggagagcgg

SEQ ID NO: 585853 - DNA, 812 bp, Homo sapiens
gcacggatcgtcgcctcggtgagttcatgcgatgtgcaacggtgaggttcccgggcccgctccaggtcggaggcgcatgcgcagtgcctgtgacctgatgcgcctgaggtcgctcgcgacgattgctgccgggccaggatctggaaggacgcgtcctcgatcgcacaggtctttgtgctggacacggcttgcgtgtctgcggcactgtcgcctgcatcgatcgcctgtttcctctgttgccggagacagaggcccgtggtctgcgctgactctcgacgccgggtgcgtcgctcagccgagcccatgctcgtacagaagggcacgcggcggtgtcacgccctttgctccatgcttcctctgctctgaaagggtgcctatcggacatctgcgggctatcgccttcgtctggtcggccttgcggagccaccggtgtagcgaagcgctggagctcgagtcgacggcaagcgcgcccacttgctggacgccgacgcggctccttggactcgggcggctgcccgtgcacttgcttgcccgtgtgttagccggttgtctgcgttccctttcgcgtggccagatggtggcccagttcacgtgaaccgcgggagaggtgcagcgaaaatggtggggtccagacgccacgggacaacttccccggacagatccacatgttccaacgtccaatatgctaaccgaaagcgccagaaagaccttcttcccgcttcctaaggcggctatgcgcggggacccgggccgttgtactctgccaatccgggcaaacgctcacgcttttaaatccgccttcatcccacccg

SEQ ID NO: 585854 - DNA, 901 bp, Homo sapiens
ggtactttctatgagaagcgtttggccacagaagtagtggctgacgctctgggtgagagaatggaagggttatgtggtccgaaatcagtggtgtggaacgacgaatgaaggtttccccatgaagcagggtgtctggactccatggtcgtgtgcgcctgtctactgagtaaggggcattcctgtaacagaccagggacggacacatggagaaagagaagagaagatcagtgcgtggtttgcagttgttggatgcgaagatctgagcgttctctgatcttggttcttggtaaaacatgggagagagaggagtattcctggactgactgatactacggtgccttcgccgccttgggcgctccacaagagctagctgagatccgcaaagcgttttttcaagtgctctctcaggaacgatgatggtccgacagtaatgtcgtacaggacaaggccttaaataaaggaaggtaaagaacacgctagagaccaaagcactccacatgattcaggcgtgcttgttcagctccacgtgtcctgcaagacaacaaatcggcggcgtgaatggtctgaagaagcagcgtaccacagaacaaagtatcgaagaggctgagaactatgctgataactgtttggccaaagagacgtgaatggaagctcaggagaagcgccaggaccagattgcgaagagacgcggagtttactctctgagagcttctacttctaaaatctgaatccggtcaggaaataagactcgcggaggtaacacgataatacgatcagagttccgcacagaaaaccaaaagggggggcgggtgaaaacagttcccaccgaaggggccaggttaacggatcccacagtttcttgggccgggggcccaaaggaggggggttataaaagccgggg

SEQ ID NO: 585855 - DNA, 893 bp, Homo sapiens
  misc_feature (144)..(145): n is a, c, g, or t
  misc_feature (152)..(152): n is a, c, g, or t
agtgatctagaggattctcacgcccatgtcacaactggcggcagctattcctcctcagaatgatggaaccttcattggatacaaggagcggcgcaggatgtggaccaacgtgaggctcccctcaacaacttctctgtggcgcanntgccagntgatgaagacggagcgggcccggtccaagatcttcatcatcctgctggcctgcgagtggatccacatgtcgatcgaacgcaccttccatgtggagacgtcctgaggagcgggatggagtggacaatcgacatccagactgtggctgacggcctcaagaagcaggaggaggaggagatggacttccggtcgggctcacccagtgacaactcaggggctgacagagatggaggtgtccctgggcaagcccaagcaccgcgtgaccatgaacgaggttctgagatacctgtaacgtctgctgggctatggctactttcggcgaaggtgactcctggtgaaggagatatgggcacaggacgtgtactacgcccgtgaagatcctcaagaccggaagtcatcgttggccaaggcacgagggtgagcccacacagtcaccggagaaccgcgtcctggagacactccagggcacccgcgttcctcacatggcctgaaggtactcttggccagacaccacgagtcgcctcttgctattgtcatggacgtacgccaagggagggcgagctgtacttccatctgatccgggaacgtgtgttctccgagggacctgtgcccgattctatggcgctgagatagtgtcagccctggactacatgcactcggagaaagaacgttcgtgtaccgggaactcaaagctggagaacctcatgctgggacaaggacgggcacataaggatcacagacta

SEQ ID NO: 585856 - DNA, 435 bp, Homo sapiens
ctctaaacactctcatcctcagtgacctcttctacttccacatccacagtctcagttagcatcactagctgaaaatctctatgcaggacttcttactgacatatcaacctgcttatgaaaccaacccaatagtcacatagatatttttttttcttttcttttcttttcttttttttttgagatggagtctcgctctgtcgccaggctggggtgtggccaggttggagtgtagcggggcaatctcggcttactgcaacctccggctcccctcctgggttcaagttattctcctacctcagtctcctgagtagccctttaaaagggggggggaaaagcctttaaaagccccaaaaggggggaacgcaccacgcccggctaatatttttgtatttagtagagacgcagtttcaccaatgttggccaggatggtcttta

SEQ ID NO: 585857 - DNA, 684 bp, Homo sapiens
  misc_feature (5)..(6): n is a, c, g, or t
  misc_feature (508)..(508): n is a, c, g, or t
  misc_feature (582)..(582): n is a, c, g, or t
  misc_feature (601)..(601): n is a, c, g, or t
  misc_feature (604)..(604): n is a, c, g, or t
  misc_feature (611)..(611): n is a, c, g, or t
  misc_feature (623)..(623): n is a, c, g, or t
  misc_feature (634)..(635): n is a, c, g, or t
  misc_feature (643)..(644): n is a, c, g, or t
  misc_feature (650)..(650): n is a, c, g, or t
  misc_feature (655)..(655): n is a, c, g, or t
  misc_feature (660)..(660): n is a, c, g, or t
  misc_feature (664)..(664): n is a, c, g, or t
  misc_feature (667)..(668): n is a, c, g, or t
  misc_feature (672)..(673): n is a, c, g, or t
taaanntgttcattcataagcaaatgcatatatgttatgctctttctccatattttaatcccttatacagctgttgcctcactttcatattcctttgttgtaatgctgccagcattctccttcctccctcctcattaagaagaatgaattgaacaagctacatggagagatttacactgcaagggctgtcagagggaattccaacacaatgatttacttcggtatcaaattcaaaacgaggatcagaaatcctgcattatcatctataatgaatctatttcatcaactaatttaaaatcatgcataattcattacgtgcattattcatttatatttagcatgtatttccctagatgtggtctctatgctaactttgcctcactattttttctgcataaaatgattatacgtttctttattggtgaaaacagaatgactttttgtcaaattgggtcactaattttcctatataacacaataatacttcctgccttttatttcaaaaccntttccttacatttgcattttatccttctagtaatcatgtttttatcaatcttgtgtattttattttaaaagtangtaatccatcattccaaangantgagaangttgctcaaatnaaatgtatgtnngattgaanntagaantactnctggnttcnagnntccnntttgttggcct

SEQ ID NO: 585858 - DNA, 567 bp, Homo sapiens
gtaggttgattaaacaattgaaggcgatctttaaaaagagattaaaccgaaggtgtgattaaaagaccttgaaatccatgacgctagggagaattgcgtcttttaaagcctagttaacgcgttactaaacgcagacgaaattggaaagatcaatagggagtggtaggatgaaacaatgtggagaagatacgcaagtttgaagtggaaaacgggcaatacagaagtacgggaaggcgaagcaaaagaatagagaagatagggaaattagaagataaaaacatacttatagaagcaaaaaagataattttaaacccgtaaaagtaggacgcagaagaaaaaagacaagctaggaaacaaaaagctaagggcaaaattgtgcaaacttagaagaaaattggaagatagaaacaagatagaaattgaaactatcgtcacgagttccagatagcaaatgaaaaacaggctacgacaagtataggagaagtatagaagatagaataatataaagcctaaaatgggataaaatagcactgaaaaaatgaggaacttatgggttacagaccgtcg

SEQ ID NO: 585859 - DNA, 364 bp, Homo sapiens
  misc_feature (8)..(8): n is a, c, g, or t
  misc_feature (25)..(25): n is a, c, g, or t
  misc_feature (222)..(222): n is a, c, g, or t
ctgtaaancccagcactctgggagnccgagacgggatggatcatctgacgtcaggagtttgagaacaaccctggccaatatggtgaaaccctgtctactaaaaatacaaaacattagcccagcgtggtggtgcacgcctataatcccaactactcaggaggaggctgaggcaggagaatcgcttgaacccgggagggcacaggttgcagtgagccaagatgngccattgcactccaacctgggcgacagagcaagactcccatctcagaaaaaaaccaaaaagccattgaaacataaatatggctggaagagttttatataattcatgtggttttttttttttttttggaggcagagttttggc

SEQ ID NO: 585860 - DNA, 1666 bp, Homo sapiens
  misc_feature (96)..(96): n is a, c, g, or t
  misc_feature (159)..(160): n is a, c, g, or t
  misc_feature (163)..(163): n is a, c, g, or t
  misc_feature (165)..(165): n is a, c, g, or t
gacccggttgggctctgctgctcccttctgggttccgaggcccaagcccttggcagtgtttgtgagtggaagggaggtcacgctatcgtccgcggncccagcagccctgtgccctcgttggatcccgcgacgcggctcctttaagagcctcgcgggtcnnccngncgctaggtcgctccccggccatgcgggctgctgcgggcctggcctgaccctggcgtttgggctgctggggctgggtgcggtctgtcgaggtgctggcgtgctggctgtgctgggagtgactgctgctggtgctggctgcctgtggacttgcttgtgtgcctggctgccctgtgcttgccctgtgtgctgtgctgtgcagcctgagtttgccccctttgtgccctgtgggtgacccctgcggtcctgggcgagcttggccaatgtactgtggcttgcctgtgtggccttggctgcatgctcaatgagcccgctgagtctgtactgtgcttgtgctactgaccctgctgcaccctgctgtgtgctgctcttgggtgtgtggagcatgcttgctgaccctgagctgtctcctgctgtgctgactgtgcgacccgtgctgcgatgtgtgagttcctgttgaggagcgactcggtgcacagctgttccaccgtgccaccaaacggccgactacctgcggcagtggcttcgaccgcgggcaacctggctgcgactgcaaccaccgtggagccagaaggcatggacgaccacggttctacctgagcaagttgcgcccaggtgcccacctcacagaatgcctgacaactggggaatataagccgagttggacccgagtaccaacacgtcatgtttgagtgggcctctactgccagaaaaggtgtggaactaagaaatccaggctagtaacactgaggccaacctaaagggaaccggcacatggctatcacctttacacggtgcacgttgaaatgtgtgttctcttccgtcgtgggctcctcaacgatcaaaacaacaaagcaaagagacaaacacaaacaacagacacatcaaacaccagaaccggagggtgaggactagagcaggacaagagcgcgaagaagcaaggagcgaggataagagaagacgggatccgcatgaagaggtagaaatgagaagagagagaggagagagcagagaggaggagagagggcgcagagcaccaaaagtgaggcagagcggacgagagcgaacagcagaagcaaataggcgaagacggagacgcgggaagaaagaagagaagcaagagacccaagagggagcaaaaccagagaagagagctacgaaggagaagggaagccagagcagcaacgagagacgcagaggagagagagaagcagagcgaagaagcaagacgcggaggagcgaaggcggagaagacagggagagcagaaggggagaagagaagagaacaaggagagacgcagagacgaagaggggacagagcaagagagacggaagaagaagaggaaagaacgaaggaagaggcgcagcagcaatcagccaaaagagacagagcacaacgagaaagagtaggaaggaggagagcaggacaggagcaagagacgagcgcagagagacagaagaagacggagcacgacacgagagacagagaaggaacacgaacacg

SEQ ID NO: 585861 - DNA, 640 bp, Homo sapiens
cgttgcacggccacaggagggacacacatgtaactgtgtgagaggtgcatattagcagatggggccagacacagtatggcgtgtttttcgaacccgagggccaagataccgggctaataacgaggcgcgttacccaacagatacacttctgtgtccagacaagctgcgcaagcgggcttcccacacagtgcctggcaccaccacacccaagaatcttcattctttaacacgcaattatggtgaaccatgggtgacaaacaggtgtgaacttcttggaaagcaccagagtgctcagacttttccgtgccatttgcagagggaacgcccattccagggagcaagcttcgactttcacgatatttatcaaggaaagggtttcactctgtggaggacacgtggcttgagaacacactggagctgtcagagttcgaacacaggttgctgagttcaagaagacattcagacgagcaggaagtctagctctgagcaaagctgtgagcaaggccagcagacgccgaggcacagatgcattagactttgacatattagaaatacagaccgcgtgctcagatgtgtgctgtgtccccagacacacagacctataccccgagcaggttctcgggcattcacagaggccttt

SEQ ID NO: 585862 - DNA, 194 bp, Homo sapiens
ccgtcgagctgctgtgtgacccagatccggtgtccgtgggtcgtctcatcgaagctggcggttcggctctcaagatggtgactattgcgccagaacgtgcgcacggcttggaagcggtgaccaccttcaccacagccggagtgcacgctgctatcggccatactgagtgtgacaacaccacggctagtgccgca

SEQ ID NO: 585863 - DNA, 599 bp, Homo sapiens
  misc_feature (532)..(532): n is a, c, g, or t
taactgtaaacggacttcaacaaaatttaaaacttagcaatacaaaggacaccattaagaatatagagtgtgaattttctcctacacactaggagaaaatatgtgcaaaccatatatgcagtaagagacttgtatccagaatatgctcaacatcgttagtcattagcaaaatggaaattaaaaccacaatgagataccacttcataccaccctctagaatggctataaacaaaaatataagaacaagtgttgaggaggatacagagaaatattggcggcaggaatgtaaaatggtacagccactttgaagcagtttggtagtcttttatatataaacataaatttaccatatgacttggtaattccacacctaagtatgtacccaaaagaatgaaacagctgaggtgcttgctgagggcaaataaaatatgcaatgggcagtggaaaaaggtagctataagtaccagctacagacccattatagtactcagaagaaaatttatgatcttaaatatatgtattagaaattaanaataaactaagctttcaattaattaaaacaaaacagaactaaatagagttgaggtaatccgtgaggg

SEQ ID NO: 585864 - DNA, 350 bp, Homo sapiens
ccacagcgtatttcttcaaatataatgtgacagaatacgactcaattcaccggctacaacaattcatagaatatttcaatgtttacttggagatgccaaagttcactgttgctgtgtttttcacaatgaccacatcaaggtactacttacttgtgttaaacaggccactgtgtagagtcatctagagtgtagaagaatgtccctatcacttgctggtaaaaatccactgtgctcccaaggaaaagaaaatggtctgacagcctctgtttgtggctctcaccaactcatctttcacctaagtcatcaagctccacatacactgaggtcaatgtcatacctccaaggggaaa

SEQ ID NO: 585865 - DNA, 142 bp, Homo sapiens
tgtactctctaattcctggagcttcactctatgatcagcaaccttatcctttaccatgccgtaacaggcgtgacattcctggcagccaggccaaagaccgattgtagaaatagttttctctcacactggtacacatgcgatt

SEQ ID NO: 585866 - DNA, 1060 bp, Homo sapiens
cttccttctgctgtaccaagtgtattggtaaatctgttgtcatctcaacattgtttacactgtcttcaccacgagtagatttcatctcaagaaaccacttgcttgtgctcatccgtgggagcaactcatcctctcacgtttactccagaggctgctgcagtctcgccagatctgcaggctctttctcgtgattctagtgctctatgtatatttccaccagtatctgcagattactgtcctcgcacagaagatcgtgaacgccctgtgtcatctggtgagggttggaataatctttacccaacttctctctctttttgatcatttggggaaggaggtctgggaggcggggaggcccgtggtcagggtatgacaatgccggtttacatgcgtgacaccccaccatttatccggggtgtatccgatacagattagtctgtgccgctagagacgcatccacaagtttcgcgttgggggatttaccgcaacatcgccctcgtagcacaggccccacagtcggaatgttacaggcggggccctttaattgcacatgcactgaggattctcgccaatattgttggcgcccagggggcggggttcctccaaagaataactgggagacgcttggaagagtcacagagttgccatggggcacctccccaaacggcggctgcggacactaccacagggggttggggaagccccactacaatgccccagggcccccacaagttctccctccctaactgggcgaccaacaccaaggggacccatgctaaaacagaggctcccgttaacagtggctctcctctccaggggcctctcctcaacacacgtgtgtcgtgaaaacccagtttatgccagcacaaacacggttcccaacgatatttttgtggcccccaaagtagttactatcgaccgggggagcatccactttcccttaacaaacaaagctcttagtgctccgtgacggcaaactacttcttttaacggcgtcgcgtcacgcacttgccaacgtggcatatcattccttgaggcatccaaggggtcaccgacattgcgt

SEQ ID NO: 585867 - DNA, 225 bp, Homo sapiens
ttataattttataatatcataaatttataatattagcaatttataaaaatataactttataaaaatataactttataaaaaggtttggatacgtgaaaactttataaagttgttgacatggaaatattggtacggtatatttgagtcataaaaatgaataaagaaaaagcccaccaaggacaggacaccttggaagcatcatttatttaagttagatacatatta

SEQ ID NO: 585868 - DNA, 116 bp, Homo sapiens
cccccgagcgtcgagctgtttcaaagcttctgccatggcctgtctcctcccttcagtcttcgtaggcaaggggtttcatgcatgcactgttacctttaacatgtagagggttcttg

SEQ ID NO: 585869 - DNA, 1702 bp, Homo sapiens
  misc_feature (13)..(13): n is a, c, g, or t
  misc_feature (42)..(42): n is a, c, g, or t
gcgagaggcaggngagcgacacgcgggttaatgatgcttgtnaaactggtggtcacctgttgtgtaattagcatctcaccctcgtcggtggtttgttgtggattaactcctctgatagatctttctttgtgtgcttcctacactccacacactccgtggcgattttaatgcattcgttggttgggtgcgctcgccactcccttcgtgggtgattgacaagatttgggttgctgcactaacagagcacacccgcggattgtgtttccctcccgtaagagaatttccccccggtggtggttttcccacatggttgtctccctccttcctcccggagtgtgtgcgtctcccccgcgcatatatggtgtggaccctcctctctcgcccttgtttcactacccacgggcgggctccccggtcgcttctctttttatatagttgggagtgaattatttgggggattatctactcatagcgccgccctcttctggggctacactactctctcccctcggcggatgtatacccttcttggcgtcgctaagtaatgttgttgatgccgccccaccgactgggcaccccacatgttctgttggtaggccgccgttgtcgctcccacctctcccgtggggggcccactatatggggggaacgacctttttttcgccgccaacctcttgtgggggcgcgctcgggtaaaagagtgtgccttttttttctccccgcgcgtaagttgttttacccgtattcggagtagttgtgttttgccggcgcaccacactctgtgggcgcggttttagtataccccccgcttgtttctcccctccctgcacgaggaggtggtttacttgccggcacctagtctgtgtcccccacccggcgctccccccacgtgttggggttttttaaaacacacgggtgtcgttttgccccgcgattttctttgtggtataagcccctccccgggggtttcctcccatagaggggccctcctctttcggggggcctccacctcgccgcattgagagagagtgtctcactctcgcgcagcgagagtgtctctctactatagagagagggactccccccccctcgcgtaaacacactcttgtgagagaatatacatcgtgttgtagagacccatacaacccacactatatgtcgcacaagaaccactgtgcgcgccgcgggagacacaccacatctgtttttctccccacgcgcgccacgcgagatatttacacacacgctctccgcgcggggagatatataggccacacgcttgtgtcgcacacgacacagcgcggcgcgctcacacacacagcgccacatatcacagagtagtgagaagaaggcgcgggccggtgtgtcacagcgcacacaaaacgcctctctggggtgagggtgagaagagaaaggagaaagaaaagagcgctgctctgtgttggtgtgttaaagagacagcacacagagagaaagcctctcctggtgggggaaaataaggcacccacgctttcccacgaacccgccccctctgtaaaaaaagcctctccacagagagagatgagaaccctctcctaccacagagaggagagagaagaaagcctcgctgctacaaaaactctttaaattgggtattccctaaagggccaaacattttgggcacatttttttggaaaaaaacccggttataccgccccggtga

SEQ ID NO: 585870 - DNA, 236 bp, Homo sapiens
caacgttaggagctggcttatagtgatatgataacagcatgttcatataagagctgagagagcagcatctactatgatacacagttctgagaatctgagtgttactggatctagcggtaacaaagcaggaagtatgtctcttgctgtgtacacgcagggctttatcctccacggtatattgtgtactgtcaagtatcttgaaagatttctgttctccatctgctgctaggtacaac

SEQ ID NO: 585871 - DNA, 118 bp, Homo sapiens
catcatttcatcacaacacatttatcaattaaaccccctgccataacccaataccaaacgcccctcttcgtcaagatccgtcctaatcacagcagtcctacttctcctatctctccca

SEQ ID NO: 585872 - DNA, 141 bp, Homo sapiens
ttgccctcgcttctcagatccccgccggaagtgaagagagcaagcagatttgaacctatctgctttcaagctggtcatcatgatgaaacttagacacaaaaataaaaagccaggtgaaggttccaagggcccacaaggaag

SEQ ID NO: 585873 - DNA, 620 bp, Homo sapiens
  misc_feature (271)..(271): n is a, c, g, or t
aaaatgcatctgtccacatccctatgggtgtctccctcttctcagtggatctgcacaattcctgaagaattagacttggattgttctatgcaaactgtcatttccaggctgagcacaagtatcatagggacgttggatctatcttaataacgaccgaacgcaacaagtgataagcactggagatatgtttctccacaagagacctctgcacatggcagacagaaatcattacaaattcttattcagacatactgcaatatgtaacctgtanaatattcaaggtatgagacatgacattatagtggtttccatatttacagaacacatttacaattaagaatgttaattacaatgtgcagtcgaaataaatctccgtggcgtttggagtaagtaaacacgctgagtgaggttatcctataaatcatggggagagcacgtgttgcgtcaaagtttctggtcatgctcaatagctaaaacaccagtgacacattttattcacgcaaaaggaacccagtacctttaatcaggccagacatgtattagcctgttcagcacagcaattccatggatacgaaatagatcttcaatgccaatcattccaagattcagtattactgaag

SEQ ID NO: 585874 - DNA, 344 bp, Homo sapiens
tgtcggaggtaggccgaacttcgggctgagcgtgagccaagcaggaggccgagcgggccctgaaacaggctatgaaaaatgggaacaagggaggaccacctcctaaggccagccccagtcacagctggagaaaccccctcaggattgaagcgtctcccttagtaccctcaggttgatgacctacttctgataacgcttgttaaaagaccagagcgtttacaggttcctacaccaaaggattattgatccaaagtctgtctcttctctcacctaccccagtacagcatacaaaactctctgacccttttcctgagcctttcgtaccgagctctccttcttactct

SEQ ID NO: 585875 - DNA, 403 bp, Homo sapiens
atgattgggaaacacccttccctcagatccccctaagccaacaggtacatagcacgagtacaattagcagaattcacacactccgtcgggcgtcctccctctctgggacagcgcggtgcagtccagaaggtccatgcctttaataagaaggtccatgccaggcctccactccggcttggcctctgctgctctgcgcgcagtcagcactctccacactccagatgtctcactggctccccccagccccatctctcacaagctccagatcctataattaactgcatcctcaacgtctccccagctatcccacagacacctcgaatgcagctcgtctaaaactgaatgcattactgttgcagcatcccccacaaccctttctcctgtggtcttggctggtgggcag

SEQ ID NO: 585876 - DNA, 322 bp, Homo sapiens
ttcccaacatttcgttgtcgagcgacagcattttgccaagtactgtttacattactctgcgaagcgatacgtggaggttcgaagacgatagatccgtctctgagatctgacaacacctctcgcgcgaccggcgatgcggcggcgttattcccatgacccgccgggcagcttccgggaaaccaaagtctttgggttccggggggagtatggttgcaaagctgaaacttaaaggaattgacggaagggcaccaccaggagtggagcctgcggcttaatttgactcaacacgggaaacctcacccggcccggacacgaatgttca

SEQ ID NO: 585877 - DNA, 205 bp, Homo sapiens
caagagtagtccagagatctagttaagtctctcagtacacagtgctagtacaagccagcagtgagagaggagggcccagcccgcatgttatggagctagtatagagccagataggcattagtcagcgtctatccttagagagcagtccaggcttatatagtttgagagcatgcctagagagagtagcagagcttagtgagctagg

SEQ ID NO: 585878 - DNA, 155 bp, Homo sapiens
actgcagacagctgtgacaataagccaacactgaacccctgatgacggtctcactctgtgagccgacaacgcagagccgctgaagcagcagatgaatgggacgcgtgtgtgagagtgaatctcaccgatgtccagtatccaatgtgagtgtcgca

SEQ ID NO: 585879 - DNA, 361 bp, Homo sapiens
gaattcccccccccccccccccccccggggtaatgaaggggtccagtttcagtcttctacatagtgttaggtagttattcctgcaccatttattaaagagagaattctccccatattcctcttgtaagtttggtcaaaaatctgatgagtgtaggagggtgaaattatttctgggctctctatcctgtggggtgggtcttgtgaacttacggattccatatatctacctctctcctggcttaccccctgtaaaattatttcaagtgcatacagggtgctaattccagatgtccaagagttcaaactctccaaaaagtcccaaaaaaaaatttggtatcccctctttccctttttaaaactt

SEQ ID NO: 585880 - DNA, 304 bp, Homo sapiens
  misc_feature (258)..(258): n is a, c, g, or t
cccggaaatcgcacggagaatgtcatgaaagaaaggatgtatgtttatttacctatttttttctgtttgagacagggtctcactctgtcacccacactggagtgcagtggcatctctactaaaaatacaaaaaattagcccggcgtggtggtacgcgcctgtaggcccagctactcgggaggctgaggcaggataatcgcttgaacccggaaggcaggttgcagtgagctgagatcgcgccactgcactccagcctgngcgacagcacgagactccgtctcaacaaaacaaaacaaaacaaatc

SEQ ID NO: 585881 - DNA, 290 bp, Homo sapiens
ccacgccgatgtgatacgccgatgggtcatatggaggtccccaggctaggggtccaatcagagctgttgccgccagcctatgccagagccacagcaacacgggatccgagccgcatctgtgacctacaccacagctcacggcagcgctgggtcctgaacccactgtgcaaggccagggatcgaacccacaaccacatggttcctagtcagatttgttaaccactgcgccatgatgggaactccatgcagattttaaaaggcattctgaataggtgaattccgggagattc

SEQ ID NO: 585882 - DNA, 760 bp, Homo sapiens
  misc_feature (660)..(660): n is a, c, g, or t
actatcgcggttgaagcaacggtagagatccacgtagactgctgcctagatctgtattctagctgcagggcaccatcgagactgctaacatagctgtatatagtggatcacgagatctgatcctgatcgcagaacctcccctgatcacaggatctatgttggttgaaataaaaacaggacctgcatgagctcaataatgcagggatctaacctagtggacagcaatctgtagaagaagataacttcttactacctgctaaaatcaacatgcagagaagtgatctgagaggcccctgctcaggacagatgacagatggtccacagctgattagtcttgatccagttctaccagtaacatggggtggacgctctgcatagaaccccacttcaagatccgcgtggtggaccatagagagcaagcttgacacttctggtatcggaaagtggtgcattaccagcgaagcacgtcaagacactctggagaaaaggctccgtgcagaccgcactgctgaacagtgagatgcggtgaacactagaatggaaggtacagcgagagtcctgcctgactagaaccttgatttgttaggaccgagacttaccttccaagcttatcattcccgcaacgctccgccaaaaaaagcaggtgcaatttgtccgatnttgcaattggataaatctgggggaatgttccattcggtatttcgttaaggaagtgcgcacgaactaacaattttaataggatgtccggccccaatggctc

SEQ ID NO: 585883 - DNA, 190 bp, Homo sapiens
  misc_feature (78)..(78): n is a, c, g, or t
  misc_feature (106)..(106): n is a, c, g, or t
  misc_feature (140)..(140): n is a, c, g, or t
  misc_feature (158)..(158): n is a, c, g, or t
  misc_feature (185)..(185): n is a, c, g, or t
tggaggactgttgggcatgtagactggccccttgaagattccccattgtttaaataaaatcaagcaaatgcttttttnccaagagcccgagcctcgctctaaaggncgcagtcctagaggcgtccctttggggcttgaanagcacactgtgggacgcncgtgcttctgattaaaggaatctcagntctca

SEQ ID NO: 585884 - DNA, 255 bp, Homo sapiens
aatccggcagatcgaggccaggagaagccaagggatgtatcatctgttgaactcttaaggaataatcatcaaggcatcaaagttgaaattgatgcacgtaatgacagtttcacaagcctgcattgaacttgggaaatccctgttggcgagaaaacaggtatgcatctgaggagagtaaggaaaaagttactgcaggttgacggaagaagaggaaagaagatgagtcgacaaggtgggaaggacggagtgggaaag

SEQ ID NO: 585885 - DNA, 317 bp, Homo sapiens
  misc_feature (265)..(265): n is a, c, g, or t
cacagaagcagaaaaccaaacaccacatgttctcactcataagtgggagttgaacagtgagaacacatggacacaaggaggggaacatcacacaccgaggcctgtcagggagtgggggacaagaggcagagagagcattgggacaaataccaaatgcatgcacggcttaaaacctagatgacaggttgatgggtgcagcaaaccaccatggcacatgtatacctgtgtaacaaacctgcacgttctgcacatgtatcccagaacnttataataaaaaagaaaccagtaagtgctcaataaatgttactaacatctaa

SEQ ID NO: 585886 - DNA, 691 bp, Homo sapiens
gaaggatgcagtagtagcaggtgcagacgttccgacgaaagggggatgaaactagggatgtattaacacagctgcgttggtaacgtttttcatggaaccaagatttgacaacgggcatctcttatccttaggtttaaatattacctgctgggagcaaggcctggtatgaggcgccctgggtcttgtctgtgggtgtttcgcttatctgtaaggattacacgcagatagggagaagggaaactggggcctcactttgatcaatgaactgaggtcagcctgtgctgatattcttaaagttttctattcttgaataaacgctaatcaattttctacaaccttgtcacatgtagctgagtctgggatgactcagtggcatcagtggatgcgtggcaaggttctcggtcgttgataactcatgacccaaatccttccaagacacaaatgaagctaatcttcttcaccgtcccttacctctcccagcttcccctctgtgtctgtgtctgtgtgtgtgtgtgtgtgtgtgggtgtgtgcgcgcgcgcgcgtgggtgcacatgacggaaggtacggtaccctaaatacacacagtgagctgagctcacgtgtatctccggactcacacacactgtgcgctacgaccgtttagcatagacctcagcaagctcttccgatgtcacgtgtctacgccacacg

SEQ ID NO: 585887 - DNA, 1024 bp, Homo sapiens
  misc_feature (322)..(322): n is a, c, g, or t
ggctgcagtagcttgggaggctggaaagcctctctccatagagggagatagaggtggcacgcgcccaaaggctcatgaagttcgaatcaagatcattgccgactgcggtttggccacaccgtatgcctataccgctgtagtggagctgatcctgagggttgttttccatgtgatcttgggacatgaatggtgcatggaattgtggaaacgtgttggtgaggggatgttactaatgctgacagtgcgggtgagcacttgatcatgtcccatctttatcatcgccatcagttgtgtgagaactgcaaagtttgaggtcgtaaantcctaaacacctaaacctcttgtccagatagtatacaggagatcactctaaggcgcaagaggagtgacatgcactagactggctcaccagctgagtcatgttacattgtcgaacagcgataagacacatcattgcgagttcacagtgggaaccccagccacaatgttgctgtaggtacagcaggttggatggcatgactaatcgtcgtagcttcgcttaatcactagatcctatttagacaacacttgtttgggcattaaacgtcatgcccttctcagaggtagtaggcaatgttcgaagcgagttatggcgactcgctgtgaaacacgttggcaccaggtcggcgccgccgtggcgtttctcgttgtggtagccgggtcgtctggtcttgtgccagggaagtcagcgatttgggacaggttaattcatgtgccctgtactaggtggggtttggtcgtttttcccggatcgctccgggtcgtgggccatctctggaaccgttagcttgtgcgggggcgcacaggagttggggacgccgacaggatgtgtcatcaaccggcaaaggagttgaggacatgccaatccacggaaaggggggcagcgagaacgatctcgatggatgaagtgagagaatcaccttggcaaatcgaaacggtaacggggaaaaggtcaagaacaggcaacagcttgacgcattgtgaa

SEQ ID NO: 585888 - DNA, 992 bp, Homo sapiens
atgcgtatgtacttcgtggccgttttgtgtcatgtcacttgtggtttagttcacttgtgtgctcgagctgttcgcctgacgcctgtggatgccgtctgtgtgggtctttgtgtgtcgtgagtttcgtgtgtttggcggtgcgtgtgtaatagctgttcactcattgtgtgcaccgcatctgtccatataatcgtttgatgtcacgtctgtgcttggttgctatcccgcgtgggcgcatagtttttttgcgtgcgcgccgtagctcaactagtcgtgttcggccccgttatcccctcgttgtggggggtttaccccgctgttccaccccactaccgccggggtttaaccgccgctccctttgttgtctcggtgtttaccgccgaaccctctaatatgggccgcatattatttttttcctaatctgatccaccccgagagttaccaacctattactcttattttgtaagtgcatactccgcctcccactaaaattctctgttttagccacaaacaccttttccagaggtttatcccccctttttccgacgatacccggtcgaaaaaatacccccggtgcgaaactgactcatcgttttgcacgcaccgggagtttgtctacaaccaaaaaccactcatgtcaaccctcgtcacttgtgtctcccccccccgccttgaaccaaatctgggggcatttctcccacgtgtcgagcagcactgttttccacgcaacgcgcagtgtctctcgcgctttcctttcccgccctcccgtcgtgtgcgcgcccacagccgctgattggtcccccaccaccgcggtgtttgctagtcaaaaaccagggggcgcccccacctcgcgtccggtcgaagacggcacaacgtggcgtctgtgagagtttcgctgatccccaccagtggccacatggggtcaccaccctactcgcgccttttcccccccacgcctccaacccattccccacccgctctcccccatcaca

SEQ ID NO: 585889 - DNA, 236 bp, Homo sapiens
  misc_feature (1)..(1): n is a, c, g, or t
nttgtggctgttaccgtgggagaaagtgggcattaccacagctcttcggaccagggtcgaggcagcctgggacagttggtccactccgagtcagttcggacccaatactcagttggccgcgggaggttggtcgatttaatgtcagctcggacccggtaccgagtcgggcggggatagctcggggaccccaacagctccttcggacctggggtcccggaatagggccggaaaggtgt

SEQ ID NO: 585890 - DNA, 405 bp, Homo sapiens
  misc_feature (10)..(11): n is a, c, g, or t
  misc_feature (358)..(358): n is a, c, g, or t
  misc_feature (369)..(369): n is a, c, g, or t
  misc_feature (383)..(383): n is a, c, g, or t
  misc_feature (397)..(397): n is a, c, g, or t
gcgtggtggnntcatgcctgtaatcccagcacattgggaggccaaggcagcaggatcgctgaggccaagagtttgagaccagcctggggaacaaagcaagaccctgtctctaaagaaaaaaaaatttttttaattagccaagtgtggtggcacataactgtagtctgagctacacaggaggctgaggcaggaggattgcttaagcccagggaggtccaggctgtggtgagctatgattgcattactatacttcagcctggggtgcagagcaaggtcctatttcttaaaaaaaaattaaattttttttaaagaaggaaggtgggggaaaagggacacaaacaggtggaacaattagganaacaatgggtngagatggttaggantttaatttccacgntttaaatt

SEQ ID NO: 585891 - DNA, 747 bp, Homo sapiens
gcccggcggacgcttgttgttgtccggccgggggaggcggatggtcgctcgctcgctcgctcgtgctcgctgactcgccggagcgctctgtggcggtcggtggcaggtcggtcgcgagagcgggctctgtggaagggggcgaggctatgtcgcgtgtggcagcccgtgatgtgtgcctggcagggccgggagtaacgtggactgtcgcctgcaggagctttttcccccggatacagtgctgtgccctgagctggagtgccgctggctgcctgcccttcctgatcattgacagagccctgcgactgcgcaggatgcccgacccacgaactgcaggcaccagtaaaccagaacgcggagcagaccaagaaccagaccagaccctggacacggcagcgagctgatctaaacccagaccagagcaggcaaatactaacaccctcattggagcacaggagctcattccccaaaagacatgaagctattggagaactcgaagctttgaagccatcaactcacagctttgacattgtggagaccggagattgcccacatcattggcacggaatcgagagctaactcatgtaagatggcaggagacgacaaaccacatgttcaaagcagttctgccaggagggacagacaccacgttgctggaggcactattctacacacccagaacttcagggactgagcccacagacagacctcagcaaaaagccaaaggcaggtgaaagaggagggacccct

SEQ ID NO: 585892 - DNA, 287 bp, Homo sapiens
tacaccgtatatttccttaagatagaagagttgtcactttctacaaaaagaatacgtgtgactctagtattcgcagatagtactggttgcaaagaccagctatattgtatgttcatgtgattgctctcacaacttcgtcagcccgtaactgttctgttccaccttgctatgagatagtcatggagacggtctagaaaaatcacatgctgtgtactaataatgatgcattgtaaatcatttacaagctcaaagctaagctaaaatggaaaagtgcacaatttgtcgag

SEQ ID NO: 585893 - DNA, 333 bp, Homo sapiens
  misc_feature (245)..(245): n is a, c, g, or t
  misc_feature (289)..(289): n is a, c, g, or t
  misc_feature (296)..(296): n is a, c, g, or t
cacagttccaaaaagttgattccagtttttgccagcttaacagttgcttcagtggagggaccaattcttggagctccctagtctgccatttctgtggcatcacttcctctacttactgtttttagtctgctttttataatctaacattttgccttttagtggctacattattttcctaactacctgtatgctgtgatattgaacttttggttgttgcatactttggtggtgtccagtttttttgnctcttataaaaatattgatgcaaactccagttatttcttcaggntaatttnctagaagtcaaataaagtcacagagctcttattaaga

SEQ ID NO: 585894 - DNA, 960 bp, Homo sapiens
  misc_feature (41)..(41): n is a, c, g, or t
  misc_feature (77)..(77): n is a, c, g, or t
  misc_feature (148)..(148): n is a, c, g, or t
  misc_feature (178)..(178): n is a, c, g, or t
  misc_feature (222)..(222): n is a, c, g, or t
  misc_feature (232)..(232): n is a, c, g, or t
  misc_feature (239)..(239): n is a, c, g, or t
  misc_feature (249)..(249): n is a, c, g, or t
  misc_feature (352)..(352): n is a, c, g, or t
  misc_feature (357)..(357): n is a, c, g, or t
  misc_feature (387)..(387): n is a, c, g, or t
  misc_feature (455)..(455): n is a, c, g, or t
  misc_feature (457)..(457): n is a, c, g, or t
  misc_feature (459)..(459): n is a, c, g, or t
  misc_feature (649)..(649): n is a, c, g, or t
  misc_feature (668)..(668): n is a, c, g, or t
  misc_feature (677)..(677): n is a, c, g, or t
  misc_feature (713)..(713): n is a, c, g, or t
  misc_feature (716)..(716): n is a, c, g, or t
  misc_feature (745)..(745): n is a, c, g, or t
  misc_feature (756)..(756): n is a, c, g, or t
  misc_feature (766)..(767): n is a, c, g, or t
  misc_feature (822)..(822): n is a, c, g, or t
  misc_feature (856)..(856): n is a, c, g, or t
  misc_feature (864)..(864): n is a, c, g, or t
  misc_feature (891)..(891): n is a, c, g, or t
  misc_feature (895)..(895): n is a, c, g, or t
tttgtttgggtttcttgggggttttgggatccccttcttcntccctctctcgtcctcccgcctcccctcttccgggncgtttgctgcccggttgtccctccgtgcttgtggcggcttttccgcttcccctgtctctggggctgccccngttgcccgcccttcctttcctttccccccncggcccccccttttttctgctctcccccacgcgttccccttccncgtcttcccngtctccncttggttttngtcttttgccgcccttcgcctctctccttcttctgcttcctccccccttttctttgtttcccccttttcccttgcttgctggtgccgggttgccttgcgtggngtgcntgttttctctgtgctttgttttttgttttnttcctgcgggttcccgggcgggtccctcggtggttggctccgggcccggctggtgggtgtttcttctncncncgggcctgcccggggggcccctgggggtgggggggggccccctgggtctccctccctgggcgcttggtgctttcctttttttctgttgcccgggggccgtttttttctttttgtctggttccgctgcttctggggcccgccttccttcctcggttgcccactgcctactctgtgcccggtcgtgtgttgngtgctggtgccgggtgggncaaggcacntcctacgggggctcgcagtgtgggcaggtgctgtgnttncgcacacacacaagggctgggtactgccngatccgtatcnctccggagcnncgccctgtctctctgaatgatctctggcatggtaaaagagttaactgtatttcanaaggtgaacaaaactttttttgctttgttatgcntgtttcanattgatcagtggttcaggcctggagtntgcntcagaattatctgtgaagcttagtgaaagtgctgatgccagagcccacccaaagcttactgcttc

SEQ ID NO: 585895 - DNA, 244 bp, Homo sapiens
gtgcaatacctggaagaacagacatagagttggaatatattgtatggaaggtattccagaaaaagcaattggttgaaagacggcgacttctttgacagaaaacacaagaagtcaaaaaagagcacaagatgattcttatgaatattatgatgacgactcttcagcctcaacttcatttcagccacaagcctgttcaacctcagcaagggtatatttcctccactcgcacagccaggacttccac

SEQ ID NO: 585896 - DNA, 1098 bp, Homo sapiens
  misc_feature (1)..(1): n is a, c, g, or t
  misc_feature (3)..(5): n is a, c, g, or t
  misc_feature (7)..(7): n is a, c, g, or t
  misc_feature (9)..(9): n is a, c, g, or t
  misc_feature (338)..(338): n is a, c, g, or t
  misc_feature (492)..(492): n is a, c, g, or t
  misc_feature (605)..(605): n is a, c, g, or t
  misc_feature (638)..(638): n is a, c, g, or t
  misc_feature (825)..(825): n is a, c, g, or t
  misc_feature (864)..(864): n is a, c, g, or t
  misc_feature (866)..(866): n is a, c, g, or t
  misc_feature (954)..(954): n is a, c, g, or t
  misc_feature (992)..(992): n is a, c, g, or t
ngnnngngntcgcgcggttaaccctccatactactccgcagtgttgtctcagcctctatatttcacgtccactcgcccgctctctcttacttctatctgttccatatgtctatccacaccccgcaccacgattcgcactacggcgcgaatgagcgacccggcgacgccgtcgctccctcacatttaatactgatcactcacatcatacctattacttcttctccgattctacacatcgaggcacacatctcctgatcccgcaacctacaacgcttcaccggcgtgactgcgcgccgagtaatggatgagaccagggaacctgtgataccgccgaagcnctacgatttaagtctgagtctctactacctactatcggcgcgtaccaaatcctacacaatatagtgtggtgcgttacgacagatgagaacagacgctgcgtacgagacattaggctgtgctaggcgcgcgccctgcagcatgcggccgccaccngcgcgcccgagaaatgcagggggtcgatcagcgccgagaaagccgccaatacttgagtggcgtgagatgtaatgatggatgagcataagtactacggaagagtctcgaaacantcgcagtcaataatacaactcaatacgtaaganaacaatataacgaataacacacgcatatcctagaagacacagaagacagtatactgacacgacacagcacgtgtgtagatcgatgagtgcaaattagcacagcgtagtaatgcatacatcacgcgactctgcacactacaacaaacgacaccacactaccgtactttacgcgaagcgtcatagacgngagcgtacgagtcgtctgttacgcgtataactggatgtntnagtgttatcgcttatgcatcactagaacgacgaacagtcatccttagtccgatctaaatataagtcagacgtagatacacacaggatnagtatagtactacagcacactgtcactccacacctatngcatatcgtctcacggcacgcagtacgatacgctgacatcagtccagtcacgagtcgtactaacactctctacacgctacgtctgcacacactagcggcgcgtgtc

SEQ ID NO: 585897 - DNA, 1188 bp, Homo sapiens
gaacctatcctggggctgctgtggactatgcctgctgtggcggagacggacatccaggatctgaagatttggggtcgagcaggatgttgatatggtgctttgcagtcattcatccgcaaggcatctagatgtcctatgcaagttaggacggtcctgggcagagaagggaccagcaacatcaagattatcagcaaaatcgagaatcatgagggggttcggaggctctgatgataatcctggaggccagtgatgggatcatggctggctcgctggtgatctaggcattgagattcctagcagagaaggtctaccttgctcagaagcatgatgatacggacggtgcaaccgagcatgggaagcctgtcatctgtgctactcagatgctggagagcactgatcaagacgcccgacccactcgaggctgaaggcagagatgtggccaatgcagtcctggcatggagccgacagcatcatgctgactggagaaacagccaacggggactaacctctggaggctgtgcgcatgcagcacctgattgcccgtgaggcagaggctgccatctaccacatagcaaataataagaggaactccgccgcctggcgcccatcaccagagaacccacagaaagcaccgcgcggagatgcgcggagacgctcctacacagtgcatgcaaagggggacataacccgacaacaacaaagtctaggacagtctggatcaccaagaggccaaaaacagcaaacaagcaccaagcatagcggagacacgaaaaccacacacagacccgatacatgcaccacgaggtaccaggagaaataatcaccaggaccaagagaaggacaacaagaacacagaagtgcagcgaatgagcgaccatgaaaccacagcggatcacttgggacatgtaacatctttgatatgtctcactaggattattatacagaagagagcacattacgagaaagtacgcagtaccagagtgcctctatatcgtgcttactctcttatatctgaataaggaagtaacacacgcgtatatcaaatgacacaacgaatgtatgataagcttatacttagacttcatcatcacagaagatcaagtaagaagatacacagcagtctgtgtgtccatgtctagagatatcatactacatccgaacgaactgttagactctgttatcatcact

SEQ ID NO: 585898 - DNA, 333 bp, Homo sapiens
gaggcagagagattgcagtgagctgagatggctccactgcagtcaagcctaggcaacaagagctaaactccatcttaaggcggggcgggggaaaaaaaagagtcctgtgcctagggaaaaacaaaaagaaaaaaagaggccaggcatggtggcggaggcgggtggatcatctgaggttaggagttcgagaccagcctggtcaacatggaaaaaccctgtctctaacaaaaatacaaaatttagctggggatggtggcacgctgctgtagtcctagctacttgggaggccgaggtgggaggattacctgagcccaggaggtcaaggctgctgcg

SEQ ID NO: 585899 - DNA, 132 bp, Homo sapiens
ccttcagcaactgcctcaagataactgcgtcggtcgtgcaaatcatggcgataacggaacgggtcgaactcctccatataggtgctctggacaaactcgcagctgcacctgagttgaatatccatgcgccga

SEQ ID NO: 585900 - DNA, 544 bp, Homo sapiens
cgcccttttggcccctggggaagaaatgtgacaccaaggtaggaaactcaaaaaggctgggggcccggcggagggacaacttttttggggggaaaaaacccccccaaaccttctttttgttttgggatgaaacgcctttttttaataatttaaaaagcgggtggaacagcttagaaccgtgggggttttcttaattttaaaaaacattgtaaaaccctgacccgaggggatggacccctcgccctttgcgggtttgaaaaaaccaaaggggttttaaaaaacggggaggaaacccccttttttttttaagaaaaaggtttaaataataaagcaaggggttaacccttcggcttttttaaaagaaagttattaggtttttcgtaaaagaaaccttttttttaaaaaaaagagggcgctcttaaaaaaaagaagggggaaatagcccccccctaaagagagaaaaggggctgccccattctcccagaactaaaaccttgggcgcagcccaaaaaggggggaaaaataatttttcccccctgaaatg

SEQ ID NO: 585901 - DNA, 421 bp, Homo sapiens
tggaaggatcaccagcacatatgcggccagtcagcagctgtccccgtccaggcaaaaaaagtccacgtggctgaaagcgtgatggaaaaggtgaccgtgtgaggctccatcggcccccctgggaagtggggcccctcgccctcctgtaagggttttgcaggtcgaaggccccccttaggactttggggggacgtttaaaaaaggggtgtgggaaggtaaaaaaacttgttggccaagtctttaaccccctttaaaggaatggggccctgggaagggccctccccctgcccgggccccctgcccgctcggggacaaattttttatccctgggatcatgagggtccggttttgcccccagggcctgtgttgcgacgcccaaacatacgtgttgtgtttgtcaataaagtgtaaataaggtcca

SEQ ID NO: 585902 - DNA, 570 bp, Homo sapiens
cggaatgccaatccaaggttcccaaagtccgcccgcacatccagggagagtgcgcaagagggtatggaagaactcgggctagggtgccgggagggatgtatggaatggtgtggactaggacttttgttctagagcgtttggctttatttgccttgttgttatcgttttgttcgaaaacgggtctacgctgccttcgaatccgggaaacgtccttctgattaaggtatgggagtatgctacctaccgtactttatgtggggcctcttgtataggtttagggtctatttggaggtattgatttgttcttgatctttcgagggggtgtctttgtcttgctcctcgcccgttttggattttatttttagtggacgatctggatgggtctccgtgaggtataaggtctaatccctgtccgggggactcttatctttaggggtggtttccccgtcggcggctagttccattttctcttttgagaggatcgaactaatataccttagtacttgtagcttagttgttgtactataccttctaggggcgcgtgcgctgagcctggggattgattaatgg

SEQ ID NO: 585903 - DNA, 266 bp, Homo sapiens
  misc_feature (76)..(76): n is a, c, g, or t
  misc_feature (170)..(170): n is a, c, g, or t
  misc_feature (183)..(183): n is a, c, g, or t
ccccccttgggggttcccagtaggaccctggtttgtcccttccccttcaccgctccccaaagttttgcaccccctnttcctccccaaacacacccaaaccattttattttttgggccattcccccaaaccccttattgctgccaaaaccacatgggttgggggccagggntggatggacaaanccccttcccccacccaaatccctcccgtgtggggttggaaaacttttgttttttggggttttttttttttgaataaaaaagat

SEQ ID NO: 585904 - DNA, 268 bp, Homo sapiens
  misc_feature (40)..(40): n is a, c, g, or t
  misc_feature (51)..(51): n is a, c, g, or t
  misc_feature (53)..(53): n is a, c, g, or t
  misc_feature (60)..(61): n is a, c, g, or t
  misc_feature (77)..(77): n is a, c, g, or t
  misc_feature (80)..(80): n is a, c, g, or t
  misc_feature (85)..(85): n is a, c, g, or t
  misc_feature (121)..(121): n is a, c, g, or t
  misc_feature (156)..(156): n is a, c, g, or t
  misc_feature (161)..(161): n is a, c, g, or t
  misc_feature (205)..(205): n is a, c, g, or t
tggcccggcggttggtggcccgggccctgggactccaacncaaaaaaaaanancggcctnntgtccggggtccgctnccnccctnaggcctggagacccaactggcctggatttgggtccngacgtagctggggcccccaaccccataagccttcncagangccagagcagccccgcccccccctcgagtttccccatggggtgnggtgggctttagtttagtcccagaaatggagaaaaaataaaaactcccgttgttttaatgtga

SEQ ID NO: 585905 - DNA, 311 bp, Homo sapiens
ggggaaaaagtagatagttacgtaaaccaaaaataaaattctaagtcccccaaccatcagaatggaccccttctcctgaccaagggcattccaaagctaacctgaaaaactacttcaggccatgatgcgaagtgaggtttggatatgcctcattataccctcctctcttctggaattcagaaaaagctaaccaccattaacaacaacacagacgttaagtttcacaagaaacagttacaatctattctctctgaagcctgctatctgcaggcctcatctgcatcaagggtgtccactctttttgcttccgt

SEQ ID NO: 585906 - DNA, 279 bp, Homo sapiens
gggaaatttttttaaaattgatggaccttggggggcgggtttttccctccaaccggaggggatttattcctggataaaagccccctttatggtttcaccatctttgggaacctttggggtttttgggggttttatggttaatccccctccggcggggggtttttgccttttaaaaacctcccccccttttgggaatttaaaaaaaaggtttttttccggtcccgggggtggggaaaaaatggtgccggttttttaaaaaatggaaaaaaaaacttttta

SEQ ID NO: 585907 - DNA, 308 bp, Homo sapiens
gcttatttgttccacaaaagtacagttccattttttatataaatagattctacctaacttataacccctatgtcaaaatttgtttatcttaaaatagtttgtataaaaagtctttactgctttattatgaaataataatgtttattgtagaaaaatctaggaaaacacaaaaatgtcaaactcagttaacagtcatagtttcactatttgaagttaaccactgttaagattcttttttttttttttttttttttgatttgagattgtgccactgcactccagcttaggcaataaaacaagactgtctc

SEQ ID NO: 585908 - DNA, 213 bp, Homo sapiens
  misc_feature (139)..(139): n is a, c, g, or t
  misc_feature (143)..(143): n is a, c, g, or t
  misc_feature (150)..(150): n is a, c, g, or t
ccgtcacacaagaccctgttgagcttgactctagtctggcagaagcaggaagcggcagaagcaggaagcggcagaagcaggaagcagcagaagcaggaagcggcagaagcaggaagcggcagaagcaggaagcaggagnaggngcagaanagaaggggaaggatcaaaagcccaccatgccccaggcagaagcagaagcgggccgagctcata

SEQ ID NO: 585909 - DNA, 232 bp, Homo sapiens
  misc_feature (158)..(158): n is a, c, g, or t
  misc_feature (162)..(162): n is a, c, g, or t
  misc_feature (169)..(169): n is a, c, g, or t
actctagtgatccccctcaccaagaccttgagaatgcaggaagccacaccaagaccttggcctcatctagaaggcagaagcaggaagcggcagaagcaggaagcagcagaagcaggaagcggcagaagcaggaagcggcagaagcaggaagcaggagnaggngcagaanagaaggggaaggatcaaaagcccaccatgccccaggcagaagcagaagcgggccgagctcata

SEQ ID NO: 585910 - DNA, 396 bp, Homo sapiens
  misc_feature (204)..(204): n is a, c, g, or t
  misc_feature (322)..(322): n is a, c, g, or t
  misc_feature (326)..(326): n is a, c, g, or t
  misc_feature (333)..(333): n is a, c, g, or t
ttattggcagaagcaggaagcaggcagaagccttcctgcttctgcccacccgagattgagcaataacaggaagcggcagaagcaggaagcggcagaagcaggaagcaggcagaagcaggaagcaggcagaagcaggaagcagcagaagcaggaagcggcagaagcaggaagcggcagaagcaggaagcggcagaagcaggaagnagcagaagcaggaagcggcagaagcaggaagcggcagaagcaggaagcggcagaagcaggaagcagcagaagcaggaagcggcagaagcaggaagcggcagaagcaggaagcaggagnaggngcagaanagaaggggaaggatcaaaagcccaccatgccccaggcagaagcagaagcgggccgagctcata

SEQ ID NO: 585911 - DNA, 378 bp, Homo sapiens
  misc_feature (186)..(186): n is a, c, g, or t
  misc_feature (304)..(304): n is a, c, g, or t
  misc_feature (308)..(308): n is a, c, g, or t
  misc_feature (315)..(315): n is a, c, g, or t
cctcaccagaccctgccacgtttgacgcttacaaaaaaaatgatagaaaaatacagaagagaagcaggaagcggcagaagcaggaagcaggcagaagcaggaagcaggcagaagcaggaagcagcagaagcaggaagcggcagaagcaggaagcggcagaagcaggaagcggcagaagcaggaagnagcagaagcaggaagcggcagaagcaggaagcggcagaagcaggaagcggcagaagcaggaagcagcagaagcaggaagcggcagaagcaggaagcggcagaagcaggaagcaggagnaggngcagaanagaaggggaaggatcaaaagcccaccatgccccaggcagaagcagaagcgggccgagctcata

SEQ ID NO: 585912 - DNA, 403 bp, Homo sapiens
  misc_feature (211)..(211): n is a, c, g, or t
  misc_feature (329)..(329): n is a, c, g, or t
  misc_feature (333)..(333): n is a, c, g, or t
  misc_feature (340)..(340): n is a, c, g, or t
ccctacaagacctgcacagaggagggtaagaggaggggcaggaggaggaggaaggaggagaaaggcgagggggatgaggagggcagaagcaggaagcggcagaagcaggaagcaggcagaagcaggaagcaggcagaagcaggaagcagcagaagcaggaagcggcagaagcaggaagcggcagaagcaggaagcggcagaagcaggaagnagcagaagcaggaagcggcagaagcaggaagcggcagaagcaggaagcggcagaagcaggaagcagcagaagcaggaagcggcagaagcaggaagcggcagaagcaggaagcaggagnaggngcagaanagaaggggaaggatcaaaagcccaccatgccccaggcagaagcagaagcgggccgagctcata

SEQ ID NO: 585913 - DNA, 128 bp, Homo sapiens
  misc_feature (84)..(84): n is a, c, g, or t
tgtttgcccctgtggcattgtgtcttgttccatatggataaaaggaacaacaacaacaatgccatcactggaatttacccaccntttgtgagcgtgtcgtatgacctagtacacttatgtaccaattc

SEQ ID NO: 585914 - DNA, 201 bp, Homo sapiens
  misc_feature (47)..(47): n is a, c, g, or t
  misc_feature (51)..(51): n is a, c, g, or t
  misc_feature (64)..(64): n is a, c, g, or t
  misc_feature (143)..(143): n is a, c, g, or t
  misc_feature (172)..(172): n is a, c, g, or t
  misc_feature (180)..(180): n is a, c, g, or t
ggaccaacgttcaaggccgcctggggtaaggtcggcgcgcacgtggncagntatgggtgcggangccctgggagaggatgttcctgtccttccccaccaccaagacctacttcccgcacttcgacctgaggccacggctctgnccagggttaagggccacggcaagaaggtngcccacgngctgaccaacgccgtggccaa

SEQ ID NO: 585915 - DNA, 350 bp, Homo sapiens
  misc_feature (204)..(204): n is a, c, g, or t
ttattggcagaagcaggaagcaggcagaagccttcctgcttctgcccacccgagattgagcaataacaggaagcggcagaagcaggaagcggcagaagcaggaagcaggcagaagcaggaagcaggcagaagcaggaagcagcagaagcaggaagcggcagaagcaggaagcggcagaagcaggaagcggcagaagcaggaagnagcagaagcaggaagcggcagaagcaggaagcaacatttcttctggaagagcttgtattctactggaagggaaaaaaggaggtagtaaggacagaggcagaagcaggagcaccattgcagaagcagaagcgcaaacagaaggacgc

SEQ ID NO: 585916 - DNA, 282 bp, Homo sapiens
  misc_feature (21)..(21): n is a, c, g, or t
aaaggatacccctaaaaattnctctgtggcaagaaatgtttagataggaaaactgagctatggaaaattatacagggccagataagttgaactcctaatagcaacaggtctggcatccttccagccatgtctacacagacacccagagtagcctccaccctggagggatgaagggccaagctactgtcaggcatcttcttgccagtgaccattaaatacacatacacagacacccccccacacacacatacacacacacacacatacactccaaacagaagt

SEQ ID NO: 585917 - DNA, 448 bp, Homo sapiens
ttgggcgtttccggagagggggatgtggcaggacaataggataatagtggagagaagatcagcaggtaaacacgtgaacaaatgtctctgcatcataaacaaggtaaagaaaaaagtgctgtgcttttgatgtgcatatacataaacatctcaatgccttaaagagcagtattgctgccagcatgtcccacctccagtcctaaggcggttttctcctatctcagtagatggaatatacaatcgggctttacaccgagacattccattgcccagggatgagcaggagacagatgccctcctcttatctcaactgcaaagaggccttccttcctcttttactaatcctcctcagcacagaccctttacgggtgtcgggctgggggacagtcaggtctttcccttcccatgaggctgtatttcagactatgacatggggagaaaccttgga

SEQ ID NO: 585918 - DNA, 456 bp, Homo sapiens
ccaggactgcccggaagggagctctccatggcaagtcaggacaggtttcagtatgctaatataacatagaaacacattagtgcactgagcctctctgaggtcagcatattagtactcttggaatatatgtaattaactacagtaacaacagcaacaccccagtagggagtatcaccaataactgactaccactcactcatggatcattatctttccaattaaagcacaagcactgtgctgtgctcagctactactcagtttgtcagtaaaagtttatagttttcagtgttcaggttatagaatataacagaccataaaaattacctgcaggtatttactttttatgaccttgtttataaattcacaagtaattactggtgtcattaagtaatatagacagacacacgtatctcccaaacaaacaaaccgtgcccttctccatgggtcacaggactt

SEQ ID NO: 585919 - DNA, 406 bp, Homo sapiens
acccacttgagcttactaccgcacaaccttcaccacaccatttacccaaataaggattaagctatggaaatagaaacctggcgcaatataaatagcaccgcaagggatacacgaagaatcataaccaagcataatatagcaaggactaacccctatgccttctgcataatgaattcgctataactaacttcgtaaggagagccgctaagacccttgataccagactagctaccttcgaacagcgttgagagcacacccgtctatgatgctgaatagagggaagatttatacgtagaggcgacgaacactaccgagcctgatgagaactggatggccaagatagaatcttagttcaacgatctatatgaccacagaaccctctcgatgccattgtatgtccctgttg

SEQ ID NO: 585920 - DNA, 957 bp, Homo sapiens
gaactcggtggtggccactgcgcagacccagacttcgctcgtactcgtgcgcctcgcttggcttttcctccgcaaaccagtgtctgaccaaacccgactatggctgacgactcgacgaaacttcgactaacgtcgaacacctgaacgaacgaccacgagaccgcaacgagacaacaactcccacgtgccttccaaacgacaacgacttgcaacaggagcaagcaaagcagcgcgaactcgtcaatgacggcgttgcgccgtccaaatatgcactggtaccatttccacaacgcatggccattcttatctccaccttctttctagcaggtttcacacttggtaagcatgcacacagaggtcggcatcacagtttaacatgacgtgtgctgcccactttcacattcaccagacactactgacaacgcaaggccggcgcctgccttttccccatctgtctatctatctggctggcagggacaggacagaccttgcatgtcggtgacggacgacagtgccggtggccagacctggggtggccaccgacacgtgcacatctacgagttaaaaccatgctggcccaaggcggtcctgtcagggcttgtaactggcacttctaatcagagtggccattccccacttcaggtccaattgcattctacttcatgggcagtggcacacactttttcaaactactgcacatctcacgaggttttcaacactatcgaccccgaacatgccacacagaccgacagttatggagagatctggccctggccacccaccactcccggcacacccccggcgcgagaccaggccacacaagcgctaccacacaagggggccaccccgtccaaagacaccccggacacacagagacgcagatcccacacaaaacaccgccggggacaccagcgcctcgaaaaacaacacgagcccacgcgacacgtggcgcaaacg

SEQ ID NO: 585921 - DNA, 847 bp, Homo sapiens
ctgaaaaattttagagctaggtatagtgatgcatgtccaatgtcctattgaccagtagctctggtgcactaggacttggacatgctcggagttactatactctaggtaaagatcgatagctgtttatcttcacctcgtccgcatgatagtgtgaagctcaatcatggtagacaggattacttttaccccatatttgcgagatctctaggttatccctcgtgtgctgatttcattgaatgtaatgcttttcccaacgttattcctagtatgtagggatatactttatctagatgctgctcgtggcgtgctgaatgatagggcaaggtctgtccagggtaccgtcgagcacagatgcgtcggtcgactattagagaagcaatatgggtcgcaactcggtgtcatgcgtttgcaggtccaagttgtatgattgacagtgttttgggaaaatgtgagcatcttatggatgctgatgaacgaatagtaagggctatgacaagtgaatctgagatgatatcgttacatgtaactttagagggttcagttacttagttgctggtgtccgcggggatggaatggtatgaggctgggggtatagttgagccgtgagattttacgtatgctgatatcacataacttgtgaggagtggaggtgcaaatgccagacatggtgttgttgaaggtgcgtggtatagaaattttggagtcttgggtgcaatgtgttgaggtgcctagagattgtatcaagaagttttttgtggttcttaaatgttagggagcagtgcacagtgggggaccaaaagggcgggcaaatggtggtgggttcagtagacagtttgtgatgggtgga

SEQ ID NO: 585922 - DNA, 412 bp, Homo sapiens
  misc_feature (94)..(94): n is a, c, g, or t
  misc_feature (113)..(113): n is a, c, g, or t
  misc_feature (122)..(122): n is a, c, g, or t
  misc_feature (210)..(210): n is a, c, g, or t
  misc_feature (232)..(232): n is a, c, g, or t
  misc_feature (336)..(336): n is a, c, g, or t
tgttgtacaactgcataatgtatttttattacaacagtcaaaagtttatgaggtaaaaattacagtaaaggttaatttattattggagagaganaatttaagaaataaatttngcgtagatnaaatctacagtgtttttaaagtctacagtactgtacagtaatgtcctaggccctcctattacccagacatgttctagtcctgtaagcngcgttgatggtaagtgccctangcaggtatacccttttttatcttttatgctgtgttgttactgtaccttctctatgtttaggtattccaatgcttacccttatgttaaaactctctatagtattnccctatgggtaacatactgtacaggtttttcgtgtaggagcataggctataccctatagcctagtgtgtagtatgc

SEQ ID NO: 585923 - DNA, 1008 bp, Homo sapiens
  misc_feature (206)..(206): n is a, c, g, or t
cccatctcgaattagccaatgtcaaaagagtgacctgaatgagaatttagttgacttcatagactaaatcctaaagaccttttaggcttggacctatgaaaaatataagaagtttagttagcttgtgagaactttcacttttatgacaaagagaaatagttgaaggaagagggaaagtgagagcaggtttgggaaggcactaaggntggaggcaggaaaaaggctcatgggcttcttcctcccctcatgtctccctccacctgaatcccgtttgttccagactggagacaatggcaactgtcttctgagaagtttcacattatttctcagagcaggggtacagtcccacagaagctaccccagtttttatatggaattggcagtcaccagcactataaagattttctttactaatgtacttccctagacccaaaacagcacaggcctctttgaaactgcaatgcagagacttactgcccggctaccaggggtggggtgtatgaggaggacagagttgcctgggctttctccagatcaccggaacagtgtctgctcatgaccttaggcccttcacaagctccccaactcccagcactggtgtacccactggaggagaccagcagggaaagccacgacagagtgtgaacacctggtcagtggggcggtcctctgactttcctgcagaagtccctgttctgagacagttctgaaagttctggaagatgtggaagcagggatttaagctgtgctttatctggtgcaattataagggatccatttaggattcttgaaaggatccagaaaaactggagaaagaacaaaggtaggtagtctaagttgaaatgagaaacaacgttatttagggaggtttaggacctcctgggtagaagagatttcacagtgtttatacaagtgttcattatagtcaaactagtaggttataatattggcacaagtggtacacaatgtgttacaactgtgaattttgaagtggcaagacgaaataac

SEQ ID NO: 585924 - DNA, 699 bp, Homo sapiens
ctggtagcgtcagcctcctggcttttccttttcctggacgcttcatgggctccgcggctgcgctagactggagggtccgcgtcactctcgccctcctgctttccgcgctctcacccgctcccgcctcctgagggcacgacttgtggaggagcgcgggcggcggggcgtgagcgagctgcctctgccgccatcttagagaaggcgagcgtggggtgtgctgtgggcgcgagtcggcctcccgcggtgccgccgcagcgtggcgcggagagctttaaaaaaaaaagtctggggccgggcgtggtggctcacgcctttaatctcaacactttgggaggccgagcgggtggatcacctgacatcgggagttcgagaccagcctgaccaacatggagttaccccatctctactaaaaatacaaaattagctgggtgtggtggcacatacctgtaatcccagctacttgggaagctgaggcacggacgaatcgcttgaaccctgtggaggcagaggttgcggtgtggccgagaatctgcaccaattgcaactccacccttggggcaacaagacgctaaaactcgggtctcaaaaaaaaataacacattggctctggacaacatctccaacttgctctttcaaataggaggcggcggagccaccacttgggtggcccgcacaaatgacttaacccctgttaatcca

SEQ ID NO: 585925 - DNA, 307 bp, Homo sapiens
  misc_feature (69)..(69): n is a, c, g, or t
  misc_feature (145)..(145): n is a, c, g, or t
  misc_feature (196)..(196): n is a, c, g, or t
  misc_feature (231)..(231): n is a, c, g, or t
  misc_feature (303)..(303): n is a, c, g, or t
gtaccatggggctagagtgtatggcaagatcttggccaagtatcagtaaagttaataaattaacaaggnatgttgaggaatctggagattagtaacagtggaaagccattatcatccctgctatgtggaaaaatgggagggacanaaatttttgtaagggactcaagtgagagctgctggaagaaaaggatgcccngatcagatctgtgattgtagtggggcagcaactgnatccaaagccaagtagagagaagaagggaacaacattcacatctctgttccctttagccctccaattgtctngcca

SEQ ID NO: 585926 - DNA, 142 bp, Homo sapiens
  misc_feature (38)..(38): n is a, c, g, or t
gggtcgctctagaggccccccgctcacaacaggcacgngcaaaaggtattcactagatttctacgtagtgatcggcttttacttggtcattggtagtctcaaaagacttttttttaaaaaaataaagtccatacttacactt

SEQ ID NO: 585927 - DNA, 713 bp, Homo sapiens
  misc_feature (645)..(645): n is a, c, g, or t
gagaacagagtagaggcggcggcggcggggggcggacccagactggtagtgaggctctggaccccgagcccgctgcaatgccgcgtggaggctggagtctgtgtcccggagcgcatgggctgggctgggttaacaacccaggtgacttctatcgattgccagagtatcgggcgcaatgaaccactcgatggtgctgacgcatggactgtcagccataggcgacgatgataccgcatggcgcaaggagtgttggggctgtattgtgccaataggttcctagagaagagtgaggcataggaattcaatgttttgacattcggtgataacgctctcgtgatgtaggcctataactagctcggatatgcatgttccttggcgtggacatgacgatactggtggagacaactgagcgagatcgtggagttcagccatgcatcagtatcgagggaacgcttgctagggatggtatcgcctgaggtaaggttggtgactctactattcactgccgtctgggtctatggatgacgtatggtagatagtaattgctctgcatgagacatgaatgcttcctattctttacaaatgttgtgtagtctggtatgaccatttaattaattgttcctgtaatctggaaataggacaggnctaaatagaatgtcggcgcaatgggatgattctccagtgtggaatgcagttcgatgtgacaccagtga

SEQ ID NO: 585928 - DNA, 220 bp, Homo sapiens
tcagcggacccactgacgccagcctactcatcattttaatatgcattcctaatgacatatactgtacagcatcttttcatatccttacctgccatctgtgtatcttcttcggtgaggtgtctgtacaggtagtttagccttttttttttttttttttttttttttttttatttttttttttttttttttttttttttaccccccgaggggggggaggggg

SEQ ID NO: 585929 - DNA, 683 bp, Homo sapiens
  misc_feature (58)..(58): n is a, c, g, or t
  misc_feature (98)..(98): n is a, c, g, or t
  misc_feature (116)..(116): n is a, c, g, or t
  misc_feature (118)..(118): n is a, c, g, or t
  misc_feature (207)..(207): n is a, c, g, or t
  misc_feature (218)..(218): n is a, c, g, or t
  misc_feature (232)..(232): n is a, c, g, or t
  misc_feature (234)..(234): n is a, c, g, or t
  misc_feature (250)..(250): n is a, c, g, or t
  misc_feature (272)..(272): n is a, c, g, or t
  misc_feature (297)..(297): n is a, c, g, or t
  misc_feature (299)..(299): n is a, c, g, or t
  misc_feature (302)..(304): n is a, c, g, or t
  misc_feature (362)..(363): n is a, c, g, or t
  misc_feature (375)..(376): n is a, c, g, or t
  misc_feature (390)..(390): n is a, c, g, or t
  misc_feature (395)..(395): n is a, c, g, or t
  misc_feature (401)..(401): n is a, c, g, or t
  misc_feature (403)..(404): n is a, c, g, or t
  misc_feature (407)..(408): n is a, c, g, or t
  misc_feature (414)..(414): n is a, c, g, or t
  misc_feature (421)..(421): n is a, c, g, or t
  misc_feature (432)..(432): n is a, c, g, or t
  misc_feature (440)..(440): n is a, c, g, or t
  misc_feature (443)..(443): n is a, c, g, or t
  misc_feature (452)..(453): n is a, c, g, or t
  misc_feature (457)..(458): n is a, c, g, or t
  misc_feature (465)..(465): n is a, c, g, or t
  misc_feature (470)..(470): n is a, c, g, or t
  misc_feature (487)..(487): n is a, c, g, or t
  misc_feature (489)..(489): n is a, c, g, or t
  misc_feature (498)..(498): n is a, c, g, or t
  misc_feature (529)..(529): n is a, c, g, or t
  misc_feature (535)..(536): n is a, c, g, or t
  misc_feature (545)..(546): n is a, c, g, or t
  misc_feature (564)..(564): n is a, c, g, or t
  misc_feature (570)..(571): n is a, c, g, or t
  misc_feature (579)..(580): n is a, c, g, or t
  misc_feature (600)..(600): n is a, c, g, or t
  misc_feature (619)..(619): n is a, c, g, or t
  misc_feature (662)..(662): n is a, c, g, or t
ttttcataggcattatctatttgaaggcactttttacttattagactataagaaaaantgtacagaaagtttatactataaaattacatccctaagtnattagggtcctcagtaananagaaataagaaattgaaaagggtcattgctcggcaatccacataactacagagtagagcgcaagctattgttcgtgatcagaaagaganttcataaaaanatcttcacatattncntagcattatgccctantagtaaaaggaaggcctatganaatgccattgtttattttgtgttangnagnnnttctatttccctcaaaagtttttttttcctgctataagataaagaaaaggctgtatcnntaagatatatanntaatgaagattatntcaanagaagntnnaannttttcnatttttnaatgtttttcntgaagttnaantggatgttnnaaannaattttntaaanatttaattgttgattanantaataaaantagaattatttagaaaaaaaaaataaaaaanaaaaannataaaaaannaataaaaaataaaatttnaaatanntatatttnnatataaatataaatttaaanttaattattttttataatnaataaaatataaatttttaaaaatggaagttttaaaaaaaaanatgtgttaagaaaattataat

SEQ ID NO: 585930 - DNA, 361 bp, Homo sapiens
atctcttacccttgccccctccacccggtcttggtggtggtatattaaaaaaaggaagaattgaaagcacaaaaaaaagaattttggggtcaattggataaaggggggatattttgcaacccaattgtttaagtaccaattgggcgtgtatcacactccctgcccggtctctgggcactgaaatataggggaaaaaaacccctccctactgatataaatgacacagagtattagagtatctggttctctgtctcttttatcccctccctcttcagagccaatatatgtgtcacactcgacgcacagagcaacaaatgggttccccatggtataatcggcattgtggtgaattatctacaca

SEQ ID NO: 585931 - DNA, 468 bp, Homo sapiens
  misc_feature (391)..(391): n is a, c, g, or t
  misc_feature (452)..(452): n is a, c, g, or t
  misc_feature (466)..(466): n is a, c, g, or t
ccactgggagcattcctttggtagctgctgctgatttttgtccaccactattttcctcttctgtagttgatggaaaagccttctttttacaccagtctttggggctatttattaggctgcaggaccggcatatgccctggttgtattttagtctgccctcttgaggaaaacttaggtccaactttcctgggatcttcacgtaagacactggaatggtaccacctgtacccagttttacattcaaaatagcttttccccagatcctgaactaagattatgccatcctggttgtcaaggaaggatgtctctgccctgttcaagaggacttcaagtcaagaagcaaggcaattaaactggtgggttcccccccgataattgtgtaagagtcttnaatccagggtaatcaaaggggtctgaactgtaaaacttatcctatcaaatcaaatcaatcntaaacttgggcctnag

SEQ ID NO: 585932 - DNA, 633 bp, Homo sapiens
  misc_feature (26)..(26): n is a, c, g, or t
  misc_feature (45)..(45): n is a, c, g, or t
  misc_feature (62)..(63): n is a, c, g, or t
  misc_feature (71)..(71): n is a, c, g, or t
  misc_feature (87)..(87): n is a, c, g, or t
gatcccacgtccgtgggggccctagngtcgccaggttcacagagncagaaagcggaatggannaggcaggnctggggggcgtggggngtcagtgcttcctggggacggagcttcggcctgggaggatgagatgttctggagaggacggtgcggtggctgcacagcattggaaatgtgcttaacatcactgaactgtgcttaaaaacagtgaagacacagttaagctggaaaatcttaggttctgcattttattacaagttttaaaaagcttgggattgctccacttctgaagaaaggagaaaagcgcgtccaccgctgcctctggttcccacgtatgggcagcgaggctggcaccgggggaccatcccagcatgcacaccctgctggctggcctgctgcccgtagcctttgctggaacacggctgctccaacatctgagcttacgggaaatcctgggcaacaatgcatgaggctggagactctgcagagggtttttaaagttgcaaaggaacaaatggcctcattaatggggccgacacatgttgttaatttaccttctggaaaataagaagcacagatgttggtgactcacgcgcgtaatcccagcacccgggaggctgaggtgggaggatc

SEQ ID NO: 585933 - DNA, 352 bp, Homo sapiens
ggaaggggaaaagggccccaaaagcaaacccccttttcccggggggtgggggatttattaaagcaagtgggcccccaggttttccccctggaaaaggggcagtgggggcaacccaattaatttgggttaggtccctccttaggcccccccgggttttccctttttggtttcgggttgtatgttgtggggaattttgaaggggtaacaattttccccaggaaacaattttggccctgatttcgccaaggttggaatttaccccccctaaaggggaaaaaaaatgggggttccccccgggggggggcgctttaaaaaaaatgggtcccccggggggcaggaatttgggccggga

SEQ ID NO: 585934 - DNA, 220 bp, Homo sapiens
agtactaggcctctctctgtctccctatgcggaacactcatagtggacgttacctgaatatcatcagccaatttgttctgagtcctataagtctcctcattaagcgtacagacgaaaatcttactgctctaaagaaatgtgcttacatatccgagttcactccttgcacgtttccttttccttaaagccaatcattttgctttcaagaagcaggaactgg

SEQ ID NO: 585935 - DNA, 865 bp, Homo sapiens
agcgctctataccctgtttcgttttgtcgcgggtgtaccgtcactgggtggtttttatttcacctgtggcagcgtcttgttgcgccctaattgtttacaggctcttaccggttaaatttttccccgcgttaataaacaaaattcggggtgagtactccggtaatctgcaaatgagggctaaaacgcgagtttccttcacatacagagttgtggtgagcaaaagcgtggctttgatatcgcctcgcccacctgtatgtgactatggcccaaaatcatgggtagcaggtagcaaagaacccaatggtctgtcccaaaagaactctcccctgtatgattcaaaaaagggggagcccaatcagggcacgaccacattcgttgtgggcccgcggccgaaacattttcttcttgccaactcccgtccctgggctattctagattttaaaacagagcataatgacccttgttgttgaacagccctaataatccttggactttcgtgttacccgggtataccccttctatcaaggtacaatttatgagaatccaggggagtgcagcaatctgaataaattctgcccccctcgtggggcaagtcacccctctattagaattcacccccaatggcgggataaactccaggatcccgactatggttggatctctctgacagaggaccacgacgattcactttggagtgacgcccgcccgtgaatcttctagaaaccagggggatctcccggcccgcttttgaaacacgttaacttgggcgattttttgcaaaatcgtgccctttttgggaagacaaatatatgggcacaaacgaactcctttcttggaaacaaaaaaaacaccccttcaaaaaaca

SEQ ID NO: 585936 - DNA, 465 bp, Homo sapiens
  misc_feature (341)..(341): n is a, c, g, or t
  misc_feature (399)..(399): n is a, c, g, or t
  misc_feature (419)..(419): n is a, c, g, or t
  misc_feature (427)..(427): n is a, c, g, or t
  misc_feature (447)..(447): n is a, c, g, or t
agcaggggcttgggcaggagcaaggtccgagggctgccaggtccacgctgcttttatgagctgtaacactcaccgcgaagatctgcagcttcactcctgagcccagcgagaccacgagcccaccgggaggaaacaaacaactccagacacgctgccttaagagctgtaacacttgccgtgaaggtctgcagcttcactcctgagccagcgagaccacgaacccaccagaaggaagaaactccgaacacatctcaacattcagaacggacagattccagacggcaccacctttaaggagctgttaacattcaccgcgagttttccgcggctttcattttttngaagttcagttaaggacccaaggaacccaccattttccgggacacagttaggcttttnggggattatttaaggatttnttaggttngggcttggttggttacacgncttttagggacccttagg

SEQ ID NO: 585937 - DNA, 256 bp, Homo sapiens
taccttgagcccacctctcctccccatcctcaaccactggacgtaaatatatatataggcagggatagaaatgggcacctagtcagatcttctaagcttgctagccagaaatgactgtgattctagcatgggggctgctgagaaggtaatgtaggtcgcaaaggggctctaagttaatttataacgtaagcattgacactatccacacactccctgtagtccaggtagggcccagaactaggacaatggctaggat

SEQ ID NO: 585938 - DNA, 896 bp, Homo sapiens
gtttggaccatccccaaatggggtcggctgctgtcttcggcgggctgggtgtgatgtatatcgcgcggtcttctgggctcgcgtttgcccggccctctcggaccagaggccctctagcgctgcggtgccggcccattggcccgctacgggcgtttgctgcttcggagggtgaaagacccccccttttatccggctgtagccccagaccatgtcaggcgtgctgtggctccaccgccgctagagccgggttctcgcttcgccatgattgaggagcgcttgcttctctaggccgccagccatggcccggccagttgccttggggctaccagatgggggaactcctgcggagtgctcacaaaatacagggacgaagttcagggcaccacccagggtcctgtgtgcagacgccctcacacgcgcacagcagcattcaacagagctgggcaagggaaggggagagagatcaaggattgaaatgaagggacttcaagaagaaggtacagagctagagcccgacccacacacgatacgtgggtaactaagccagcgagctgtacacacacactccgtaaataataaagtgacaggtcgcgactggccgcgcaagagaaccgcaagagcgggtcccggccagcagagggggggcccacacggcgcgcccggccagaacaacgccaggcgtcaactcgtgacaccgactttcggggagaacaacaatgacgggtcccggcgccccacgagccctccctccggggttaaactcgcttgtaaaaaaaatgccccgccggaccccccgtcgtgacaggggcgaatcccttctccccgcgaccattaatttgaccacagattttaattggaaaaaataaaaacccccagttacccggccccacatgaca

SEQ ID NO: 585939 - DNA, 363 bp, Homo sapiens
tgcgacaccgtgctgagaatgtgttatggccaggtgatggatggctcacacctaatcccaggattttggtaggcccaggagaccagattgcttgagctcaggagttcaagaccagcctggtcaacttggtggaaaccctgtctctactaaaaatacaaaaattagccaagcttggtggcacatacctgtagtcccagctgctcgggaggctgaggcaggagaatcgcttgaacctgggagatggaggttgtagggggctgagattgtgccactgcattccagcctgggcagcagagcaagactccatctcaaaaaaaaaaaagacccaactttctaaaattatggcgtggggaacggcgctta

SEQ ID NO: 585940 - DNA, 399 bp, Homo sapiens
tggtagaggtcacttagagagaagctgctgggccatgcacacacaatcttggcccttagtgctcatcccattcctcatgtgaccctgacattccggggaactgggacacctgttccttaaaggcgacaacagtcctttctttcctctcacaacaaatgagcatgttctccgtgaatgcacttttcatttactgctctcaaaataatatgccttctctaggaatttttaatgcacttttcttgaatgtcatgctcccagcaacacaagcattggtcttgttagggcattcccgggctcgggggcggccgctcctacatgtggtaccagcggccattaggaagtacctgcccacgtaccgttcctactatgactcagtggacccacgcatcacctacgggt

SEQ ID NO: 585941 - DNA, 101 bp, Homo sapiens
tctatgcttgtctcgtggtccgtcatgttacacacagtctgtatctaggtgaccatgcaagagacccagtcattagagaatactctctacatccttcctca

SEQ ID NO: 585942 - DNA, 123 bp, Homo sapiens
cctgtttagatcagaaataggttgagcctgtgtcaagggtcctcattacggtatcacaaggtagcagctccatacttaccaagtatatcttctgtttacggggactgctacacaggttcaagt

SEQ ID NO: 585943 - DNA, 756 bp, Homo sapiens
  misc_feature (363)..(363): n is a, c, g, or t
  misc_feature (383)..(383): n is a, c, g, or t
agcggagcggtgggcagggctgaaaagacagaaggtgtgagtgaatgaccttcttcaggtggagaagcgtctggagctggtgaaactaggtgtcccacaggcacgcacaagaagctcaccgcatgtctgcggggccagcaaggggcagaggcgtgactagacgctccataaagttgcctttgacagacatcgtggctcagtgtctgatggaggggtcagctatcctgggcagatgacacacttcttgggaagatggctgaaagctctgtggagagacggcaggacaattcgtggcgtcaagagcatgagtacatgtctcttgagcttgcaaggtatgacgagagacgtgagtggagccccgtntctatatgcttggcggaggntggaaatcccaatgatatgtcaggaagcggaggagacacttagcgcaagttggtgctggacagtggattgcctcacgaaccagggtggcagcagacttccaaggtcttcaggtgtgtcgcagcagcttacaggcctgcgggtgccaaaggctgatgccctcagggaggaaactggaggatggcgtgccaacagagtggagatcttgcagggaccaagctctcagctgatatgtgcagatgatgtggccaaaggaaattgactatgcaagactactttgcaaagcgctaatagaagtgcaaagctgaatagcacaggaagttcctgacactatggcaggctgctattgcctcagatcaaagcacaacaggaggc

SEQ ID NO: 585944 - DNA, 546 bp, Homo sapiens
gctacccctttgcttcatctgttctggtcattggctgggagtgcacctccggaggacgtctcatgcagacttgcaccatatacagggagtgttgcattgaaggtccttgctggaccttctgtcagaaggtgatttcaaaagcgagcaatgctgccaatgcagcttgcttctcttgacagattgagaagtccagcttcaaaagttacctgccatttaagcaaggagtttgtcacgagatcatggttcattttattgaaaagactttaaggagtcgtaggatttattcatagattgctgagaacaatggcaatatttttatttttacagagtttgcacttctgatttcaggttaaacgctaacttgtgtttagtctgcttaggggattgtgacttggaaaatttttatattctgatgagctttttcgtagtgtccaccatgtataaaatatttcctaggtgagatctattttctccatttattgatgcattgcagaccactttgagtgatgtgtttcaggaaaattcttcctagtttaacaagtaagc

SEQ ID NO: 585945 - DNA, 250 bp, Homo sapiens
  misc_feature (18)..(18): n is a, c, g, or t
  misc_feature (235)..(235): n is a, c, g, or t
gggcaatacattggcaancggttcttgtcgtcttatcaactagtgctcatggacacgtaaaaaataataatgcaattgcggcacatagcaaaagagctctgggaagaagggctctggaacatagaggaggagcccctgctctcctgcctggggagctgagacagattccacaaagaccggtgcacctgaaaagcgagtgtctccagaagtggtggatgggctccctgaaaacagnttcacactgcttctt

SEQ ID NO: 585946 - DNA, 453 bp, Homo sapiens
agtgaattttttgtattttttagtagagatggggtttcaccgtgttagccaggatggtcttgatctcctgaccccgtgatccgcccacctcagcctcccagggtgctgggattacagacgtgagccaccgcgcctggctaccaaaaatttttaaaaagaaatttgccaggcggggtggcatgcacctatagtcccagctactaggcaattgaggcaggaggatcacatgagccaaggaggtggcggtgagccatggccacattactgcaatctagcctgggcaacagagcaagaccttgcctcaataaataaataaataaataagcagtcgcattactgcaatccagcctgggcagcagagcaagaccctgtctaaataaataagtaaataaataaataaataaataaataaataaataaataaaatgaaactattattctctaaaaaaaaaa

SEQ ID NO: 585947 - DNA, 316 bp, Homo sapiens
gagaagcgacagaagggcctaaaagagtgatacagggtttcaccacattggccaggctggtctcgaattctggcctcaagtgatccacctgcctcgggccaacatggcaaaaccccgtctccacttaaaaatagcaaaaaaattagccaggcatagtgtcacatgcccgtagtcccagctactcaggaggctgaggcacaagaatcatttgaatctgggaggtggaggttgcagtgagcggagaccacgctgttgcactccagactgggtgagagataccgcctcataataaaaaaaataaataaagtcgtatcga

SEQ ID NO: 585948 - DNA, 1066 bp, Homo sapiens
aagttcccaaatactttataagagtttatcagacatctctaatatggccatgtccagtttatacagctgttacaaacatcatagacagagtgctagagcattcatgggggcaaatcctcatattcagagtactctcataacatttaggtgtatgtgtgtatgtgcgtgtgcattaccgagagaactcactaacacaaaagcaactgctttttaaatccgtatggtgtcagttaaagtgtcatgcccttgaccaatctaatgaatgagattcaattaactagggcctttcatacttaactcaaataaaacaaactcaagacagcatcatgcaggtgcaacattctaaacagctacttcaaatctacatggcctcgagcggtcaccatggtgtcaaccatctcatatttctcacaccacaataggctctacacatatctagagcgtccaacggcatctcccaatggggactaagtatatcgtataccgaagtacaagcagctgtgcagcataaccacacaattcaattcggttcaattgtaacccactcctatctagagactcagttgacacacctccatctgcacctaaaaaagcaacagttgcaacctctgacaactcttgccttagtactacgaccactgggagtaaccttaaggggtggaacaccaggacaaacaatttacgcgtgggaagcttaccattacactgcagggtcataacaccagatcactacttattccaggaaagtttcataatggggctactaatgggaatggaaacagaacagactgcttattacacacgcttttcatactacaaccaccttgcaccactgaccgtcagcccaactaaccagacttacacccggaagggcatcacgatccagcacgcggggccacgcgcgcgatgcaacaccgccccacccctcacaacgacctggccgtacacaacgacctgggcacagtaaacatacaacttacacacgccgacaccacgcgcaccccccgaaacagggcgtcagacaacgccacgtaacagaccaaccggagccgacactaatgtcgaa

SEQ ID NO: 585949 - DNA, 221 bp, Homo sapiens
atgggacttagagaggatgaagatatagagaggggggtggtttgatagtggcaacgttgttggaacatgatagtgaaaagtcacgagatggagaaatatgctctcagaaaagactgtgaggatggctttcctcttgttgcacatgtaccatgcatttctcagcttggggtactacatttggtggaaagttaatctatctatctttccacatctgaattaat

SEQ ID NO: 585950 - DNA, 312 bp, Homo sapiens
  misc_feature (108)..(108): n is a, c, g, or t
  misc_feature (194)..(194): n is a, c, g, or t
tctttctttctttcctttctctctttctttttctttcctcccttccctttatctctctctctctctctctctttctctctttctttttgagatggagtttcactctcngctgcccaggctggagtacaatggtgcgatctcggcttattattattctccatgttggtcaggctggtcttgaactcccaacctcnggtgatccgcctgcgttggcctcccaaagtgctggtgtgagccactgcacccggcttaggatgcatttttcaatattttagtgtttgaataacgggctatcttgagaaaaaaataatt

SEQ ID NO: 585951 - DNA, 355 bp, Homo sapiens
cctcttgactatagctcctggtccaaggttagcccaccaccttgtcactggtgagaaaaaggaataaggacggactcatctctttccttttaggaaatttgccactagttccctgccttctaacctcagttcagtgacctgaacttagttatctaactcctccttgagaaaaatggtacttgtgggtaaccatgtgtccagctagtagcatggtgatcaaggggagactggatagcaatctacttgtgtttaagattgttactccgtgtgcgtgcgtgcgtgcatgcgtgcgtgtgtaaagtgtatgtgtattacaagcttgtgtatattcaggggagacacagtgagtcgacgc

SEQ ID NO: 585952 - DNA, 292 bp, Homo sapiens
ggagcaggagattgccacctaccgccgcctgctccagggagcacggatgcccacctcactcagtacacgaaagaaccggtgaccacccgtcaggtgcgtacccttgtgcaagacctccaggatggccaggtcatctcctcccgcgaccaggctccaccagcccacccgtgaggacccgctaccccggccggccacccagccggcagggcgcagccgccccatctgccccacagtctccggcccctccagcctcagccccctgcctcagtcccttccccatgcttccttgcct

SEQ ID NO: 585953 - DNA, 647 bp, Homo sapiens
ttccttgaatattaaagttttaaaaagcattgccattttgtcctactggtaaggacattaaaccaataacagggcatttggaaattttaatccttaaaacagtgagtactgaaactgattatatttttcaacaatgtccaccccaagtgggtcttcctacaattctcttaacttagttgcccctcacttgccatctaagcaattggcaagaatgtgccaggccaaggttaaacttggaaacatgcttacacattatattccctggtcctttaaaatcagattagctacaattttgactccttggaccctcaagcatagctggtaaatcaagttagaaatgtaactgccttaaaacatgccagcttaggctgggcacggtggctcacgcctgtaatctcaacacttcagaaggctgaggcaggcagatcacttaaggtcaggagttcgagaccagcctgaccaacatggagaaattctgtccctactgaaaatacaaattggccggatgtggtggtgctgcctgtaatcccagctacttgggaggctaaggcaagagaattgcttaaacccagggaggcggaggttacagtaagccgagatcacaccattgcactccaccttgggcaacaaaagcaaaactctgtctc

SEQ ID NO: 585954 - DNA, 1133 bp, Homo sapiens
ggcttttatttccctggtgtgattccgtcctgcgcggttgttctctggagcagcgttcttttatctccgtccgccttctctcctacctaagtgcgtgccgacacccgatggaacgacttcgactggacatggaccatgagccccctgaggccccagacacctatcttttcggttgtgaactaaacggccgacaaacgacttatcaccttttaacggtggataaatgatgaaacactgacgcaccagattactctattaacggacaccggtcagtttacgggactggtgcaacaggactgacgttgcacaataggttcgaagcagacggcaactgacacttaccgaacgggcagtccaattaaagtaacactggcaacatttgaaaatggtctgtacagacaaaaggatttcccattggaggagggctttgaaaataacaacacaacagatgggtctataaggttagaacgatgctgcgttccaggggccagtggccatcattacaatgagacaacagcactctagtcagctagtgggcgggacagcatgccaccagtccaggcacgactgcacagcacgcagcgacagcgcatgtgcaaacctccttcaggtcattcatcttgggaaccagccggatctggccaccctggaaaagcgtgagttaggcaacgagtatacccacaaggtaacacaaacgtttaacaagatttgtcttgcttgcatggcacagacattgcatggcaccgccatgacaatgacatgcaacgacagggactgtcattgacatgacacagcattgagttgcaatacaccagaacacggccacgtcatggcgccatgcactgtagacgggaacaagacctgttaaacgcacaacaaacatatcctgccacccgtgttgtgacgaggacaaacatctttttatctccgcagcgacaattcagtctcgaggacacaaacaatcttgtgacgcacaggacgcgttccactccatccagaaaagtgtggaaacgacagtcaccaaaaacgccaactttctataacaccatcagcaattagcacggtcgggcaagtagacaatcttgtatagaagcaagctcggggataaccacacccctgataacacacaaaaa

SEQ ID NO: 585955 - DNA, 528 bp, Homo sapiens
ccggagctggcagacaagagtgtgcccaacttcatgtcgatgaaaggccatgcacgttctctcaagtccctagggctacgtgaaggaacagcttggctggaaacatttctactggtaccttaccgatgagggtatccattatctccgagatataccttcatctagcccccggatgattgtagcctgccaaccctacgccgcgtagtccgtcctaggagactggacagtgcctcggtctagaaggtctggacgggtgagcgacctgtcgagactcagaaagaggggaagctgacagagatacctacagacggagctgctgtgcctacctggtgccgaccagagacagccgatggctggtggctggtgctcatgcacgccgaattaccagtattacgaggcggcatcttggttcgtggacgtggtcacggcacctcagtaagcacctggacgaggatccgtgatgcagttgacactagaaacttgtacaagggcaatggagacacccttaaaggacaacaagtaggagag

SEQ ID NO: 585956 - DNA, 457 bp, Homo sapiens
gatgcttatgggtcgagttcatggaaccgttgagtaacatgtatttgagatggaagttcacttgacataataaattaatgcagataaaaaaatattgggggaacttaaagggccaggcaccatggctcacgcctgtaatcccagcactttgggacgccaaggcgggtggatcatggggtcaggagaccgagaccattctggctaacacggtgaaaccccgtctctactacaaatacaaaaaaattagccgggcgtggtggcgggcgcctgtagtcacagctacctgggaggctgaggcaggagaatggcgtgaaacccgggaggcgcaggtcgccgctgagccgagatcgcgccaccgcactccagcctgccgcgaaagggccagactctgtctcaacacccaggctgcccgggagtgctgcccaggatggccagcccctctgtagccaaggtcgta

SEQ ID NO: 585957 - DNA, 104 bp, Homo sapiens
ccgtcgatgcggtacccggcacatctcgatatctttcgcatgctctcggcgttgcagctggaatagagaatatagtccggcgccatccggctcaaatagtcgca

SEQ ID NO: 585958 - DNA, 285 bp, Homo sapiens
tctgctgtactaaatgcaccgtgatctctttaggtacagcatttaggtacatacatttaggtaccagccatttaggtaacagccatttaggtaacagccatataggtacagtcattagataacagccatataggtaacagccattttgataccagccatttaggtaacagccatttaggtaacagccattaatgtaacagccatttacggtaacagtcatatatggtaaccagccaatataggtcagagccatttcggttacaggccattgacggtacagccact

SEQ ID NO: 585959 - DNA, 466 bp, Homo sapiens
ctaattttttgtgtttttagtggagacggggtttcaccgtgttagccaggatggtctcgatctcctgaccttgtgatccgcccgctttggcctcccaaagtgctgggattacaaggcgtgagccactgcgcctggccagaaaaaacttttactactttatttgataccttatgttctaattaaacttgaaaaaatttagttctgaaatacacgtggattttttaaactctgagaactttgtaaacacaactgtgttctacagacagcaaaagcttctctaaacttgtgttagtcacatggtcaaattagacataatgctccgtacatattgaagcacaaagaactaaagataagaggcaaataattctgactggaaaagaataggaggtacctcttctagcttctggatacagaagacgtccatttgcatagtttgcgcaagagagccttttctttcttgtgtatt

SEQ ID NO: 585960 - DNA, 956 bp, Homo sapiens
gcaggtgggcgggccgggaaatgctcttgccggcccaacgctcacagaagggacatacaccaccacagcatgaagtcagcccgtatgagcagcgatatccacgctgatgtgatccacacagccagagacgccatggggtcacacgagacacagtatagatcccctgagacctgtgtgcacaggtaggaccagtgcactcacacccatgctcggagagggagccccctgtataaccaaggagccactggtggttcagacacacacatcagcagcttgacctcagctccactgagggcctttccactagcgtcgcacagcttccgcggccgtcgctcgccgcaccaaacccggggttctagagttaagagaatgggggaggggtatttatagctgcggtcagtctgactcctcaacccagcagcaatttgaggggatgaggggcgaagaggagccgccttttggaggccgcccttcagcatgcagcgtagtgatgccgcgtgttctctcttctcggcggtgtcgctcaccatagtgcggtgatcacgccattctagcatcccccgtgcgtactgcaagtgcgcctgtggcgttgtccccaacacccacgtcgagggacaaagctcagcttggggatagcgagagtaattgtgatagaatgcgtcgaagtcagcgtcttccatttcagagagaaccgccagtcttcctttgggggtatgatgtggcaagctggtttcagcccaggacccaccactgaggagaggatctagacaggtgggcctaactccaaggggcccttcctggcctggagaaggccttttacacacacacaacacatacacacacacacacacacacacatatcacagttttcacacagcgcctgctgcatctctgtcatactccgttctatatagatttgtcggggtcggggggggggggagggggggggtgtgtgt

SEQ ID NO: 585961 - DNA, 740 bp, Homo sapiens
gtggtcaccgcggacgactttggttacatgcccgcgacgcggatgagggtatcgtggaggcctttctggccggggctgtgaccagcgtgtccctgctggtcaacggtgcggccacggtagagacgcggcggagtctggcccgctaggcgacagcatccccacggggcctccacgccaacctgtccgagggccgccccgtgtggggtccggcccgccgtggcgcctctcatcgcttgcgtcggtccccggaaggcttcttccttgggcaagatgggtattccgggaggtcggttggcggacggagactgtggatttgcctcaggtgcggatgccgcgagctacaggaggatggctcgcagaggacccgccatgagctccgcccggagggtgcgggaggagctcagaggaccaactaagctgcttccgggagcggctgggcaggggccccgaggcacgcggacgggcaccagcgagcgtgcacgtgctcccaggcgtgtgccaggtgttcgtcgaggcgctgcgaggccgtatggggtgcgcgtttacgcgacgtgccgggtggagcgcggtgtgggtggctgcatgttggctggagggcctccgcgcgtgcttcgtctgcgtgcgtggagctgcgatgcccgggccgacgtgggtcccttctccgccagggctgccggtggacagacgcctcgtgtcctggcacttgctgcgggacaggttccgttcccggtgttcggggc

SEQ ID NO: 585962 - DNA, 254 bp, Homo sapiens
caatatcttcctggtgattctgtagcactcgatactctacagactgacccttcttaaggatctagtataggtggtggtagccactcacgatcaaacctgctggccatcacagacgctgaggttgcatcgatcttggaaacaggaacgagaggctctttatcctttaatctgttggccattttatcatattccggagcaaactgcttgcagtgtccacatccatggagcataaaactccagcagcaccaccagga

SEQ ID NO: 585963 - DNA, 833 bp, Homo sapiens
  misc_feature (540)..(540): n is a, c, g, or t
gtcgactctgaagatttctggcttgtcctggggcttaatccttggacctattttattcaacattgattgtcaatgctctgaatcatgatgcccatcactatccccctgaagaactcaccagctctttccccaggtgtgtggggatccgaactgaagagcgctttccaggagacacacttcgctgtccacacagagaccaggacgcattcgtggactcacttgccctaacttctgtcatgctgcttgcaacgcacggcaatcccagcatgaatgaagccagcaagacttttcttggtgttgttgagtgggattctggtgcctcctgtgcagattcactttttacaaaattatgttgacatcttgcttataggcctcaaaaaactctgagtgagatgcgctggtttgcctttggaacataggataggcactgttatcagaatctgctgcaatctcataccaaattggaatgttttccctttatagcatttttaaaacttttcccacaaaataacagcattgcaccgtgtcacgttatatttnattgcataaatgtcagcctcccttaaaacgaaagttgaaaagattatactttgaaatagtaatcgtggggaaatgcctgacttgaggagttcagccagcttggtaaattattcctgcaaccatttaatttgctcactaaaatatattgcttgacctgaacaataccaccacccccatatgcccctacaacaaaaaagagggggggggggctaaagaaaatttcccccgggggggcccctgttttccgcccccgtttttttgtgttcacggggggcgcccaatggggggccata

SEQ ID NO: 585964 - DNA, 251 bp, Homo sapiens
ccgctccgtatggtcatttacgctgttgtcttaattgtcgtcatgattttccgaccaaagggattgctgggaacactgaattgtcgttaaaagcgttattgtttgatacagggggcgagcatgacaaccattctaaaaacgcatgatttaagtattgcctttcgtggtgtgacggccctcaatcagggtcaatattgaagcgcatgataatgaattgattggggttaattggcccaaacggtgcaggtaaa

SEQ ID NO: 585965 - DNA, 348 bp, Homo sapiens
ccggttatgataccacctctcatcgacaggtcacctggtgaagaaacaacagtgacatggtaatcattggagaatcaacatcgtcatgttcctcccactacccttgaagatattgtagccaaggaaacagaaaccgatattgatagagagtatttcaacgacttcaagtccttcctgcttacacagccgaactaagaccacctcactggtggaagaccaaagaggccatttgcacctcaggctgctttctgacgccacagacctccagcaagcacaaatatttcaccctgcacattaatagtgtatattattcgaggtcagcagaaaataagacaggtcgaatgagtg

SEQ ID NO: 585966 - DNA, 760 bp, Homo sapiens
  misc_feature (467)..(467): n is a, c, g, or t
gctgtccagatgaggaagctgagctcagagagattcactaacttacctgcagccacacaggtgtgtggggatccgaactgaagagcgctttccaggagacacacttcgctgtccacacagagaccaggacgcattcgtggactcacttgccctaacttctgtcatgctgcttgcaacgcacggcaatcccagcatgaatgaagccagcaagacttttcttggtgttgttgagtgggattctggtgcctcctgtgcagattcactttttacaaaattatgttgacatcttgcttataggcctcaaaaaactctgagtgagatgcgctggtttgcctttggaacataggataggcactgttatcagaatctgctgcaatctcataccaaattggaatgttttccctttatagcatttttaaaacttttcccacaaaataacagcattgcaccgtgtcacgttatatttnattgcataaatgtcagcctcccttaaaacgaaagttgaaaagattatactttgaaatagtaatcgtggggaaatgcctgacttgaggagttcagccagcttggtaaattattcctgcaaccatttaatttgctcactaaaatatattgcttgacctgaacaataccaccacccccatatgcccctacaacaaaaaagagggggggggggctaaagaaaatttcccccgggggggcccctgttttccgcccccgtttttttgtgttcacggggggcgcccaatggggggccata

SEQ ID NO: 585967 - DNA, 139 bp, Homo sapiens
gtcacgcaacagccccggtgattcctcactgacggcccaaggtggtggaagctggcagaaaagtgtgtgttggagtggagctcgggcggctgtggtagggtgtggatacttcaacaggggcggttgcggtgctaggagg

SEQ ID NO: 585968 - DNA, 596 bp, Homo sapiens
  misc_feature (131)..(131): n is a, c, g, or t
  misc_feature (155)..(155): n is a, c, g, or t
ctgaagtctcctgctcaattgtaagctctataatggctgtttggcccagggcagtgctcagcgagcactggggtgcctctaacctgctcaggcctcactggtcaccaggccgtggtggcccttggctgtgnttctcggtttctctttggggcccngagcaggtgccaggcccagggccagctcctgaccagaactggcacgtgacacgggggacctgacatgggcggtttatcctcaggatgacccattccagggcctgtagtctgcccactgcccaggagcctcctctctcagcatggaagtgcttgggtccgctcagaccccagaacatccattgtttgggggtttttcagtcacatacccagcagaggagagaggtctggtaagcacccttcctgccaaccagctttcatcatttccagctcgcgcctggctggtttccctcctgccccgggttgcctggaacttcatcacactgtttcagcccttgtctttggagggttcttgataggagcagagcagcaccagtgctgtggccggtggcagctctcacagctgttgggagagcccagcacagagtggagcaggagccttca

SEQ ID NO: 585969 - DNA, 120 bp, Homo sapiens
cataccatcgtccagcagtattatgtcgctcatcctcatcacgcagtaccaacaacacatctatcacagcatgacctctagcaccattgtccctgtcagcctctccgttgcccttacctc

SEQ ID NO: 585970 - DNA, 905 bp, Homo sapiens
gtcttgtctctgctctcctgaacctttaggcttgtttcggcccgatttgaagaccaggaatgttgatcaatccctgaggctgctgagagacggtggagcgattgggacagtcgccagtgtgatggcctgaagtcgtgtaataaattgcgatggtgggttgtccgggtcgtgcatcctcgcgtggtatcgctgtcgcagtagtgtccctgtggtgttcttcctggccatctcttgagaccggtgagtctggcctgacattatgcccgtggtccatggacatgaagagagcgtctaagaagggattgatgaattgggagttgaagaactatcccgggtagcccctataaacatagccctgatacttttagaacggaacgtggcaatgttgcgttcttcggtagcgtgtagtgtgacaatttcaggagataactgaagaaagcaatatctggttcatggatcaaggttcacggccaaccaatgtgacctcacttgcgtcttccggcggacctcgtaatttgggctgtagttcaaaggagtagaactacagtcgtatgtacaaccattgtaagagcgttaacaggtgggagtacactctaccatttctggaaggaaacccaactcatcacatgagaatgacaattctgtaaaggcggatcaatgagtaaagaacgagtggctgctgcattggacaaacgcacaattaacggcagattgtgggacagggtgtggtcccttagacctgcactggtggctgtataaggagccactggctgaaattgtttgagtatatttggttaaactcttgtataatgtcagagaccctgtttggcactaagtgcttgaccccaaagcttttaacgattctccaggggataaactaggaacccatggcctttacctccggt

SEQ ID NO: 585971 - DNA, 286 bp, Homo sapiens
cggggaggtagtccacaaagacaattggagagggaggacgctgatccgggagctagcagcccaagtcctagaagacaggggtgtgggctgcgggcgggtagactctgagaaggatgcacgctgtggccaagaaactaggcctaactgaagtggacagcatgtatgtatgcaaggggacgatgaccgtcatggacgtaccgacgggcgacgttttctggctgaccaccatcggggacgttccggctggactgtcctagacggaccccggtggacctggatggaaggg

SEQ ID NO: 585972 - DNA, 970 bp, Homo sapiens
  misc_feature (545)..(545): n is a, c, g, or t
  misc_feature (666)..(666): n is a, c, g, or t
gtccctggtgtgtattccgtcctgcgcggtgtgttctctggagctagtcgttcttatatatctctcgtccgaccgttctctcctacctacacgtgcgtgcctgtcaccacgattggtaagattcggatggtaggcatggacatgagtccccctgaggccccatgaactatcttttcggttgtgaactagaggccgacgaagcttattcacttaagggtggcttatttgatgaaaatagagcaccaggtataatcttgaacgtaaccgggtcagagtattagtgggcctgggtgcaataggaatgaggttgcatgagttgttgaaatgcatgaaggacaatggacattagagataagggcggtccactattaatacggtaatcacatgggaaatgatttgaaacaaattgctctgatatcagctcaactgggtatctccccttgggggtgcatattgaccatgtaatcaccatgcagtctggtctcgttacagggcttgaatgttgatgggtctcaaggtgtcgcagatgtcactagttacgtggnatgcaggctacctgtagtatagacatgtggcagcgaagtcatgcaggagtcaggacaggatcgaaggacgggaggcatgcgtagtgtgaaaattccttttaagctcattatcttgcgggancagcgcggtctggtcgcacgtgtgatagtgtgggtgatctaatgggttttcacacttgcataataagggtaagaaatttgggtagttggattgaatagaattgatttgacgaattggaattgagtgagggatcggattgatggattcgatactgatggacgcgagtcgatcgaatgaatctggtgggttgactgttacgtgcatcttgggggtggaaataacgccgcctgggtgaggtgataactttattgggtaagatagtactaggcattagaattgtggtacaattgtcaaagtcagaatg

SEQ ID NO: 585973 - DNA, 745 bp, Homo sapiens
gggggggggaagagaaaggggaagctggaaaagaagacaaagatgaaaaaggggaagaagatggaaacagaggattaaaatgggaaacgtgacgaacaggacgaagagtgcaaagagaacagaagattggaacaaaaggtgaacgacggaaaaggaactgtggacgaagatgtggaaacagagaacggagaagatttaacaaagaggaagacagaccgaaaagaacacggagatttggaacaacgacgacttgaccgatgtgtgacaacacgacagacttgacagggtggcaaatgacggaaagaagcctggaaaagagaaagaagatttaaacagaagaggaagaaggaaaagaggaagatgagatcaaagaagatgttgggaaaaaaagaggagacacagagtatggtttaaaactggcctatgtagttcataattgggtaacttggtaccttcaggtggtaaagttaatagagataaatatttttatcaaaaattttataaacacagcctttctttagcatggatttaatttcagaacatcttcatattgattattaggccataaagtttctaacgtgaaacatttatctactaaattgggcgattatagtagtggagctactttgaaaaaaattttgctttcaacttgggagtgaattccggtcgcgtaagttatttgtcaaattttggaattttaattatactctttatacatgtgatatttcataaaggggggatcccc

SEQ ID NO: 585974 - DNA, 247 bp, Homo sapiens
cgtcctattagtacatcacttctccacatctctatattcagaaagcactaggattactttcttctttagtcatcagaaaaaaaaaaaggaggtatattttgaatgatcgaagaagtgttgtctggggggaggggccacatagccaagcttttatgcacttacataggactctggctcaatacaggctcagttcctctgggtttagtttgtacagtgtaattcgagggtgacttaaagttaagaagat

SEQ ID NO: 585975 - DNA, 492 bp, Homo sapiens
acctattctgtccactacatccatttatcctctgtcatcctgaatatacgtagattgtggtctactgatgtagtggtttcttatgtagcataaataccccagtatacaattatttcactgaatgcttgttgtgtgaatgaatatcaagtcttcagacgtttccttttgctctgtatgatgatattattgaggaacctcaaacgtattggttaaggaccagcttcaagatacagtggattcttcattgacctctaggaggctatcgtattccaaataatctgatatgatgatgattttctttccattgaatttctccttcaagctggtgttaaaaaccttcacatggaagaactgtgtctgtgtagccactgtagcatgaaacattatttttttctccatttctggggtctcatattcaaattgggttgttgtactcagtaccttcactatcactgggcgtttttggagaacatttcttctgggagttacctg

SEQ ID NO: 585976 - DNA, 840 bp, Homo sapiens
agcggagggaggcggggcggagacggaggcgaggaggaggccgcggcgcgtgacgcatagagctgcggctcgggcggcgcctccctgcagaggcaccggacccggctccggacccccgcatggggcaagtgctccccaggggccgcagggatgagcacagctgagctctggcacggtccgggcatggcagatccaggggcagggcatagcgagttcggacggccaaagagcgtgcggaccattatcgctccaatgagagcctatggtggagcgccagtgaaaggacgagacctgggccgatgtgtgcatcaatgacctgtgtaatgggacctgggctctccacgcggttgcgtgggacgtattgcgcgtgtccctgatctaggggccttggtaccactggcgctagcgactccgtggtgcctagacagtgcacagactgactcgatgaacgcggatcggctgtcactcggatgtctatgtggcaagactcggccgcggccacaggcacgcggacggttggtggtccttgtcgcgagggctgcagcgatgatgtagctgccatggtcgtccgtgtcatggtcgcagcgatcgagacgtggctcaccttgtcatcggactggtggccgcgtggcagctggcgtgtgccgcgatggtgctcactgttgtgaggacgtgaggagcctggatgctgcagcagagaactgagaaagatgcgtggtgcgtgtgccttgctgtgacgtgtggtcgcggcagtggggcacgccgtgggcctgctggtgccccacagcctcgtgcaatttgacgcaggaagattgagcgggagctgtgtgtcctggaccc

SEQ ID NO: 585977 - DNA, 274 bp, Homo sapiens
cggtacctgtatgcagctgttgagtagctggaattacaggtacatgcacacgccggctcatttttgtatttttagtagagacaggtttcatcatatttggtcaggctggtcttgaactcctgacctcaggtaatccgcctgcctcggcctcccaaagtgttgggattacaggtgtgagccaccatgcctggcctctctggattctttttgctctggagaagttagctctcgtaattttgttacttaagctgtcttttttttttttttttttttt

SEQ ID NO: 585978 - DNA, 1845 bp, Homo sapiens
  misc_feature (1108)..(1108): n is a, c, g, or t
  misc_feature (1344)..(1344): n is a, c, g, or t
  misc_feature (1442)..(1442): n is a, c, g, or t
  misc_feature (1520)..(1520): n is a, c, g, or t
catatgcacgggtgtctctctactcgtgtagttttaccttctctcgcggcgataatcacatttttcccaaagaagcactctgatcgtcgccgatcttggcctctttttgggagccccccacatgaagaagcacaagggtgtcgcgcaccaaaaacgacgagaggtggtgtcacggctccgcagtattctccccgggggattattgttcgtgcgaccaccaagagcgcctcagttttgtttcggcgccagaatttctccatagaaacgcaagtgtggtgtgtaccgtcggggggtatataccacccgaacgaagagattgtttgtcgtcgcttagttcgacccagagcgcagatatagttcgtggtcgaccaatatatacagcccgcccgctggatggaaaagaagaagccgtctgtatttgcaaatacgaatggacagatctatcttttaatattagggggggctcgccttcactcaaaaaataaaaaaagacggtttcgtatattacggcccccccacgcgcgcccattttttctttttgaggaaagaaagaggtgttttttacacaccgcgtcgcgcggaaccccacaccctgcttgtggttggtgaagcacacacagctatagataggcccgcttcatcactgtgggaagtgtatttaataaataacgtgtattcttgatgaaagcaggagacagcttcgtcgaccaccagacgcggctaaattatataatataaatatttgggggggagaaggaagaccacagcagtgtttattagtagtcggcccctcgtgaaaccgtctgcttgtaaaagagaaaatgaattttgtggaaaaaaattattttccacgacggtggggggaaaacaaaaaaatataagatggtcgtgtttgcccacaccagaagaaggaacaacaacaagatgggggcgtctcttaataagagtgtttaaataacacccctcctctaataggaagactcttttgggggggtgccccccacacctgctacttcttctgctgaatatttgtggaggacaaaaaaccacactcttttttatatgtcttcgcgtcgattataaaaaaacacaaacataatttcttgtngggggaaacacaatagatatagtatagtaaatgaataagataaatatagtgttgtaatatcgcgctctacccacgcgacataagaggagctctctctcaatagaggagccactactttgtgagagagaaaaattatatattgtgggtgttcccccctctgtggtgtgaataaagtacgcactcccctctcttagagagatatttcttttaatatagagacagcacacaccatatgnggggtgtatatatctacatacacatagatattctacacagaggataaataatatatatagtgtctttgttgctcacaggtgtcgcacacatatatgtngtgtctccccccactgtttgttctcacactgtggtggtcgtcacacacacacctgtgggttgtgtgcccccacatttngttatgagtgtgtatataagagtgtgccagagacacctatattgagagagtctctgtcccagagtgttatagagtgtgtcccacagtcctgtgctgtgagaggaaaatagcgcgcctcttttctctttttagacggtggttaacacactacacttctcctggagaaaagagtatgtagcgtcttcttgtagccatataatggaggttctcaagtgggacaccaaaattttgtcgccacatttaaaacactggcgcaattattacatggacaatattacacaattgagaaatccaatccacaaattaaaatttttttcatttccca

SEQ ID NO: 585979 - DNA, 515 bp, Homo sapiens
  misc_feature (117)..(117): n is a, c, g, or t
  misc_feature (262)..(262): n is a, c, g, or t
agcatgaggacctcaaggacccccatgttggagtcccagcccaggaacttagaaaatacttcaagatgggggaccacgtgaaggtgattgctggcccgaattttccggtaaattgtnggtggccttggaatcacatgtgtcctttccattttgtgcgggtggaggagaatttcgttatcctgttctctgacctcaccatgcatgagctgaaggtgctcccccgggacctgcagctctgctcagagacagcatcaggtgctgnggatggtttgggggggggggcccaaggccaattgaaatggggggcgagctgggtgcagctggatccccagactgtgggtgtcatcgtgcgaactagaaacggggagaacctttccagggttggctggaccattgttaccggggaaagggttggtttgaccttgttcaggaacttcaggctgtgacccggaaaaaggacaaccgttttggtttgtgtggccttgtgggacccttcaagaaagccaggaaacaaa

SEQ ID NO: 585980 - DNA, 358 bp, Homo sapiens
gatccaaatgacgtatcctcccttgtcaatctgcactgttgcgatctaatcactgaccatctgttcaaagatgactgatgtgggctctaaatccagtaactggtggccttttaagagaaaaaaagacagagacaccgatacgcagggagaacgccacgggacacaggtgcccgaagctggagtgatgcgtctatgaaccacagaacagcaaggactgctggtaatcaccaaaggctaggacaggcatggaacacattctccttcaaggtttctggaaggaaccaactttgccaacaccttgatttcagattctagcctcaataactgggaggaaatacatttctgtggtttaagccac

SEQ ID NO: 585981 - DNA, 291 bp, Homo sapiens
  misc_feature (41)..(41): n is a, c, g, or t
ttggacgtggcttctaattccagcagtggcagagccattgngggtggctcagctctgttggaggggcagttcaccatcaagtacaccaccactactactccagcaggaagagctataagcacaaaagtgcgtctgttagctctcggtcccgaagacctcaggcccttctctggctgcagagccctctcctcaggttgcctttcctctccgtggactccaagtcttcccctgctgtccccaggtagagctgggtatggattgcttagttgcctcactccttctcgcatctct

SEQ ID NO: 585982 - DNA, 227 bp, Homo sapiens
  misc_feature (68)..(68): n is a, c, g, or t
  misc_feature (81)..(81): n is a, c, g, or t
  misc_feature (194)..(194): n is a, c, g, or t
cccccatctgaccagaaacatgccaatcctgagaataacctcccctccagccagagatattccaactntgcaataaaactntccttcacacagaaacattcgcagcctgcggtaggctcccccttcctaaacccttaaatgcccttagtctgtaagagaatgtccctgaccgaaatcggccagaagcccctctnaggtttattcccaaaataaacctgtctctgttg

SEQ ID NO: 585983 - DNA, 680 bp, Homo sapiens
ctcatgatctatcaagtgaagcacagacaaaagaggcaaaaagaacaaagaaagttaagtgtttataacgggctgttgactgtacaccaacggaaaaaaacaaccgctgactaagccgtaggacaacattttcttgctcttaataccaagcaaagctgatatgctgggaaatgcgatgttatcagcctaaggcgaggagacttgcatcaacaaggggatttaccctactaggcgaagcaggagctcttatcgtcagccttgcggcacttgtttacaaaagctgcaaaatcatccataacagcactcagttgatcttgtgttgccctgggcttgagattgacgagcttaacaagagcaacaggttacttgacaaggcgattcttatgagaaagtgcgcatatatctgcgttgaacgagaatgcatcatcgttaaactctctgtgaacagatggtgtatggacttccacagctgcaaagcatggtcccactgttcaccaacgatatacgggccggatttggtgactctgtcaattacaggcggttggtatgcaggacacaaacttggttatgaccaccgaaagaatagtctttgcacaggcaatctattgtgttgagggatgttacaacattaggtggccacgttttcaaaggttcttgagaccccttccagacatggagag

SEQ ID NO: 585984 - DNA, 132 bp, Homo sapiens
atacagccattttatacactatcttcttcatcttcttcttcatctgtagtatagtccaggactcaatgaactcctctgtggcatcgcccagcagcccccgaatacgataaacaatcctcctgtccctctcca

SEQ ID NO: 585985 - DNA, 332 bp, Homo sapiens
cttcggggttcacgccattctctggcctcagcctcccgagtagctgggactataggcgcccgcaaccaggcccggctaattttttggtattttaagtagagacggggttacacggtgtaagccaggagggttttgatctcctgacctcgtgatctctttgcctcggcctcccaaagtgtgggaattacaagcgtgagccaccgcacccggcctcttcctttctaattgggatgactggtctaatccttgatggtagggagagtctttaatcatgaagcatgatggtagctgtgggtaaaccacagatgcccttaatcaggtggagaacattc

SEQ ID NO: 585986 - DNA, 982 bp, Homo sapiens
aagatatctggtatcatgtggacaagactctacttgcggctcatgtataccttcgatgacataaagggagagaatatagaagacatcccagaggaagtgctgatggactgtgcccaccgttgctgaaggccaagtacgcatgtcaaggctgcaagatgaagcaacgtaaatgtggtatatacggaccgaggtctaaccctgaaggaaaacggatgctgacatggtatgtggggcatgatgaggcattgtaacacatggccagaatggattgtaatgatggtgacaggtggaagaatgaagagtaaatgaggatcctgaacgcagattaagagaaagagcatatggtcgagactggttccgcttagacacttaataggcaggaagaaggaagtgctatgaggatcgtggagaggatgaaggatatgagaacattggagcccaatatctgaggaaatgaaaagagagagaaaaagaagaaatgaagaagaaggagggaaatgttatgaacttaggagctattcatcactaatgaaagttgataatatatgtcgttcaacatcaggatggtatgattcaaatgaattcatgttgaaggagaaaaggagaaaaggacctttgaaagatgtgaatgtagagacaattgcggacctttggttgcatcatgtgttctgaagtatggaatagtaccaagattctaccgttcatccgtacggcggatgattatgaggtttcaaagtttgtacgtacacagagtgttccttgttttggctgacagaaagaagggtccgatgtgttaaagatcggttgagcttgacaggggtataacttgaaagtgcaaggtggtggccggacagggtctggggcgtggtgaagcagggggcccgtgctgaggatggaggttaaaggacaaggcgtgaagagaatggggaggagggaatctgaacgagggttgtgacacttggcaattaagaagggacgtggg

SEQ ID NO: 585987 - DNA, 232 bp, Homo sapiens
ctagctatacttgactgagcattaacaatagtacgcggaacaataagtaatctctgatttaaactagacagccaggatgtgcgtaggtcatgtgcaaatactgtgccatgttatatcaagtacttgagcacctgcaagttccggtatctaggcgagggtcctggaaccaataccccgaggataccatggaacaactggtagtacatgtgtcgtccatgtactgctcagcgct

SEQ ID NO: 585988 - DNA, 559 bp, Homo sapiens
  misc_feature (333)..(333): n is a, c, g, or t
  misc_feature (430)..(430): n is a, c, g, or t
  misc_feature (485)..(485): n is a, c, g, or t
  misc_feature (507)..(507): n is a, c, g, or t
  misc_feature (511)..(511): n is a, c, g, or t
  misc_feature (514)..(514): n is a, c, g, or t
  misc_feature (521)..(521): n is a, c, g, or t
  misc_feature (538)..(538): n is a, c, g, or t
  misc_feature (542)..(542): n is a, c, g, or t
  misc_feature (553)..(553): n is a, c, g, or t
  misc_feature (556)..(556): n is a, c, g, or t
aagtgtgtatcctgcaacgatcacgaacatgaacatcaaaggatcgccatgggaaagcaggctccctcctgtctgctgctggttgtctaaacctgtctcctgatgccagatgcgtggcccacctctgcccatctgctcccgggcggggtctgcccgaatgccagtgtgacccattcgatgacctgcttttgaccgtcgcgcgtcgatcctagtacccatctagcattccagtataccttctcgcttcagtaacagtgtttccacgcgacaattctgagtcaaacaggatattaccccagctggggcgagagggcttcgagttacacatagtgnccgattccaaacgagtcgtggagcaacagcatttcgttaccgcgtttgtctcacgctccgcgaataggaacacatgagaagtcagacgtgcgcgaancgaaggaattggaacttcagagagagaggatcctttttccgtgtaaggcccttgngagatatggatccaagagcganttanttntggcggncacatccacgtgttgcnaaanatggtcagtgnccnctc

SEQ ID NO: 585989 - DNA, 132 bp, Homo sapiens
ctagaggatccgtagtttagggctacctttctacaaaagtcatcaatgttcacttgtccaattgttgttcttcctttaagaaaaataccagggaaaatgttaccaacaaaaaaatgaatcattaatataata

SEQ ID NO: 585990 - DNA, 246 bp, Homo sapiens
tgcatggctgataggcttggtgtggggagatgacgcagggcgactttgtctgcaacaccctgcagcccggcgtgcacagcacgtgtgctacgctcactccttccccctctcccacatccggctctgggccctgcagctgctcttcgtgtccacgccagcgctcctagtggccatgcgcgtggcctcccggcgccctgagaagaagaggcagttcatccagggggaggtacagagtgaatttaagga

SEQ ID NO: 585991 - DNA, 272 bp, Homo sapiens
  misc_feature (124)..(124): n is a, c, g, or t
  misc_feature (133)..(133): n is a, c, g, or t
  misc_feature (181)..(181): n is a, c, g, or t
  misc_feature (249)..(249): n is a, c, g, or t
  misc_feature (262)..(262): n is a, c, g, or t
ccggcgcggcggtcgggattctgggctgggattctgggcggctgtctgctgccgtcgggcgggagctgagcgtcagggttcccgggcgcgggcgacagtggaaacgctggagggcagggagagngtgccaggngcaccgccggggcggcggcgggggaagggattaaggaggctggtctcngggattcccccgcgatcgttgtgcggcgggcgcgggcgcctcacgccacctcctgcttgccctggcangacgcccgcagcnatagagcgcc

SEQ ID NO: 585992 - DNA, 365 bp, Homo sapiens
ggcatatgactgtacataccacaagcatagccttcttatcttacttcttggagcatgtttaactttgtaagatgcaaataggtgggatcaagtttaaatgagtgtgctgcccctttcacatcacagaactactgacaacaaggccgcgcctgcctttcccatctgtctatctatctggctggcagggaaggaaagaacttgcatgttggtgaaggaagaagtggggtggaagaagtggggtgggacgacagtgaaatccagagtaaaaccaagctggcccaaggtgtcctgcaggctgtaatgcagtttaatcagagtgccatttttttttggttcaattgattttaattatgggctgcaccctg

SEQ ID NO: 585993 - DNA, 452 bp, Homo sapiens
gagggggcggggaatccttccgacccttcttagagaggggctgcattgcagggtggagcagtgaacttgacagactcagtcacatgaagcagtggacaaaggcagtgatgaatgactaaagcctgtcacaagcccacaactagacttttgtgatttcctcctagaccctgtgcgccagaccaccggaagacctccccgtaggacagactcccacagtcacaaatcgtgtgtggcaaaacaacgagcccagagtacactgtggagtcgtgcacctacaaacaagggaccaggccttactgcacgcggcgcaacaccgcgtgagttgcaagcattaagaacacaatgtgttaaacgaagtgtgtacccattgtatccattgttatctccattgggccaagcggacattgaccccacaaaattactcgccaagtaaacagctttgcggccacgtc

SEQ ID NO: 585994 - DNA, 234 bp, Homo sapiens
tctaggtgactctgaggatcccccccgactagccgacagggctgtgtttggaagcaagatacttccacggcttagccatcttcctggacacctaccccaagtgatgagaccactgagcgcgtgttcccgtacatctcggtgatggtgaacaatggctccctgtcctacgaccacagcaaggatgggcgctggaccgagctgtcgggctagtcggggctgtcgggctagtcgggg

SEQ ID NO: 585995 - DNA, 386 bp, Homo sapiens
ataggttcgcaggctgggggtgggggaaatggggagtcagtgtttaaagggcagagctgcagtacggagatgaaaatgttctggagatgcattgtggtgatggttgcacaactctgtgaatgtactgaaagccactgaacagcacacttaaaaatggtaaaaatggtgataggatttggctatgtccccacccaaatctcatcttgaattgtagctcccataattcccatgtgttgtgggaaggaccaggtggaaggtaatggaatcatggggacaggtctttcctgtgctgttctcatgatagtgaatgggtctcacaagatctgacggttttataaaggagagttcctctgcacatgccctttctcctgcctgcgaacctatga

SEQ ID NO: 585996 - DNA, 593 bp, Homo sapiens
  misc_feature (24)..(24): n is a, c, g, or t
tagcaggtggtaccccccgggtantggatatcgtcgacccacgcctcgcctcagagaccgagcccacctgccctttctgcaaccagcgagggatcctgtgatgtgaaaatggaccgtgcccgcaacaccggagatcatctcttgtaccgtgtgcctagaggaattccagacgcccataacgtatctgtcagaaccctgtggatgtgtacagtgatttggatagactgcctgcgtatgcgtgcaatcagtagcgacactagaggaccctgccactgagcagccccgatgtactgtggatccagctgttcggttctggtccagagacattccaggggatccaggatgtgggtacctgagactgtactcagaccagtgatgttatgtgatatggtgatgtagtgtagtgatgtgtagatagatgaatgtgagtgattactactgtatgctgatggagaagatgagaagatgatggtactgctacttttgaataattacaacgatgatcacaaaggggactaacacgaaaacaagtatatgactcacacacatacacagcaaatgataaaaaaccatgaacatgaagtgtaccatac

SEQ ID NO: 585997 - DNA, 318 bp, Homo sapiens
tagctctaacgcgcgcgagtatctaagatagctgggattataggtgcccagctaatttttgtagtttaattaaagactagggtttcaccatgtatggccaggctcgtctcgaactcctgaactcaggtgatactgcccgcttcggcctcccaaagtgctggcattacagccatgagtcaccatgcccaggcctttgacgagatacttttgatgaatttttcttgccttgtgaatggcattataatccctacgatgtaagctcttggtccggcagggtaatacgtttgagcaactaggagggctatccagcgcgtatgg

SEQ ID NO: 585998 - DNA, 192 bp, Homo sapiens
ttttgtcgcaagcacgcggcgaggctgccccggggcagcctttttcatggctgtggcattttggtgtgcgggggcttgctggcacggcggcttctttggaacatggcagcattccagaaccagacacagagagggaatgacatggacgctgcggtgaccgaggccgcccctgcacagtcgtgggcgccactg

SEQ ID NO: 585999 - DNA, 140 bp, Homo sapiens
  misc_feature (38)..(38): n is a, c, g, or t
  misc_feature (68)..(68): n is a, c, g, or t
acagctgcctcctagaatatagactgtctgtaattatncacctataattcgtcattatgatgcaaagntgtacttgcatttcaaagcttataagatataaatggagaaaagtagaaataaatatgtattccatgtttgtt

SEQ ID NO: 586000 - DNA, 345 bp, Homo sapiens
tgatcgggctcatgttagactagtagttctgatgactagttacaccaagaacacaatgatatgatctgaaatactatatgccttaaagctgcaaaaatatccccattctcaagtctccgatcctgccacacatcactgctgtgtagaacatagaagtcctcgtttttctcagcccaagagggggactgaacccagatattagacagcattaaagcaagcttgtaaggactctaaagtagtaccccaaaatgaatgttggaatcgtgggctctacttgtgcgcgtctccgtcttcgtcccgtagacacataccaaaagagttgacaaacgtcgtaccgctttctcc

SEQ ID NO: 586001 - DNA, 100 bp, Homo sapiens
ccccgctccggcctcccacacagatggctgtcaaaggtcggccataaaggaacccaagtccctatgggcgataaggtaaaaccgccaatattcaggatta

SEQ ID NO: 586002 - DNA, 126 bp, Homo sapiens
cgtgtcctgcaatctggctgtctggaccatttgcagtctgatgtgccccttatcagaaaagtgactccacaatgcacggattttctgacgtccctcatctcctcctgtcaacacaccaaggaaggg

SEQ ID NO: 586003 - DNA, 143 bp, Homo sapiens
gctcatgacatgcaactgcatttggatgaacaccaccttcttcagctataccatgcaacatgcatatgtgtgatgaacaccaccttcttcagtggtgatcctactagatgtctgaccctgcagtgcatgcaatgcttgtgcac

SEQ ID NO: 586004 - DNA, 280 bp, Homo sapiens
gcttcagccaagcaccattatgataccgaggacgctgttatccttcggcgggaagtcatacgtgttagggagcacctcacactttcctcaggagaagacactgtagcatgaccctcatcctggggaccccaactccaggccctccagccccaaaactgcccagccagccctgaaaaatgcaagtcttgtacgagtttgaagcttagcgaatcccacggagaactgactgttggtccacgggagaaaacgctggagtgttctggtaccactagctagagtc

SEQ ID NO: 586005 - DNA, 1199 bp, Homo sapiens
ttctttcttctctctcttttctcgtctgttgctctcgtctctcttcctgttcgtcttcgtggctggttgttgtcgtctcctctgtgtcgtcgtctttctctcttcgttcccctgttgctcttctctcttcttctccctgcctcttctcttgctctctttctgtttgtttctctcctctgttttcttttttcctcttctctcgtcttacctcttgcctcccttctcttttcctcttgcgtctttttcctgtgctcctttcgttatccctgatcttctctcgttgttgctcccttgtgccctctgttctttgtcctgtgtgatttgatgttgtttgttttctgtccttcctatttcctcggctctgcgtgctctctgctttatgtccctgtcctttagtgttttgtctctatggttctcggcttttcttactgtctttatttctcctcttcttgttctgtcttcttgcgatgttatgcttggggtcgcttttccatcctcttccttgagtgttctgtacttgtttcatagtgtttggccccgagtatgaggccattcactgagtctgcatcagagtttgcaattttgtagtgtcttcattgcctaagaaggcttagtggttgttgactgtagtataagtcagctttctgtagcataagatgtgagttttcccatactttagcttcacttgttatacatcatctgactatttgggttaaactggactcatttcaagctgtttgcttttgttcaacatcgtgatgagaaacctaattatctgtaatttgatttgtacgccataatacatcattttcaatagttagcgttgtattatacgttatttatagctctgcttttatgtgggacaagatagaatctatacgtataaatcctcaggctaacctcgtagatgtaggcccagtctcacggtgtatctttgtatccttagtaatggatcatatcgtacaaaactacgagataacgttgggcaagatatattcgatttactgcctgttcgtgttgagggacaacggtcatgtactttagaaattcaaacttttggttagttgtgttcacatcatagtattcaagcatcattgatagtttggttttgagaacctttctggtattacgtttatggcaaatgtataaaagaaacaagttttggttatatttttatatttgtaagatcgtctggttaa

SEQ ID NO: 586006 - DNA, 461 bp, Homo sapiens
attcggcaccaggagagcagaagccagggaaggccgcccgcgccgaagccctgggcgccccagccgaggaagagccgggaaagggcgtcgcgctcatgtagctcacttcgagtgcggaggtgacggagcccccgttcaacacactcagccactcgaagtggcacagttgaggcatcgtgaggggtgatgcttcgcagccctggcacctgggtcgtccactgcggccccgtggtccagcaggaagcggacaatttctgcagaccaggagacgtaacccagctcccgatgccccgccagactgactcttcgccccacgtgtccaccaagggtctcactccagcctgggtgacagagcgagactccatctcaagaaagaaaaacaacacaacatggatggtgcctggctcaaagtgagggctgacggctgccaacctccaatggtggtctctgccatcagcact

SEQ ID NO: 586007 - DNA, 152 bp, Homo sapiens
  misc_feature (67)..(67): n is a, c, g, or t
  misc_feature (73)..(73): n is a, c, g, or t
  misc_feature (78)..(78): n is a, c, g, or t
  misc_feature (92)..(92): n is a, c, g, or t
  misc_feature (95)..(95): n is a, c, g, or t
  misc_feature (97)..(97): n is a, c, g, or t
  misc_feature (99)..(99): n is a, c, g, or t
  misc_feature (101)..(101): n is a, c, g, or t
  misc_feature (110)..(110): n is a, c, g, or t
  misc_feature (115)..(115): n is a, c, g, or t
  misc_feature (123)..(123): n is a, c, g, or t
  misc_feature (126)..(126): n is a, c, g, or t
  misc_feature (131)..(131): n is a, c, g, or t
  misc_feature (136)..(136): n is a, c, g, or t
  misc_feature (141)..(141): n is a, c, g, or t
  misc_feature (143)..(143): n is a, c, g, or t
  misc_feature (145)..(145): n is a, c, g, or t
aaggctttttttttcctttggccggggaatttttcccctttttatgaaggggttttaaattgtttcnttttgngggcngggcttcaaacccntancngncnaatcttgcnttttnttgtttgnccnaaaanatacnggccnancngaggcca

SEQ ID NO: 586008 - DNA, 748 bp, Homo sapiens
aagtttgtcatccctgactttgaggagttcacaggccatgtggatcgtatatttgaggatgccaaagagctcactggaggcaaagtggcagcctacatccctcacctggccaagtcaaacccagatctttggggcgtctccccgtgcactgtggatgggcagcgacactctgtgggccacacgaagatccctttctgcctacagtcctgtgtcaagccactcacttacgccatctccgtgagcaccttaggcaccgactacgtgcacaagttcgtgggcaaggaacccagtggtctgcgctataacaaactctccctcaacgaggaaggaatccctcataaccccatggtcaatgctggtgctattgtggtcagctccctgatcaagatggactgtaacaaagcagagaagtttgactttgtgttacagtatctgaacaagatggctgggaatgaattcatggggttcagcaatgccacattccagtcagagaaggagactggggatcggaattacgccattggctattacctcaaggagaagaagtgcttccctaagggagtggacatgatggctacccttgatctctatttccagctgtgctctgtggaggttacctgtgagtcaggcagtgtcatggcggccactcttgccaatggcggcatctcgcccatcacgagggagagcgtgctgagtgcggaagccgtgcgcaacaccctcagcctcatgcactcctgtggcatgtatg

SEQ ID NO: 586009 - DNA, 267 bp, Homo sapiens
  misc_feature (20)..(20): n is a, c, g, or t
ccctaggatagactaagcantatttggaatcgaacttaaataagctaatagtttccaagcactaccaattattcttcttaaaagtactggagtctctctgagctcagagttctgaaatcgttgggagatggaatcttttgtgatactgttccacgttcagctggtaagtgcttttatagctaaagggggaagtgctctacgtccgggagaaggcattagtgcagatgacgtcttgactggaaacaccctagagtctcggttagtcta

SEQ ID NO: 586010 - DNA, 151 bp, Homo sapiens
ccttctacgtccatcactgagtgccagatccccacgcgtgagggtttgatgtggggctcagaactctcactcctgtaggtgagtctctgtgaaccaattagttttcagtctgtggagcttcccaccccagaggtatggggttgtttatatc

SEQ ID NO: 586011 - DNA, 279 bp, Homo sapiens
gactctcgacgatcccacatattgctcaccgctccagcctaggtcacagagtgagagctgtcttaaagaaaaaaaaaaaaacacaggcccctttgtgtttttttaaaaaacccccagctttcttgtgtggtcgaaaaaacttgagtgaaaggcaagggatagaaaatcaatccccggggggggggtgcccaggtcacataggcccctgaaggctcgaagagattttgggaataaatgatgtgacgatggggaattcacagaaggggtttaggagccagg

SEQ ID NO: 586012 - DNA, 119 bp, Homo sapiens
ggtgactctgaggttccgtcacagcttgggcctactttctactttcacacaaccactggccccacatcccatctctggccagtctcagaagacccacggctctcaaaaaccaggggagg

SEQ ID NO: 586013 - DNA, 568 bp, Homo sapiens
attcgcggccgcgtcgaccaaaataaccctatcaatcaccaagcccttgcaattctagaattctggtgccaggctcctacttccaaaggaattattcctcaaatggtctttagatgagcgagctgcattcaacctctgccctgcatcccaactaccatcttgattcttagctaatttttacttgcaaacagcagaagcaatgagccaactcactgaaaagacaagaataaagtgaggatttttttttagaccataataccctttgtcttcctagaagtaatccctggagcctgcctgccctgtgtccagcactaatctatgagcttgtgatatttctttctttaagctagtcatatttagcagtggggcttgtgatatttctggtttcctgatctctctcctcttcaaataaacgcaagatatctacgccatggtaacatgtcatttacttccccattctcacatacaaggatcctggaggctctctgctcctcccccataaatctgcgcagataagcaagtgtgtgtgtgagtgggggtggaggggtgtttcaagcccccactctgg

SEQ ID NO: 586014 - DNA, 312 bp, Homo sapiens
ttccccccccccttcccccccctcccccgcccccagcccacgtggcccccaggagcccaccaggggggggcccaccaaaaaaccatggcggccatgggcggccaaaaattaaattggacccccccgggccctgggctggaattgggggcaccccagggttgtggggacccaggagggccagggaggggggacccggggagggcagggggtttccccaagatccccctggaaaattttataaaaaaatttttttgggtcggggggccagtaaacttcctgggccccgtgggtccttcaggagtttttccggca

SEQ ID NO: 586015 - DNA, 255 bp, Homo sapiens
aaaatgcgaacactaacaactttgatgcttgcaaaaaaaagtataaaaaattcatcaataaaacaatttgtggccaggcgcggtggctcacgcctgtaatcccaacactttgggaggccaaggtgggcagatcatgaggtcaggagtttgagaccagcctggccaatgtggcgaaaccacatctctactaaaaatacaaaaattaactgggcgtggaggcacgcacctgtagtcccagctactcaggaggctgag

SEQ ID NO: 586016 - DNA, 177 bp, Homo sapiens
gggactacgttgtcctgttggggtcacgcctgtgtgcctggtgcgggtgcttaccgtgtgcccatgtgctgtgtgtggctgggtgggccgctggtggttgtcctgctcttccctgccgtgcttgacgcccatgggctgctcggccgcctccgggtgtgtggcccaccgtgggcctgg

SEQ ID NO: 586017 - DNA, 222 bp, Homo sapiens
gagaagaaggaggttcctgctgtgccagaaacccttaagaaaagcgaggaattcgcagagctgaaggatcaaggcgccttagaaaagaaggtttgcccaaaagatgctttcgaaaggcaaggaggaagctttatctattaaaaagcaaagcactatcacagggaatataggcagatgtacagccctctaattcgtatggcgaggatcgcaagaaaagctcgc

SEQ ID NO: 586018 - DNA, 509 bp, Homo sapiens
  misc_feature (7)..(7): n is a, c, g, or t
  misc_feature (111)..(111): n is a, c, g, or t
  misc_feature (181)..(181): n is a, c, g, or t
  misc_feature (184)..(184): n is a, c, g, or t
  misc_feature (199)..(199): n is a, c, g, or t
  misc_feature (226)..(226): n is a, c, g, or t
  misc_feature (234)..(234): n is a, c, g, or t
  misc_feature (284)..(284): n is a, c, g, or t
  misc_feature (373)..(373): n is a, c, g, or t
  misc_feature (381)..(381): n is a, c, g, or t
  misc_feature (387)..(387): n is a, c, g, or t
  misc_feature (398)..(398): n is a, c, g, or t
  misc_feature (437)..(437): n is a, c, g, or t
  misc_feature (491)..(491): n is a, c, g, or t
ccggtgnagaaccacaaagctctctggaggaaggacggggcctctgtcctcttctacctggcccatcagcagataactggctcctttcttcatgggggggctctgcttgcnaggctcgtttaacttcagggaggcaccagtgggtggagaaggcaggtccagtcctccagttttataagcnccnattagactgacagtnacggcaaggccctcccctggctcccgnaccatggncttcactgtcgcagtcaccacaaggctgctggcacagaagttgctctgcnaggtgcctgtccggcggcactgctttgggcaggtgggtgcctccgggcgctgcaggcgcttcctctgttttctccggtggttgggactnggggggcngcttgncttttggctcngttccccgtttggggccgggcccttgcccttctttggcngtgccccgcggcagggtcttgttggtggctgcgttgcttctgcggtggcactgnggtctgggggcgggctgg

SEQ ID NO: 586019 - DNA, 326 bp, Homo sapiens
  misc_feature (8)..(8): n is a, c, g, or t
ggttcaangcgatctcccacctcagcctccggaatagctgagactacaggtgtactctaccactctcagctaattttttgtgtttttagtagagacgaggtttcaccatgttggccaggctggtcttgaactcctgacctcaagtgatctgcccacctcggcctcccaaagtgctgggattaaaagcatgagccactgtgcctggtctgaggaacctgtttctaacttgcacagagatgctgtgtgggctggcaggatttcctgcctctttggatctccatcttcccatctgtacagtgaggagttggcccattaactcttgagtt

SEQ ID NO: 586020 - DNA, 358 bp, Homo sapiens
  misc_feature (1)..(1): n is a, c, g, or t
nagatccccatgcgcagttgtgatacaaaaggatggaactatgggttctattcgcaaagccacaggatagtgcctaacaggccagctggctgatcctggctctcagctggtaaaaaaaaacaaagaatgggcagaacccagatgcagccagaacgtcaagatcccacagacaatcccgctcttatccgttacaaggcataccccgagaaaaaccaaacaaactgctgaaaaggccagggatgtatgtggctggctaaaaagggtttctttcactaaaaaatgtttcttaaggggacaggacatgacctgactaattgggatccactacattgacagtttacataaatgagttgatgat

SEQ ID NO: 586021 - DNA, 621 bp, Homo sapiens
  misc_feature (86)..(86): n is a, c, g, or t
cgctgccaatgtttcaacaacaacctcccggacggcgcgccgagcgaacctgtcagccccgtttccgagagcgagaacagagcggncgagaaacaatgctgacgcgggcggaccccgagccgcggtggtcggaggacgagcccccaggcgactctgcctcggatgcaccgacgacccaaagtgacgaggaggagccccacgcccgtccaaagaaggccaagagctcggaccccagtgccacgaaagacaaggggcagaacgagaagaggatgctgcgtgcgaagaggggccccaccgccgtggaacaatccatgccgcagagggccaagaacagcacaacgatgaccagcctccctgttcagagtgctgaagagcagatgctattacacaacacaccaccatcactaagaagctggtgacccaacagaaaccggccaccagcaacgggtaaaaccctcgtatctcacagattattttaaataatatgcctttgcaaatttcgccaccaccaaacggcaattcggatccccaataactaaatcacaaacaaaaaaactgccacaacaatcgcccgacctcaatacgcacgtatatccaccaccgcccacctaccttccccct

SEQ ID NO: 586022 - DNA, 452 bp, Homo sapiens
  misc_feature (31)..(31): n is a, c, g, or t
  misc_feature (111)..(111): n is a, c, g, or t
  misc_feature (127)..(127): n is a, c, g, or t
  misc_feature (215)..(215): n is a, c, g, or t
  misc_feature (263)..(263): n is a, c, g, or t
  misc_feature (427)..(427): n is a, c, g, or t
  misc_feature (443)..(443): n is a, c, g, or t
cacctctgtttcactttgggactttcaaaantcaccttgcaagcttcactactgaaaataaaaattaaaaaaagaaaaagaaaaaacacctgaaccaaccaatcagagctnacctgccttggccagngagggctcagctgtattgaccaatcagaattcagctacaccaaccaagcagaactgtcaattcttcatttgcataaatggacctgatngggaacctggtgagaaattttgctataaaacctgagccttccctttgntctctggaacacaccttcattttgatgggaggctgcgtctcctcagtttgtaaacgtcactgaaataaagtccctttcatccaaattgtcttttcagacaacttttgttcacgtcccaaaagcaccatctaaaagcagcgtgtgtttcagccttacattgttgncgacttcactccatgnccttgccct

SEQ ID NO: 586023 - DNA, 206 bp, Homo sapiens
gtcgcctgtggtatacctcatctctgtttgcctgtcatccatccatccttcgttctttcaccttccatttttttttttcacatctgcccaccttggtttggagttcccgctgtgtccatgggctcacggacctggtgttgctgcagctgtggtgtcggtctcagctgcggctcggattcagttcctggccacggtcacaccaccgt

SEQ ID NO: 586024 - DNA, 232 bp, Homo sapiens
aacgatggtcctcagctaagtgttaaaaatttttttacagatggggtctctggctgggttcggtggctaatgcctgtaatcccaacacttgggaggctgaggcaggcggatcagtagaggtcaggagtttgagtccagcctggcccctgtctactaaaaatacaaaaattagccgggtgtgggggtgtgcgtctgtaatcccagctacttggaaagctgaggaccatcgttg

SEQ ID NO: 586025 - DNA, 218 bp, Homo sapiens
agttataacagatatcagaaaggctgtagatgaagtttattagggaaaatcacattcaaaaagaatagggattaaaaaaaaaaaatcagctgttatgtgattggtatcgattctgttcttggcaaacagcatgaattaaaaacgctagttacccagtcttagaaagcagccttatgctcagtgttctgttatgcctaaaggttacctcacaaccaaga

SEQ ID NO: 586026 - DNA, 362 bp, Homo sapiens
  misc_feature (4)..(4): n is a, c, g, or t
gcanagcctcaaggagtgtgtcaggtgcagtgtcagcagtgctcgatcctgtagactgatgtgtcccaaaagaaagtacccaggtatacgtatcagacagtcatgcgatgcttattaatgagatagctcatgtgagtaggtgactctgaccagtggacagcgtcttattagaagaggaatctgaccacacagagcagagacgcgtgtgagatggggcagagatgggagatgtggcaacgccacaatgctgggctccagaaactaaggagctccccagggcttcgcaggagatgctcggcgacactttgatcttggcttccagcctccagaacgtttccttaaattcccttttccactggtgt

SEQ ID NO: 586027 - DNA, 101 bp, Homo sapiens
taacagaaagagaagtttctggctctcctaggtactgatagatttcattggtgatggagacttaggcatgagcaaaagaactctatcagtacctaggagag

SEQ ID NO: 586028 - DNA, 284 bp, Homo sapiens
aataataatagtactgtactctaagaggaacaggggagtgtgagtttgttttttgtttgtttgttcattttcagagagacagggtcttgccgtcacccaggctggaattgcagtggtgcagtcagctcactgcagcctccaactcctgggctcaagtgatcctcccacttcagctactcgggaggctaacttgaggatcgcttgagccctggagataaaggctgccgtgagccgtgattgtgccactgcactccaacctgggcgacagagtgagactccatcac

SEQ ID NO: 586029 - DNA, 552 bp, Homo sapiens
cgcggtgtaatcgccctcgtgccgaccaggatgctgtattacaaggattggccagctaacgaggcgctgcaagcatcgtcccttagaagtcagccccattgtggatcctcagttgtatcacgtacctccctcatcagaattggctcataataatatttcggtgtatcataacagtcagatcctcagagaaccgtaatctgtcaaggttgggtactcataaaaaggctgcaggctctgacagcctaatcagaagccacagtctcagagacactggggacacatgcccgccactgatggaatagcccgctgaggtagatactttgaaggcagcaaaccttggaaaggatgtgtactcttggggatccattcaaaaaaataaagttcttaacatcacaggccatacgtaaggtaaaagtttccattggcttggccaaagctgtccttataaaattaacttcttcccatgtgtgcacagaactatgtagtgctactggactccacactccccagatcccagtatgactacatcttgcctcaagtttctttcaccga

SEQ ID NO: 586030 - DNA, 1572 bp, Homo sapiens
gacgcagcctacacctacttctacaagggcaccagcagtactggtaaattcgacatgtgaggcgccgtgcggagtgtgggcccgcgcgtaccccaaggtccaatcactggcgggacattcgatgaggcatggcgagcgagcgacgtggaagaccaagggcccgcgcatggatccgaacgtgggcccgtgccgagccgtctcaacgcgcccagcagggaggtgccaagagtcgccagaggggccggacctaagcgacaagagggccgatcgatgtgcggagactgcggcgatgggcgacctaccgggtgcccgcctgactcaaagacagcgaccgagcgtggtccacgcacagcgttggctagtagtgccatcgccttgcgacaggaagagcatgtgcactagagaacccgctatgcagctgagctgtcccttgtgttgcgtgaggagccgcaactagtctctgcactagcgtgcctccatgacacctcccttcggcgcgctttacacattaacggtcttaataagtggattccatagcactatcagtgcacgcaaaagctggcatcaccgcatcgaccacgtcgatcacagtcgcatgaacacatctctgcgcaaggtacgcaccccttcccggaagggagcaacctggcgtgctactccgaccccagacgccgacagatggggataaaccctgacccttacatacaggtgcttgacgaacgatgacacaagggaacagtgacgcggggcatacatatatcgaacacaacgaatgcgagactatctgcagcaagcagtgagtatcctcacacccatctcacacatcagaccacacaagttgaataaacagcgaacccacaccctaatagaccaaatccatcacagtagaacgaaaacacaccaaccattacataccgcatgacacaccccacgaacccacaaccacaccgaacacacgacacaagaggctacgcaaagcgaggaaagcagcacaaaaggcgacacaagagcgccccacaacaggcaaacaaaccaccggcaaaaaacacgcgacaacaagcttacgcgagcacacaacaacagaaaccccaatccgacaaccacacacgacccacacacacacaaagcagccaacacaacacagaagagcaaaaacaacaacagccgccacgaaccgaacgaaaagacaacccatgccaaagcacgatgcaaacacaagagccaacagacacgaacaatcaccaacatcaaaacaccaccacaggaacaactcacagcaaacacagcacacagagaagcgacaacacacacggcacaagaaaaagcatacaaaccatcggaacagaccagaacagactcaggtcactccagacagggaacacgccacacgccgatagggacacaggacaccagagagcccgaccaatgagagagccgacataggcagacagtacattaagccaccccgggagacagacaaaccgatgcccacaaatgagagacgaccacgacgactcactcagaaaataacccaacagcacacaagccaaacgtccacaccacacagctggc

SEQ ID NO: 586031 - DNA, 468 bp, Homo sapiens
  misc_feature (206)..(206): n is a, c, g, or t
caagacagacactctgggcggctcactgcagcctccacctcctgagtagctgagattataggcacgtgccacacacccagctaatttttgtatttttagtagagacagggtttcaccatgtcggccaggctggtcttgaactcctgacctcaggtgatctgcccgcctcggactcccaaagtgctgggattacaggcgtgagcaantttgccgtggccgtggagcacattttaaattgccacaacttgtgggaggtatgctagtggcagctcgtgagtggcgccctagggattgccgctcaatatcctccagtgcataggacgccacccacattaccacagtggagaattagttggccccatagttgtgaacgatgctgtggtcagaagaccttgccgtagcaatgatggacttatgccatcagttgagaccctgcataggtgtgtgtcttcccaggctgatcttgac

SEQ ID NO: 586032 - DNA, 928 bp, Homo sapiens
  misc_feature (50)..(50): n is a, c, g, or t
ggaccggacgtgcactcctccagtagcggctgcacgtcgtgccaatgggnccgctatgaggaggtgagcgtgtccggcttcgaggagttccaccgggccgtggaaacagcacaatgggcaagaccattttcgcctactttacgggttctaaggacgccgggggggaaaagctgtgccccgaatgcgtgcagggctgaaccagtcgtacgagaggggctgacagcacattagtgacgggatgtgtgtcatctactgccaaagtagggagaaaagccttatgggaaagatccaaataatgattcagacaacaacacattgacacggtacacagcagtgcctacactacttaaagtatggaacacctcaaaaactgctagaatctgggtgtcttcaggccaactctggtggacactttgtgtgttctctgaagattaacagatttaagggaatggccaatcatgtccttggatggtcctgattggttcttagatatcaataaacgttggtatactttgctttggacatttcctgttagccaaaaaacaagaaaaaacaaacaaaacaacaaaaactttttgcggcaagacttggacccctagaagaaaggttttaaagaccatttgtttgggcgccgcgccccaataaggatactgtagccgattgggcacaaacggtggtcccagaggagaacacctgggcatgggcacatgcgctgttgtggtttccaccaataaaaaaccgcgccgcggaacggagttgtttagcaccaccagtatgggttcagggcatagcgggtcttcaccagggccagagagcagataatcgcacgcgcaggtgggagaaagacgtagacaacaggcagaccaacgaaagaggagaacaaacgacagcagcacagagaagacagcagagaacacagaacaacaaa

SEQ ID NO: 586033 - DNA, 185 bp, Homo sapiens
tcttaatgctcaccatactttacaactcacagaagggttacattttgttgtttttgttgtagagatggagcttcactcttgttgcccaggctggagtgcaatggcacgatctcggctcaccgcaaactccgcctcctgggttcaagtgattctcccaccctcatagcctccttgggggtaccgag

SEQ ID NO: 586034 - DNA, 507 bp, Homo sapiens
gcaggatcagacctactatcaggctccgggcgtatatgactacaaccaatggtagccgcagctgtcattgtccaccaagatgacggatgggacatatcatggggaccacaacgcaggagaccatcacgcgtgcagctagcttgataccaagagatcagagccacgatctagtgcctccatgtcctgtagctgcaggaacaatcccctgcattatccctagtggtccatgacctcagcacagcccttctaccacagaccaggcggatacgatgtgagcttcacgttcgcccctggatcgccatctcgaggggtggccctccgattccttcagacaacatttgaccccgatcaccctagagcagtctgccagaagaggggagacctaaagccctgaccgagacagagctgcgatgcacttcgccatgatgagaaaactagactgtccagaagttggctgtgagagaatgcttatctcaattgctccagacacgaccgctaccacggtgc

SEQ ID NO: 586035 - DNA, 433 bp, Homo sapiens
ccgcttctattccatctttgtgggcttatctgcctttgatctttgagtttgcgccttggatggttttttgtttgttgttgctgttgtgtttatttgttttctttgaacgactagtctgggcactcttctgtagggctactgtggtttgctacgggtctaccccagaccctagtcacattggtttttccagtacctggaggtatcatcagtgaaggttgtgaaacagcaaatatggccacctgcctattcctctgaaagctctgtcccaggggggtactgacctgttgctggcctgaccgtgcctgtaggaggtggttggagattccagttggaagatctcacccagtcaagaggaatggaatcagggacctgcttaaagatgcagtctggctgcattttggtagagcaactgtgctatgttggagatctcttc

SEQ ID NO: 586036 - DNA, 1085 bp, Homo sapiens
ctaaatccaaaccagttgaggtacagagtacacctagctcataaatatttgttgaatgagtttatgaatgagaaagattagtactttcatttctcatttagtttaattcatgtttatatgaatgtatataaaatgtagttatttgttccagagcatgttatatgaagaaaggcctttcaatagaatgatatcttctaatagacttgatgctttgttggttataccagctgtaactggtatgtagagagaatgttagcattatttaaacttcgagttgcaccgctgctattcatgctgcctcctaaacagaaatgatctatttcagtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggccttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacataaaaaaaaaa

SEQ ID NO: 586037 - DNA, 2039 bp, Homo sapiens
  misc_feature (660)..(660): n is a, c, g, or t
  misc_feature (1069)..(1069): n is a, c, g, or t
cacgaggggaagccccatatttctacaatgacactgtgacattcaagtgttatagtggatttactttgaagggcaatagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgatnacacatgggtgccaggtgtgccaacttgtatcaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatnccgttcacttgctcctgtcctttgtggtattgctgcaggtttgatacttcttaccttcttgattgtcattaccttatacgtgatatcaaaacacagagaacgcaattattatcagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggccttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacataaaaaaaaaa

SEQ ID NO: 586038 - DNA, 125 bp, Homo sapiens
tatcagccggcccttttatgggcacagaaatgtcttcttcctgggatgaggccgttgtctgcggcagtgggtggcaaagtctgaaaccaagtcgcacaagccctggtgagacagaagagccttgg

SEQ ID NO: 586039 - DNA, 827 bp, Homo sapiens
gtgctgtagtgtgtctgggtaacattagtcgagtcacccattgccagaagcaggtcttcaggaacacttgtagccgatcaaaacatctcagagaattgcgagggtagacagcgcggaacttccgggctatgagagtagggaaccccgcctgactatccgagggcagagctgcatgaagaggcacggattcccatgatccacgtggcccggcctgattaccaaagaagatttcgccacatttgattatatactatgtatggatgaagagcaatctgcagagatttgaatagaaaaagtaatcgagttaagacctgcaaagctaaacttgaactacttgggagctatgatccagaaaaactaagttattattgaagatccctattatgggaatgactctgactttgatgacggtgtaccagccagggtgtcaggtgctgcagacgcgtcttggagaagggccactgaggcaggttgcgtgcctgctgctggacagcctgactagaccccagcctgaggtcctgcatttctcagtcggtgtgttatcacgtccagggcccaaagcccagctctttgtagcagttcgacttacctggtttccttagccttaagaaagctaatttgtacgaactggacctcaagctgtgttgggcagggagaactccataaagagtcttggcttcagacagcttatgggggtattgcaagcattctttagactaggtggacatctccacttggccccggctccacacaatgagaggagccactaaaacatgatgggaaccccttgaaggccggcaatcaagcggggcataaaagacaccaca

SEQ ID NO: 586040 - DNA, 1383 bp, Homo sapiens
ttggttatatctcttcattccagacctacatgcatctgttatccctgttctccgctaataatgcctttcggtattgactttttcgtttctcgacggtctgtaatcaaacctgtccgcaatttgactcgtgccaagttcgtgtggtggcaatctcactgacactgctcttatgcatactgttggcaacataaccccccatgacgtgtaatggagcaacgtttggatgctcgcgactcgtctgtttcccgggtcgcgcgacaacgtcgtgctaccaaatggcaagatgttgaacactttcagggttccctggttttactgcaggggttcgctggtgtacttcggcctatgccctcaataggagatcacgcggtcataatattcggcaggcgcttggtactccgggctagcaagaatcgatagtttcttcaacggtatgtacttaccctggtccacattccacaaccgggtccatttcttaaggattgctcgcgtgtatccctaatccttcggttctctatatcggcacacaggttcgtcgcacttcgctcccctcagcatcatctaagcatgagactaaagcgtagaacatcttcctcgtatggtgtggcgtactcagttgagtgcacagtgaagtagttgcgtagtgccgtgatccaatttgtagtccctctgagcctatcgaccttaatacttccccatggaggtctatctctctacaaagagcgtttttaatggccctttcatctccatgcttcgatgcacttctttgctcatctcaatgagctacatggcgtgattgtctatattgttgcgtctaccatcgaggctcggggctacacaagttcggtgcgttctagagatgtgaagcaatctccttttagagatgaagctagcggtgagatatctggtagccagggcgtcagctcccccatctgctgcacgttcccacgagccaggatatcgaagactagcatattcggacaagctgacatggactcgtgggtgcaagcacgctcatactacacgtatacggtcaagcccctcatatgatgctagtcacagtacgtctaggtgcctcttcagagcggtactagagacggtaaagctgcaagtagcagtctcaaggcatgccattcctcaagtcactagtagctaactctaggtcttacatagaagcaaaggcaaattgtacccgatcttgttttacaaccatgcgtgtggtgtgataaacgtgtttctagagagtcatcgttaagggtcaccagactttttcatgccattagggtagtacaagctgagcatttgttttatagaatcttgtcatgttggaaattggggggagggggggagtgtatacatcctgtggtatgttcttaggttgtt

SEQ ID NO: 586041 - DNA, 1029 bp, Homo sapiens
ccttacaagtatatgagtattatttatagcgtagctcgtttacactatgcagtcgggaccaaagagcaactggatccacgtgaagtcctgtgtgtggctggtccctacctgggcagctctcatttgcacccatagacccccatctatggacagcgctggcgacagaggcagcatgggttagatcacacataacacatagggctctatgctcatatcccaagctgaacttgagccctgtcttgggctcaggagatagaagacaaaatctgtctcccacgtctgccatggccactcaacggcgggacagagtagcatggctgctctgcacgcacactggtgtgaacatgcgcttgccatctcaggagctagactggcccggcctccacttctggtcactctgtcaccctgagacccatgacgctgccccttctcagcggtacagatcagcctactatgaggacctctggccagctctgctacagccatctgactccatctcagcacaatgtcaacttcactctaacccacctgatggccaacaaggaccctacaactggcctgaccgccattcaacggctcacactatcttgcatgtcctggttcctatcatcgctcttctacagacccctcagctcacaccaattaacaagcctcctcctccacgcaacccactttctccaatacgtatcacagctcatggaagcgatcatcaaatgccacggtagctcactcccacgtgagctacccggaaccttaccctcgcccctccagagggcgctcggagccgcacaccggtcacccggtgcaacccggcctctcgacccagtaagaacaaaccaacatgaagcaacatcgcccccagacaacgaaatcaacacacactccaccgcaaccaggacaaacgacaccagactgcgacgccacccacggcacaatgaaacggggatgaccgatcagcaggcaccgccaggcccctacccaaaccacccaaccacaccaaccatacctgcgcagtccgcacggcaacag

SEQ ID NO: 586042 - DNA, 962 bp, Homo sapiens
  misc_feature (575)..(575): n is a, c, g, or t
  misc_feature (592)..(592): n is a, c, g, or t
  misc_feature (602)..(602): n is a, c, g, or t
  misc_feature (629)..(629): n is a, c, g, or t
  misc_feature (634)..(634): n is a, c, g, or t
  misc_feature (749)..(749): n is a, c, g, or t
tgcaacagctctttggagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggattttttttttttttttgggctcatttccacttttgtaacccagaactttctatgtactacaaaccgggtttttaaaagggaactatgtggctatgaattaaactggtgtcgggctgataggacagacgggattttccatatttcttataaaaatttctggccatttagaagaagagaactacttccagggttgggaagagataaccctgaaaagaagaggggcttatcttcactttatcgataagtcagttaattggttccactggtgtacattctaatattctcctttggacattataacngtgggctttctaatctngtaaattatntctattttcaccaagggttttaatatnctttnttatgacaacttagatcaactattttagctgggaaattttctaaacacacttgtttttcgccgaggaacaaggtgtttcaaaattttgtgcgctctgacaaaaatacgttgtttntcatctcgtatggggccagagttagattcactctggctttttaaacaaaccctgattgggcatacaatggggtcagttgcacagaacttttggaaatcattaaactttcaaatctcccatccggtttggggagaaaataaaaggctcttaaagtgaatttatccgcatttaaccattctctctgggatcggctctccaaaaaatgcttaaaag

SEQ ID NO: 586043 - DNA, 125 bp, Homo sapiens
tagcactcagcaccatacacaggtaccaggcgacttgagaaacagaatctgccgctctaaacaactgaatggatcattcacctgagaggacgggagcgatgtgcggcatcatgagcagggaccga

SEQ ID NO: 586044 - DNA, 157 bp, Homo sapiens
ttggggggggatttttccccttttaagtggggaaataggagttacctgtgccaagaataattttggaaaaatttctattaaaatccactctgaagccaattggactaatctgagattgggtttgttcctaataaaagtgaagtggatttgaaaaaaa

SEQ ID NO: 586045 - DNA, 395 bp, Homo sapiens
cccagctgttctctaccatacaattgaagaatatattaaaatcttggaagaagaggaagttgaattgtagtctagttgtgcctgttccatagtgtgcagatagtgatcctgccaacattgttcatgactttaacaagaaacttacagcctatttagatctttgcctggattagtgctatgtgatccctctgaacacttccatttgtttatgccagctcagaaaccgactgtagttacttattaacatctaggctggaatcctatttgcctcagtcctatcttattcatgagcacatagtttttactgatcgccttgaatccattgatcacctgggtaactgtatctatcgactgtgtcatgacgtggaaacttacaatctggaatgcagataaac

SEQ ID NO: 586046 - DNA, 347 bp, Homo sapiens
aaagcttatagtgcaggcctatgatgagaggacttccatgaaggtctctgacacgcctagagacatttcctcatgtctggcgattaatattcagctcctctttacttacgcacatttctgcagccagcttgaattcctccccagaaaattgtttgtttgtttgttttctaccatgtgatcaggctgcaaattttccaaattttatgctctgcttaccttttaaatctaagttccggtttcaggtcatctctttgctcatgcttaacaaaagcaatctttgctccagttcccaataagttcctcatctccctccgagtctacctcagcctggacttcattgtccatat

SEQ ID NO: 586047 - DNA, 126 bp, Homo sapiens
  misc_feature (16)..(16): n is a, c, g, or t
  misc_feature (23)..(23): n is a, c, g, or t
tcagctgatacgcccnggagtantgatatcgtcgatccacggcgctcctgcttgaagaggggagggcgcctagtggaattccgcaccttgtcatgtaccatcaataaatgtaccctgtgctcaacc

SEQ ID NO: 586048 - DNA, 128 bp, Homo sapiens
gctcctagttccagacgccattggttcattttcacagaggagggacaagagctactttcacaagccttgttgggcaagggtaattgttggagattcttgaggggaaacccttggaaggctccttggtt

SEQ ID NO: 586049 - DNA, 1006 bp, Homo sapiens
  misc_feature (287)..(287): n is a, c, g, or t
gaagcctccgtccaggggattttccttgcgtcaaggtgtgcgcatcggacggcacagtatgtcgaggtgctggagaggcccactggagttgtaggcatgtttggaagacggggaatttctggtggatcacctacaggtggtaaatagagtttgtgtgtccgaggtgtgagtgagaaatggcggcgatgtttggtgttagctgctgtgtattctccagtgaacaagcctaatgattcgcttgagccatcatcagaacaactttctatttgaatggttcctattgcganggaaaaggggcaatatcgtcactaatagaatgtctccaatagctggattagatgctggagtatcaacacctcttcccttctaggttttctgagagacttcctcgttggctcccaggaggagggattccactgaccttatgacgacagcatgtgccacccgtgtgggcacttataaagaccttgtagtggtagtagataatacaccaaattatgcttgtgttatgtcctcattcttccctttaccatctgttcagcatagacttgaactgcccttatagcccagacatctgttgagacctgacccctagtcaattggttagccagtgtgtcaggcaatactcggagctttcctcagtcgagtgccattgagattgggcacctgtgcataagacgaggcaatcggttgcgcatattcctagattgtgggattcttgcagataaattctttgctcattttcatttcacttcctgatagtcagggtcggcttgtgagaagttgttaaacaacatgctaaatgtgaaatgtcaaccctcactctaaactttccctgttcagagcatcagactgaagacttcatatgggttttatagtgggctttctgattgtttggtagtccaattgaagaagggagtttgaaagttgttgatactgtaacgttgtacgccctgtcctgcctgaataccctactgctgtatgaccacatcttataagtgactgc

SEQ ID NO: 586050 - DNA, 211 bp, Homo sapiens
atatgacatatcatcagtaaatcaacgttatagagaataaagtctcttcaacttagtactgcttctctatccaggatgatgagtcaacaggtttcactaataaatgtcatgctgtagcatgtgtaagacttgtaaatgatgaaattcaaagaaaactttttctatggctaggagcctgccagaacaaaggccaatatataatgttgtgaca

SEQ ID NO: 586051 - DNA, 479 bp, Homo sapiens
gggaatgtgatacacttgttaggtaaaacagattttttaaccttctttagacatgatttgtgactgtggaagtgaaatattttatgtgaaaagttaaaaaaaaaaaacaaaaaaaaacacaatcagatgaggtctgctcattctagcccaggtgcagagttttctaaagtgggtgtatgagtgccacacggggttttcagtgtctcttgtaaaaatgacagtgctgtcagtgctttggagttgtggcacccacagcacaaccctgatgtccctgctcctcttgactcgtggttgattagtttggaaaatgtaagatgatgactcagggctttgtgcacctcagccacagtctggttatcctctgagtcctctgggttttttgaggaccatagaactgaaccttctcctgcccttgcctgcctcaccatcccatggtgctattgggattgttagaatgaaaaaatttatgtttagaccta

SEQ ID NO: 586052 - DNA, 519 bp, Homo sapiens
  misc_feature (288)..(288): n is a, c, g, or t
caaaatgttgaagttggaacgcacaataaagaccatcatcaacaccttccaccaatattttgtgaagttggggcacccaaacaccctgaaccagggggaattcaaagagctggtgcgaaaagatttgcaaaattttttcaagaaggagaataagaatgaaaaggtcatagaacacatcatggaggacctggacacaaatgcagacaagcagttgagcttcgaggagttcatcatgttgatggggaggcaaacctgggccttcccacaaaaaaaatgcacaagggtgangagggccttggccccccccataagccaggccttggggagggccccccctaagaccacagtggccaaaatcacagtggccacggccacggccacattcatggtggccacggccacagccactaatcaggaggccaggcccccctgcctttacccaaccagggccccggggcctgttatgtcaaacttttttggctgtggggttaggggctggggccaaaaaaagttttttcc

SEQ ID NO: 586053 - DNA, 315 bp, Homo sapiens
gaattcccccccccccccccccccctgtgtggaagatgatttcaggaaagatcccagatccctggaaagggaccattaagagaggattcatgaagatcagaacactagggaatgtgtccatcagtgacctcctaagtcagattgaaagggttaagtctgtggtagggttacagagaaatgctggcccatgaaagcctctgatcatgtgtaaaatatgtggtcctggaacggggagaaatctttatctgacagaacattgtcctcctgcggatgtgggattcttggctctcccttaaaagtgcaccactgactgat

SEQ ID NO: 586054 - DNA, 341 bp, Homo sapiens
ttatttttttttaagggacaggtctgctctgtcgcctaggctggagtgcaatggtgcgatcttgactcactgcaacctccgcctccagggttcaagcgattcttgtgcctcagcctccccagtagctgggattacaggcaccagccaccatgcctggctattgccttggctattcaggctcttttggagttccatatgaattttaaaatagacttttctaattctgtaaaggatgtcaatgctagtttaatgggaatagcattgaatccacaaatttcctttgggaagtataatcattttcacgataggatcccttcctatccatgagctttggaatcctt

SEQ ID NO: 586055 - DNA, 370 bp, Homo sapiens
gaactcctgacctcaggtaatccactggcctcagcctcccaaagtgctggaattataggcgtgagcacccacaccaggcctatttatttatttatttattttgagatgatgtctcaatcttttgcccaggctggagtgcagtggcatgatcttgtctcactacaacctctgcctcccaggttcaagcgattctcctgcctcagcctcctgagtagctgggactacaggcatgcacccccgttcctggctaatttttgtgtttttaggagagactacgttggccaagctggcctcgaactcctgaactcaatgatcaaccaccttggcttcctaagtgtttgggattacagatgttagtaccccgccccga

SEQ ID NO: 586056 - DNA, 753 bp, Homo sapiens
  misc_feature (400)..(400): n is a, c, g, or t
agcggcttgggttttttcggccatctttggtcttcccgtgaagttgtcgccatgaaggtcaagctgtgcagtttaaccgggtacaagaatctaccccggacacggaaggtcgtctacgtccaaggaccgtagcggtgcaaggtttccccagtttctcgtaatagtaggcgaaaaattgcgagatcgagcgtatctccttttcacaagaaggataatccttcgtgctagaattaacacgtgtgacggtgtccttcttacatgacatggaacgcgcagagaagacggcgacgagctgcggtaaagaaatattcagacaagaaagagagaaaccgcgcgcgaagccgagctgcaaattctccagaaggtgcacataacggtgggtggcatctctggccgtgantattaagtggtccaagaaggcaattcaggaaaccgtgaaagtttagaaagagggctcaagcggagtaaacagagcctactcaggggcttgcttagaggagagcaaaagaaggctaaccaatgcttctacaaaggactgtgcacagtggcttgcgtgcttataggccaccttacaagaggcagagaccataggcaaacggatgggtgacgccgtggtgaaagtttacagcttcccgcgaagttgggtgtggaaaaggctaaaacgggcgcgaattgtagagtttgtaaactaacgaatggcgcatatagtgagcccaaataaagaaaacaagaaacctctcctcagggccccgt

SEQ ID NO: 586057 - DNA, 582 bp, Homo sapiens
caggatcaaggtgaaaaggataacccatgcaggaattttgcatctgcaggctccgcttcaacatctgtttaggagaaagtggagacagactgacctgagtaactaaggtcttggaacagcttacaggtcagaaccaggtgttttccaaagctagatatactgttagcgcctttggcaacagaagaaatgaaaagactgttgtctgctgcacagttcgaggggccaaggcagacgaaatcctggagaatgatctaaaggtgcaggagtgtgagttaagaaaaaataacttctcagatactggaaactttggttttgggacccaggaacacattgatctgggtatcagatatgacccaagcattgatgtctacagcctggacttctatgtggtgctggaaaagccaggtttcatcattgcaggtaagaagtgcgggacaggcttcattggtgccaaatagaatcagcaaagaggaggccatgcgctggttccagcagaagtatgatgggatcatccttcctggcaaataaattctcatttctacccaaaagggtaataaaaagttttcagtgaaatgtttaaaa

SEQ ID NO: 586058 - DNA, 237 bp, Homo sapiens
gggcccgagatgtaacctttttttgtaggcatccccatgaccaaagatatattttttatttatttattatatgggcccttcaagaagtccctgtcagaaaaataaagaattgttttaaatgtcatgattggaaatgtcctttgcattgcttggaaggggtgtccctaaacccaaggaaattggttttggtttggaaaaattttgctgttattatagtaaacatccaaaggggtgtca

SEQ ID NO: 586059 - DNA, 1774 bp, Homo sapiens
  misc_feature (208)..(208): n is a, c, g, or t
  misc_feature (1563)..(1563): n is a, c, g, or t
cgttctgtactctctctccctgctcttctctctctcctatcgcgtctccgttctctttcttcctcctccctctcttcttctcttcttttctttcttctcttctttctttcttgctatctcctttgactacctctgtctttttctactctctactctcttctttcacgtcctcgttctttcttcatcttatttccttcctctctttctntctctccttgtatctttgtcttttctcctcttccttcatcgttctgctcgtctcttcgcctcttctctctctctccctgcctttttcttcttttttctctttttatctcttctttttctttattttctccttgtcgtcgtttgtctttcagttcctttcctttcttttagcttcttctctcttcttcttcttctccttctcttttttcttccttctctatcttcttttgtcttcttgtttttctatcttcttgagttctttcttcctttctcctctcctttcttctctccttttcttttttctgttctctcctatccttctttgctttcttcctccttatctcctttgtttttctctgttcttctcccttctctttttcgttcctttttcgtcttttcgtcctgtttttcgcttttctttcttcctcttttacttcatattctgtggtgcgcttctgagattttatcttgttctctttcctttctttctttcgcttttctctgcgtctgtcttggtcgttggtcttcttcttgtgtgtttaccttcttctctcgccctttctttctcttctccttttcccttttctttctttttttttttttttcttttgcactttccctcctctccttcattctcgctctttcatttcgttttcttctgcctctcactctttctgccacctcttctttctctttttctctttcttctttcctctccttctttctttcttttctcccctctctctccttcctctttccttctctcctccctctctttttctcttttctctttcttctcttctctcctctctcttttcgcgctcctttcttctttctcctctctcttcccgctctcttctgcacggctctgctctctctgttgtgctctgtgcgccttttcccttctcccgcgcgttttcttcttctcttctctttctcctctcgctccttctctctcttatcttcttcttcttcctctacattctcctctcttctttgtctctctctttctctcctctccgcgctcgccgtgtttttgcctcgctctctctctctctctctctctcactctcgtgtgtctctctcttctcttctctctctctctctctctctctcctcgctctttcttttctctttctgtgttctcttctttatgtgtctccttctgctcgttctctctctctctctctctctcttctttgtttgtctgtgtgtgtgtttttttctctctctcgttcgcctttttgtttcgctctcttcgcgctcttgtgtgtatgttgtctctgttcgctctctctctctctctctctctctctctcttgtttgtctttctttttgttgtgtgtgtgcggtganggtgtgtatattatatgtgttgtttattgtttgttgtttgttgttgttataagagataggctgcgactgcattataataataaaaataataataaaataaaaaaataataataaaataaaataataaaaataataaaaataatatataatataatatataatataataatataataaatataaataatataataataaatatataggagcc

SEQ ID NO: 586060 - DNA, 244 bp, Homo sapiens
  misc_feature (8)..(8): n is a, c, g, or t
cactgtantatgtaacgatagactccaaacttaatatggagactctccacagtatacacgccgtgtgtcagatatagggtcctaagttccatgtaggctgtgctcgtggatgtgtcttgtggtcaaggtgactctgtcctggaatttcttgtgcatactctgtgtgaccattgtaaggggcttgatccatccccatcactcaatgcctttgtcaggggcgggtaccctgagctcgaaattcgta

SEQ ID NO: 586061 - DNA, 341 bp, Homo sapiens
tggatcagagtggcttgtacttccctgcctgaacagtccacagccaatggcactccagtccttgtcacatggttccactcttaggatgtaaattaggaggtaccagcttgagaggcagaggcaaaggtaaggttaagatgcagctgtgaggctgggcacagtggctcacgcctataatcccagcattttgggaggccgaggcgggcggatcacttgaggtcaggagttcaagaccagcctaaacaatatggcgaaacctcgtctctaccgaaaaaatacaaagattagctgggcgtggtgtctcatgcctgtagtcccagctacctatggggctgaggcag

SEQ ID NO: 586062 - DNA, 171 bp, Homo sapiens
ggggaccaaagaatagggcggtgacacactctatttaatacgaccaaattgctcactcatcaccagggggatggcccaagccattcatgaggaatctgcccccctgatccaatcaactcccaccagacccctcctgcaatgctggggatcacattgcaacacggtctctca

SEQ ID NO: 586063 - DNA, 129 bp, Homo sapiens
  misc_feature (128)..(129): n is a, c, g, or t
tcctctcctttctgctagcctggctaaatctgctcattatttcagagggggtaacatagcagtctaatgagtgactacagggccctactactctggccttttttacggcttagagcacagaatacggnn

SEQ ID NO: 586064 - DNA, 1142 bp, Homo sapiens
gggagtcgtgtctctctgtcaaccaggagatcatggcagctcacctggtcaacgcgatgtacgtgtgcgtcctggatgataagctgttcgtcagggccccttccatggtctccagattgtgccgatcatgatgatctttgcactgggatagacaccaatgaagaacatactgacattgcctgcaggacattcatcaggccagtgtattccaatgctcgactaggtctcctatgaactggacgacgtggatggacgcaagggaagcagagccgcttcgttacatccccataacagtgagcagtaatgcaatggtggtatcacggtgcgatccaagaaagggccacgaaggtgcacaccaggatagcgtcccatgtggtaggctcacatgtgagatgggaccgagagtcttacgcgacaccctttgggcaccgagctatactcggaaggcgagtccataagcgatcactctgatcgcgggacgtcatcagtcactgggcctagtcgtggagcaaagaccagtgaagcattaagaggatttagactccactgacaggaattgaccccacgtgtgtcatttcaacctttcatcatgatctgccgtgcaagcagagtgcaggaattgtgcctcgcggtcgtggaccagtggtttaccctgctctgcgagaaagtctgcacctgtggaagtgccgctgatagttgactgctgggaaatcatccgaccaaaggaaccgtccagaggacaggctgcatgatcgaggatgggaagcaaggacaggtccgggctgagacgcattgccgtgacaggcttcagacggtatcgaagctagcctgggccctttccgtgagccaagagtgtccattggtgcccagaccccttctcacaagagagacagacactcagcatggacgctggcttggcttgaagactgctcaatccacacctgggaacaagggcgttgtgaacagaaagatttgagagcattccccagtagcatttagagtgaaccggtcaatggatgaaaggtggggacaactcctcggaagccaattaaatggaaaccgcctggtaagcaccaacgtggcctgggagattagagtggagcacctttgggccccgaatgcagctggcggaaagggtgctg

SEQ ID NO: 586065 - DNA, 345 bp, Homo sapiens
caagcccaaaccgtattataagactagtattattctaggtctgcagcatcacagaatatttcctaatagagatttgccacatcacatatggcaccatatccaccactattctatgtctagcaaatattcctcatagtctttgcttatgtcttttctctgtaagacactgtataaaagcattatacacggcacagaaatatgtcaccatcgaaaaggcactgtctacagctgcaggcagtcacaaacaataaatacacgcacatcccattctgtagggggaaaaataccaaagtaaatgggtcaatttctctaaaacgcagagaaatattacaactctaccgtggg

SEQ ID NO: 586066 - DNA, 228 bp, Homo sapiens
tagatatagtatccgcaggggaaagatgagagagagattataaccaagcatcatatagcaaggactaacccctataccttctgcatatgaatgtactagaattaactttgcaaggagagcgaaagctaatacccccgtaaaccagacgagctacctaagatactgcttagagagcagacccgtctatgttggacaatagtgtgaagattctataggtagaggcgacga

SEQ ID NO: 586067 - DNA, 930 bp, Homo sapiens
agactgctcatgtctctagaggtagttactaaataattacatatgatattgtacctgataaatatgtatctagattctacaaggtcaagcatttatgtggaagtccggaggtcgagctcctgagcgggataacttctgtgttttggcgtcagctcgttcccctgcttcctcttgttttgttatcttgtgtttcttctgtctggcgcagggggggtctaggctcctgtgtggctccggggctgtgcagagcagggggtgccgccatgctcggcccgggtgggttctctgcggccctccaggggtcagggtgaacttgctcgtggtcctgagcttcccaaaggtactgagggattaacggggcatgcatggcccacaagtgaccgggggcctaaatttctgggatatcttatagccataaagagcgggggttggcacaattgctggcgcaaggcgtggttctttgaagctctatgacctcggtgatgcaacacccgccaggggggccccacaagaggggcggggaataccgggttatgggaccaacggaaactgggcggctcccgagaggccctctcaagaaaatacaatgggggaaggggggcccacactgctatggaacaaagagagataagaaacttgacactaagaacagtggaaacagggaacccgggtgccaaaggctccacaagggccgggaagaaagacgcgcacatcgcgacagaccctgttaggaaccacgtcatcccagcgaaagggccccatatggaggggaaaaacccaatggtcgcgagggccaaatggggggtgaacattgaagaggaaagtttcttgcagaccttaagcaaaattggaaaacaagcaaacgacaaagagtgcctccttcctatccgtggcattttccctcttcttcaagtgaaagaaagagaagaa

SEQ ID NO: 586068 - DNA, 386 bp, Homo sapiens
aggcgtttacatgtttcctccacccacatttgggcttccactgatctgcccgagggcattcctggctgcaccacgcggcttttaccctcattgtaccatactgtattcagcactcactagaaacagggtataggtgatagtatccaccgcaatagcactacaggtaaatgatcaacaaaaccacccagaaacaaatccaatcccacaatctccaagttcgcctggactggaacttctcttgcaactctttcaaaataaatgacaacagcaacaacaaacagacctctagggtgtttaaaaagatgaagtggcgctgcagagctgggctctgctcaaagattgcagtgccatcttgtacacacccacctccattataaccggcttcc

SEQ ID NO: 586069 - DNA, 128 bp, Homo sapiens
actctagaggtatccccgcggaaggacttgatggaccacacaatctcgtcctgttctcgcgggacccacttaacgctccccaccgtcgtgtcgtgtgaatctatggcgtgcagatcaggtatccagtt

SEQ ID NO: 586070 - DNA, 536 bp, Homo sapiens
  misc_feature (444)..(444): n is a, c, g, or t
aaaacgcggcctttttcgactgggggacgattaagatagagagcccgggcatagaccagacgaggagcgggttccccggcgtggcaaggatgaagacagaggccctagacggggacctgaggaagatagggtctctcgacgaggggcagacgatgaccggccctcctggcgtaacacagatgatgacaggcctcccagacgaaatgccgatgaagacaggggaaactggcgtcatgcggatgatgacagaccacctagacgaggactggaagaggacagaggaagctggccaacagccgatgaggacagaggaccaagacgtggggatggatgatgaccgggggccgaggcgaggaggcgctgatgatgagcgacaacctgacgtaatgcagaagaagacccggggcccaggccagggatggacgaagaacggggacccaggcnaggcatggaagaagaccggagcccaaggcgaggcatggatgaagaccggggacccaagctagggaacggaggatgaccaggggcccaactaa

SEQ ID NO: 586071 - DNA, 597 bp, Homo sapiens
aaaggcgctgccaggagggcgctgaggggaagacgcgcatctcgaccgggtgggaggcggcgcggggcgggcagcgcggcgggtccctcgcgtctgtgcctggagcccgggctctcgcggacgccgtcgtgacctccgggacgccggggccggaggcgcgccctggggggacccgcactcctccggtgtctccacgggcgtggcaggcctccggccgcgtctcgggcgccgaagaggacggcgaggagcctcggcctgctcggcagcgaccccgcagggaggccggggcgggaggccgagcgtcggggcggcgtacctgggtgatggagtccccgaagagcaacaagcgaggcagagcagggcactcccgcagcccgcggtcctcgacacagtgcaatggatgcagccgggcggggcgtggcgggggcgccagacacgagaggcgcctgcgcaagtggccagccgtgggttgcgggagccgggtcgtgggcaaccccacggcagtcactttggtgacgcgcgaaggtccgttgcccccttggagtccgtttggaagaaggctcggctccgcgcttgttaccccaagcaaggtgcccc

SEQ ID NO: 586072 - DNA, 160 bp, Homo sapiens
agggagaagaaggcttatgcacaaggaggcactggcgaactctaaccaggctatgggcactagggggcgcactggggacctgggcagcggccttcacggaagagaaacggcgcctggcaaggggacggactgaggcttcaggagggcaggcgccctgttg

SEQ ID NO: 586073 - DNA, 392 bp, Homo sapiens
ggacttaaacttatacagtaaaagtatgggaatagtactaaatttagaatagtggttactctaggataacaaggagagaaggaaatggaatctcaggggccagtcgaggtggctcatgcctataatcccagcactttgggaggccaaggcgggaggatcgcttgagtccaggagatggagactaacctggggagcgtagtgagactgtctctacaaaaagaaaattaaaaattagccaggggtagtggtgcaagcctgtagtcccagcactcagcaggctgaggcaggtggactgctggagcccaggaattcaaggttgcggcgagctatgatcacaccactgcacctcagcctggatacagagggaaaccctgtctcaaaaaaactaagtt

SEQ ID NO: 586074 - DNA, 99 bp, Homo sapiens
ggatttgctggtgcagtacaactaggcttaatagggacatgtgtcatggctatgagggaaaaaaaacgttagaagcttgaattcgagcagtagtagtag

SEQ ID NO: 586075 - DNA, 989 bp, Homo sapiens
gccgtctccctcctgtcgctagtcctcctctctcagtcggaaccacagcggtgggtgccgggcgtggtgtccggtgggtgtggtggttgttgtctcaccgatggtgtccgtgccgttcagttgcccgtcatggtgacctggatccgttcggcgcccctgccggtgccccttgacgatcccgcgctgcgtaacacggagtggccggtgccgagtgaaagaagatccggccgagttcctttcttggcgcaacaagggagagctagattgctggtgaatcgaagaacgacaatggccttccgactatcctggacggcgacgcccccggtgctcaagaccgcacgtgaaaaacggcgtcgaggtcctgaatgctggttgggatcggtaggtcaatgaaagtggagtaataatgtgagccgaccgtaaccatgttcatgggctcctgatcatacgacgaggcatcgcaaccgttgattgttcccactgaaggtggtggcatacgaatacgttgcgtcatggagaccgtgtcccacacgaacatacccggatcagaaggggtaacagcacatgaacccgatgtgaaactgctttgttgcatgtccccctctggaatgcatcaccttgctccccgccaaaacaataacactcgaagaacatagtcaagttactgggaataagaacagactagccgaaccatgtagggacgcactcgtaggaataacaacctgtatcgtaaatttgatagatgataaaagcagaacgccacgaggcaagttgagtggccgaacgtgagtagtgcgctgggattagatgttaacatatttaactctcctaaagtctaactcagagcgatgcccaaaagaaggttcactcgaggaatagccgctacagtgcgatatttgccaacaaagaaagccactggagccttgcaatggaaaaacccgacacttgttacaatcactagcgtatggaaaaatccttaggacgtagta

SEQ ID NO: 586076 - DNA, 140 bp, Homo sapiens
aggagaggatatcatcagagcctgactctgaagtcagtcttgtgacttggtggttgctgtgtgaccttttacaaactcctttgcttttctcgagcatctgcttatccgctttcaaatgaagaacatagagattcaaaaga

SEQ ID NO: 586077 - DNA, 246 bp, Homo sapiens
gaggatctggcagctatcggtcatgaacataacatataccatcaatactcatccattataatcataatggctatagcagtaaaactaggaatagcccctttcacttctgagtccagaggttaccaaggcaccctctgtaatccgcgctgcttctttctcacatgacaaaaactcagccctatctcaatcatatacccgatctctccctcactaaacgtaagccttctcctcactctctcaatcttg

SEQ ID NO: 586078 - DNA, 848 bp, Homo sapiens
  misc_feature (210)..(210): n is a, c, g, or t
  misc_feature (830)..(830): n is a, c, g, or t
tttcccaagttcagcaatcagtgcagcgtggtgagtccagaatatgagaaaggatttacatgggtataatgtgaagtcagatattacagtgttgggatacagcatgtgaattagccagtgggcaggtcgctttccaggcacatgcatagaactcagatgctgttacagaaactgaaagcgtctctttatagcccatgtgatatcagtatnttccctcaaatcagaatccagaatgaaaaattcccagtcaggtgtagatctgggactggagaacgtgtgtggttccaggtgacttcacaccagtaaatagtgcccgattacacacaccatcctcaaaaatttctctctgccttccttaagctgggtcacagctcttgttgggcaacaaaggatcctgagaaagagaccatcagcaagcagtttatggtcccatgttttcttcaaacagatgaaagaagcaagcaggattcaatacttccaatgtggcctctgttataaaggccatcaatatatggctccaggggttaccttggattgagcaagaatgtgatttcctgatgaaaaagaatcattatggatctagggctgcaatcatttatgtctatatatggacactttctgcgttatttctgattcaggtacaataccgaatatctgaaactcggtgcgccgggcaatcattttaaacctcgtcaagggcacgtgaggcctgttgcgaggctagaaggacatgatacatcgagggaatggatacagggacctaatcaaaaggggcataaatgcgggggcaaaagaaactcatccttgaacaaagaacacaggggggttcncccattcaccctcctacc

SEQ ID NO: 586079 - DNA, 1049 bp, Homo sapiens
  misc_feature (41)..(41): n is a, c, g, or t
  misc_feature (44)..(44): n is a, c, g, or t
ggaggctgaggcaggagaatggcgtgaacccgggagcgggnttncagtgagcggagactgcgccactgcactccagcctgggcaacagagtgagactccgtcaaaaaaaaagctctcctccccagatttgtgaaccttgtgactgttcagtggacacctcacatattgctggtgggaaggtcacgtggagacagctgggcaaagccttggggcgttaaacacagagtcactcatgacccagcacttcctctcctatgcaccttgtacaccccagatcaatgaaacctacatccacacagaaacgtacacaaatctctcagcagcactgttcacagtagccaaaaactagaaaccacatgtccgtcagctgatgaatggagaataaaacgtgggaaatccacaccaggagagaaaaaggagtgaggcaccagcataggcaccccgtggatgaacccggaacctgacgctaactgaaggaaggctccggctatagggagtgtcccaggcacagccagagattgaagggtgccggggccgggagttggtgggggttggggctggggacacagtggccagtgtgtgggtttgttttggggatgatgaaaatgttcttaggttgtgtgtggtgatggctgctcacctctataaaccttttactaaaaaccatggactgggtggatacagtgtgtgaattctctcagtccagtgctttgtttgaaacaaggtggatgatgccaacatcactaaccgccagggagacgcaggccacggccacacccggctcactggagttgtgaggatggaaacaccagcccaccccactcagttcagacctcagcttagatgcaaagaatgtctgggatggggactggcagctgattagagatgcaaccactgaacctgtggactgtgttcaaacaaatgccagcagaacacaaaaggcgactgttacaggaggccgaggcaggtggatcacaaggtcaggagatagagaccatcattgctaacatggtgaaaccccgtctctactaaaaatacaaaaaaaaaaa

SEQ ID NO: 586080 - DNA, 1127 bp, Homo sapiens
  misc_feature (41)..(41): n is a, c, g, or t
  misc_feature (44)..(44): n is a, c, g, or t
ggaggctgaggcaggagaatggcgtgaacccgggagcgggnttncagtgagcggagactgcgccactgcactccagcctgggcaacagagtgagactccgtcaaaaaaaaagctctcctccccagatttgtgaaccttgtgactgttcagtggacacctcacatattgctggtgggaaggtcacgtggagacagctgggcaaagccttggggcgttaaacacagagtcactcatgacccagcacttcctctcctatgcaccttgtacaccccagatcaatgaaacctacatccacacagaaacgtacacaaatctctcagcagcactgttcacagtagccaaaaactagaaaccacatgtccgtcagctgatgaatggagaataaaacgtgggaaatccacaccaggagagaaaaaggagtgaggcaccagcataggcaccccgtggatgaacccggaacctgacgctaactgaaggaaggctccggctatagggagtgtcccaggcacagccagagattgaagggtgccggggccgggagttggtgggggttggggctggggacacagtggccagtgtgtgggtttgttttggggatgatgaaaatgttcttaggttgtgtgtggtgatggctgctcacctctataaaccttttactaaaaaccaaaaaaaaaaaattgaaaaaaaaaaaaaaaaaaaaaaaaaaaaaaattttttgggccccccggagcccccgggaaaaatctttactaaaaaccctctgccgtggggccgcacgcgggcccccccggtaggaggtttaaagcagcacgaggtggcccacacgacggtgtgcccaagggaagaaccgcggggaccgtagacactagggcgcgcgggagattttccccccactctatatataaaaaaaaaaacgcccccgcgggggggacaccaccgcagagattcgttctttcggggaacacacatctccccccagagtgaggagagatttcccaggggagggacaatttaagcggggcgacttctataccacaacgagcgggggagtctcccccaagggcgagaaattgcgcccgaatattatccagaattagagagcccccgcaggtggtacgggagaatga

SEQ ID NO: 586081 - DNA, 288 bp, Homo sapiens
tgatcttccgtgccccatgatctgaatgagaaatttaacagataacataaacaagaaacagaaattgtagaactgaagaattcaactaatgaaataaaagcaataattgaggtggtcatggtggctcatgcctgtaatcaatcccagcattttgggagaccaaggcgggaggatcgcttgaacccaggagtttgagatcagcctgggcaacatggtgagacccctgtctcttgaactgtgatcatgccactgcactccagtctgggcaacagagtgagaacctgtttc

SEQ ID NO: 586082 - DNA, 145 bp, Homo sapiens
tctagaggatccgatcctcctcctcctacccacagctgtgccagatctgcaaaagctgcatctgcagttggtctctaactcttcccagccatctcccggtattttttgggtaccttgattccttgactcttaataaggccaagcc

SEQ ID NO: 586083 - DNA, 205 bp, Homo sapiens
tcatcttgaacaaagaaaagggccaggtgtgatgtttcccctcctggccctcatcttgaacaaagaaaagggccaggtgtgatgtttcccctcctggacctcatcttgaacaaagaaagggccaggaggggaaaatacactgactaacctgtctggaggtagatggatctgtgaggctcttttgtccatctctacctgctcctga

SEQ ID NO: 586084 - DNA, 156 bp, Homo sapiens
taatcagctcttacctctacctcgcgggtcctgtagccccatgctaatttgaggctgaggtgggagaatggcgttaaccccaggaggtgcagcttgcagtgaactgagattgcaccactgcactccagcctgggcgacagagcgagactgcgtctc

SEQ ID NO: 586085 - DNA, 988 bp, Homo sapiens
  misc_feature (350)..(350): n is a, c, g, or t
gctctatcgtcatgctgatgatggcgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgngcaccagctcgaagctggagcactttgtgtctatcctgctgaagtgcttcgactcgccctggaccacgagggccctgtcggagacagtggtgtgatgtgatgatgctgaccccgaatgctctggccttatcacgtcaacgtattgaacttgtggtcctatgtgagcaagagaatgttcatctgactctgttcatgttgattggaccgattgtgatgtgccatcgctgttgcgccagtgcgttgcatgctgtgaccaatggtcagctgtgcagcttctgagggcatgtggttactctggttgtgatcctgcctcatgatgcacctgtgtgccctgtttgcctttgtgcacccactacgaaaaccgtgaatgctggggttgtgggaaccgcaccataaattggcctaacatgcgcacgcgctcgtctctggagcgaagcgtgtgacacgacatgttctctcctgttgacccctctaatattgcttggcggaatggcggacctgctgttgtggtggacccaaccttcattgattggcttaagcccccttggcgccaattccgattttaacctaagtttttggccctggggtggccgattggcaaacacccggaaatattttcccagaagtttccaacaaag

SEQ ID NO: 586086 - DNA, 625 bp, Homo sapiens
tattttttttcgccgtatcacgccggttccggggggaaacgcggtttcccggccctttacggcggtttaacgcccgcgcgccctgtgttttgttaataccgacccccctaatattggcgcgcttttcctttcctcccactcggaagagctcgatgcgcccccggaagtctcctgtgccgagggtaccggcgcccgccaatactttttggttttagccatacccttaataccgagtttactccctctgccggtgaccccgaacaataatccccccgggaatctgtgccccctttcgggcccgggtaattgtctttctcttaaggaaggtgctttattatacaatggcaaaaatggttaacacacaagtgcgtgccacatattcttcggcgatgtatatcaacccctcatccaataataatgtggttcgtgctcgttcaatccaccccccacctacccccgggctttataacaacaatggggagtgatattcactttctgaggctcttctaacatgattattgatgatctgagattatattatgtggcaaggagagcaccgtctttttttaaaaaaaacattccatttgggttttttaaaaaaaaaaccctttaacccccaaaaaaa

SEQ ID NO: 586087 - DNA, 749 bp, Homo sapiens
  misc_feature (19)..(19): n is a, c, g, or t
  misc_feature (70)..(70): n is a, c, g, or t
  misc_feature (109)..(109): n is a, c, g, or t
  misc_feature (119)..(119): n is a, c, g, or t
  misc_feature (130)..(130): n is a, c, g, or t
  misc_feature (133)..(133): n is a, c, g, or t
  misc_feature (149)..(149): n is a, c, g, or t
  misc_feature (178)..(178): n is a, c, g, or t
  misc_feature (187)..(187): n is a, c, g, or t
  misc_feature (195)..(195): n is a, c, g, or t
  misc_feature (201)..(201): n is a, c, g, or t
  misc_feature (204)..(204): n is a, c, g, or t
  misc_feature (217)..(217): n is a, c, g, or t
  misc_feature (219)..(219): n is a, c, g, or t
  misc_feature (221)..(221): n is a, c, g, or t
  misc_feature (225)..(225): n is a, c, g, or t
  misc_feature (227)..(228): n is a, c, g, or t
  misc_feature (235)..(235): n is a, c, g, or t
  misc_feature (237)..(237): n is a, c, g, or t
  misc_feature (242)..(242): n is a, c, g, or t
  misc_feature (249)..(249): n is a, c, g, or t
  misc_feature (257)..(257): n is a, c, g, or t
  misc_feature (263)..(267): n is a, c, g, or t
  misc_feature (269)..(269): n is a, c, g, or t
  misc_feature (281)..(282): n is a, c, g, or t
  misc_feature (284)..(284): n is a, c, g, or t
  misc_feature (290)..(290): n is a, c, g, or t
  misc_feature (292)..(292): n is a, c, g, or t
  misc_feature (313)..(313): n is a, c, g, or t
  misc_feature (323)..(323): n is a, c, g, or t
  misc_feature (327)..(328): n is a, c, g, or t
  misc_feature (330)..(331): n is a, c, g, or t
  misc_feature (334)..(334): n is a, c, g, or t
  misc_feature (338)..(338): n is a, c, g, or t
  misc_feature (353)..(353): n is a, c, g, or t
  misc_feature (362)..(363): n is a, c, g, or t
  misc_feature (365)..(365): n is a, c, g, or t
  misc_feature (379)..(379): n is a, c, g, or t
  misc_feature (381)..(381): n is a, c, g, or t
  misc_feature (383)..(383): n is a, c, g, or t
  misc_feature (389)..(390): n is a, c, g, or t
  misc_feature (435)..(436): n is a, c, g, or t
  misc_feature (465)..(465): n is a, c, g, or t
  misc_feature (476)..(476): n is a, c, g, or t
  misc_feature (488)..(488): n is a, c, g, or t
  misc_feature (503)..(503): n is a, c, g, or t
  misc_feature (508)..(508): n is a, c, g, or t
  misc_feature (510)..(510): n is a, c, g, or t
  misc_feature (588)..(588): n is a, c, g, or t
  misc_feature (743)..(743): n is a, c, g, or t
aacaaaaaaacaggctggntaccggtccggtaaatacccgggtaaataagaacatactatccatttaaanagcaaaaaaatcttaatgcaataaaaaaaatgtgtacanacattcatangcaatttaganaanagcagtaataacaaanaaggatgtacgaaaacgtcggcaggttcnaaaaaaacnagtaaaantaatanaanaggagtataaaanananaaananncaataananaattngtagaangtataaangtaaannnnnantttaaaggggcnnanaaaaancngagggaatgtaaataagtacntgtaaataantacnncnnggnggcntgtattgaggatttnattgaaaanncncgtatctacaaatntnanaatatnngtagcatccaccagtatataagcattaacatgtaggcagaaaaanngaacatgaatacagaagaagcagaaaggnggattgtaaanatgattagaaangcaagaatggatgcnaagantnaatctaaataaggtaatgtggttatgggtaacaatgcagtatcacccaataagcaagtaaataaaaagaccaaaagcntttactttagaagcaagaagtaggccatgaatatagagaagaaactaaatcagaatagcaggtcagaggctcctaactgggcaactcaagattctggcttctactgaagaaccataaagaaaagatgaaaaaaaaaactatcaaagaaagatganataata

SEQ ID NO: 586088 - DNA, 619 bp, Homo sapiens
  misc_feature (350)..(350): n is a, c, g, or t
gctctatcgtcatgctgatgatggcgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgngcaccagctcgaagctggagcactttgtgtctatcctgctgaagtgcttcgactcgccctggaccacgagggccctgtcggagacagtggtggaggagagcgagcccgagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggg

SEQ ID NO: 586089 - DNA, 1958 bp, Homo sapiens
cgatctgaatccacacagagtctgaggtatcttggaaaccctctccttccctcttggatgtgtggactgtcagacattgtgaagaggagaagaggaagaggaaagacgctgcccccagtatgcagacagagagcaccccgttccagagaggccagcgctccaggagtgacagctgctaatgcccttcttccttcagtctccctgccccagctaccctctccctccctcctctccctccttccctttcttcccgcagcaaaacacacggagcccagtgatctgcaggcacagtgccgggccctagcgctccatgggcacaagtgacagctgtggccgaggtcggggagggtgctggactggaagccttgggaggctctgagcacacaggatttggggctgatactattgagggtcagaggctgctggactgggttgtaaagcatctgaggctttgaagaccatttggataattgggtgttgcaggctcagggtgagtttggggcttcctggagactttggggtacagagtagccccttcccaggccggctctctgcctgcctttggacctgggatgtttctgctgggaagcaagtggactggtgccttggagaggatgcctgtggggaggggctggactgctcacagggcctcctgatcctcgtttctcagtgtcactgatgttcaattctgaaagttctgcctttagagttatctcaacagcccaatgtgcctccttcctggcatggttgtccaggggcagacacccttctggggttggcctgtttgggagaagcctgagatctgcagagaagtctgccaggcggcctgggactaaaagctgcagaaggtggggcatgaggaagcagtgggcaggcagaaggagtgggcaggtggtctgctgctgcctcggggatgcagcttgagctggactttctgcctggctccgtcttgtcaccgagttcgcagcataaacgtcatccctcagagacgctgactcgatctctaataaaagctatcagcctgtccccctttactacgagacccctcttagctctgcagagcatccatcacagttaggcatttttgcctttttttccatccacccacgcttcccaccccaccaggacgtgagcttggacttcatcttgtcatcccagcagcaaggagtcgattttgcaggatggatggaaaacacagagaggaccagctgtttcatttctaggcacctcacttctaacctggaaccggttccgagaggaaggaccaggaagacccatgtgtcgggaatggtggacagaaggagtgtgctcagctgccgccgagaagaccacacgctgggtgctgaaaagagggggggacctgctaggaaccatggccctgggctaagtcggggatgaaggcgggagctgctgtgctggactgcagctcagcacagagacagtgagcctagattgcagagctgcccagggagggatgtcaccttgggggatggaggctgcaggtgctcctcagaccttagggaaacatttgggagggagcttgttgaggagatacaggcacctcagggtggctgggctggatggactttgatgacccttccttttttgagacctgatggttctctaatttgggaatcatttccaaagatgggtctaaaaatccttgtttcattggaaataatgagtttgctatgatgcttaagaccaagcatgtcaccatttgttattactgcacttttccctgccgttttcctttccttttatttttaatggatgatgttaggttgcaatgacattttgtttctatataaatatttaaaggtcttcataaacatataaatgtcttcatacatttttgtttgcttctagaacaatgtgtatcctactattgtatttttgctacagtatatgaacgtggaggtgtgcataagacagtaaaacactattcaccaaaagat

SEQ ID NO: 586090 - DNA, 632 bp, Homo sapiens
tacactgctcagcaacctagaagataccaagaagaagaaggaggatgccctaaatgagaccaggaatcagagacaaagctgaaggagctcccaggagatgtgcaatgatgatcatgcatggctctctgggaagagtgtgagccctgcctgtaaacagactgctgaagttactacgcacgcgtctggcgtaagtgggtcttagtgcctggttggctgccagcttgaggagttcctgaagcagagctctgcccttctacttctggatgaatggtgagcgcatcagactccctgctggagaacgatcggcagcagacgcacatgctggatgtcatgcaggaccagttcagccgcgcgtccaagcatcatagacgagctcttccaggaccaggttcttcacccgggagccccaggataacctaccaatacctgacccttcatgaactgcacgcaccggaggtccacaattcttctgtcccaagattctgaatcgtccgcaggttgcatgccctatctcatcggtacgagccacctgaacttgcaggcatgttgtgagcacctttcccttgagatgatacacgatggctacaggaagtgacatgtaaatacaacattacaaaagaaccgtacaataa

SEQ ID NO: 586091 - DNA, 233 bp, Homo sapiens
gtaggtctacaagacgctacttcccctatcatagaaagagcttatcacctttcatgatcacgccctcaataatcatttaccttaatctgctacctatgtcctgtaatgcccttattcctaaaacctcacaacacaaactatactattactaacaatctcagcacgctcatggaaatagaaacctgtctgaactattcctgcccgccaatcatacctatgtcctcatctgccct

SEQ ID NO: 586092 - DNA, 746 bp, Homo sapiens
ccgatggcgcatgcctgaattaggagagattggacataatctagcaattaccggcatcaagatggactgcttggtcaaggacatgatgagcaagatactcttggagctctgtagctggtcactgactaagaaggaattagcgaccattgctagcattatagaagactctataaaacttgcgcgactattgatactgcgagagcagacatagacacgagtctttaggttgaatgagatcataatatcacgttgatagaggcgtcaacagtgtacacgtgctactaggtgacaaaggatgagagaggagttcgtatactttgctagagatgaacatggtcatggtgtactattgttttggacgcaaagacatcttcagattacatgagtcgccgttcctcacatgaggacatttgagcgtagtcaggacctcatctgtatctgtagatgtacggaattaagaatgtaataaatagtagtagactattcgtttctacaattagggcttacaatagctaatcatagctgtcatgctacaggagcttcaggattgaccttatcgactactagggaagtgatcatgaagtttaaatatgtcatggtcatactaggaagacttgccaataagtctactttacaccctaggttttgtctagcaactcgatgacatcagtgtcgactactaggttgatgaacgacattcttttagaccgcaaccaagggcctcgtcagttgcggaccacaagctc

SEQ ID NO: 586093 - DNA, 681 bp, Homo sapiens
tcggatccgagcgcggggaggcagaccgactgtgaggctgcttgtccccatcctgcggcgtcctggggacacagagccctccgtggtgcccggggatggattggagccaggactcacttcctcctctgtcccctgcccctggcccctcccagcacctggagcacacgctgcaggccgcccgcatggtctggcgcctgggtggcgatgtgcgtccagagtgggggtcccctacatatggcctgagagtccagatgctgcacatatggacgtccatggaggagcagtcacttactgaatggacgcggtctgcgacggacatgcacaaccaacatcgatcacacgacgaagagagagatagccaaaacaggagaggagtaatagcgatcctgccccccagaaacaacatgaagcggggtcgcaagctgggcagatggacggaacacccaacaaactccgcgggactagaccaaccaaaggagcgaacatcacattaggccaaagggacaccatgagagatgcacaatataggaaagcacgggaacagcaggaacggacaagaagagaagacagaaccagagaagggaaaagccggcagggagcaacacaaaaagcacaaacagggagactgaagaaacaaacaggaaccgggaaacgaatacaaagaaccaacgggaacaatgc

SEQ ID NO: 586094 - DNA, 930 bp, Homo sapiens
tgcgttgtgtgtgggtgagcgtgattactcctgtgcgttacatctgtttgttccttgctgttgtgtgcctctctctgcgtccttggaccccgtgtttacccataggttcccccttccgtcgctctttgtgggacccccatttttttcaccctataggttcgttccgcccgcacatatccggggttcccccttccccgcgaactcggggcccccgcgcgccacgcaaagtggctttcaatctgccccttcttgtgtcttctccgcgacagctgtggccaacgccgcatgcggcgtgcccgggacacccttggttacaggtggcttttacgtgtcctgtgcgccctcgggcattccccgtcctcccccccgacggggtgttcacccgggcagccgcctcggtcttttctaattacgggcctgcccgccccaacatgctcgggtagcttctcgccccggccctgtccctttccgttagatatcttttttattgatcgcggtgtgaacagtccgtcaaaaacccacaaggggtgggcaaccatctttagaaatgcgttgccgtggcccccgctggcctccccagagaggttttgtcgcaccaccgggcaggctctcctcgccactcttccagccaacatattaatcaatcttcacgccggtcacggcgaagtaacaagacttgccctctctctggtacgaaaaaatcggggggtgagaacaataggaggggtgtggtcccgccctctacatattcttaggtcagacccgcacctgtggccgccacagtgtccgcactccccgagcccatatcgccgctttttacagcagcatgccccctttgtttttgtctccaacgaggtgtttaacgagtacgaaaacgccccctcttttttaaaaaagccaaaacaaaagagtttaacaacccacaaaaca

SEQ ID NO: 586095 - DNA, 164 bp, Homo sapiens
gaaatcagtggtgaccggatggcaaaatgcattgatccaagctgatagctcctgtgtctggggaaccacacccagcgacccgaatgttaactggatctggagaccgtgcgttgtacaggtggcctcttgttgacactgtacatgcagatatgtcttcggacaga

SEQ ID NO: 586096 - DNA, 205 bp, Homo sapiens
ccggttggggaggggggttggcccccccccccacccaaaaaaggctttttccttttcccggggtaattgggggggggggggggaagccccccccccccgggttttttcggttgcccggggggttttggggggggcccccttttttttttttcccgggcccccgggtgggattttaggcccccccccttccttggggcccccccca

SEQ ID NO: 586097 - DNA, 469 bp, Homo sapiens
  misc_feature (218)..(218): n is a, c, g, or t
  misc_feature (382)..(382): n is a, c, g, or t
gttatcccgattttactaatgaggaaactgaggttcagtggcaataaccaataaggagaaggtgctaaggagagtgtcctaaggcaggccctctaattccatgtctcctgacctgtccgccacctcctaggccttctctaggctttgccgtctctgcatgcccctgcctaggctgagtctccaatgtctgttccagctctgccaacagctggctgcantggccttagctacatcccacgttctctctgggcctcagtttcttcatttgcaaatggtgatattaggttgatgcaaaagtaattgtgggtttttgcccattaaagtaggggcaaaaaccgcaattacttttgcatcaacctatatatctatataggtgccctcntatcaactgatgggaagaatcaaatggctttgcagattctgacatgctctaccaattcttgggggctgccaggtattaccttcacaa

SEQ ID NO: 586098 - DNA, 401 bp, Homo sapiens
  misc_feature (401)..(401): n is a, c, g, or t
ctcgtgtgcacatggagtcaatggggctcttctactcgagtgcacgatacattctgctatcctagtcatgtcctttacccgcattgattacgacaagggcgtgaacacctgtctttccgaaggaagagcatatgaaggctaatatgccattgaggctatcaagcttgaatctacagccaaggcgattgacacatcagaggcattacgagtacttgacatgaggagactaactttctgactgcctgaaccgagaagcattgagacaatcgtataccatgatgatgacatatgttgagcacttagactgctcaatgctgaagctgataatttactagtctgagcccgagtgcagacacagccactgacttaccgacattgggacacagacagtggacgtgccn

SEQ ID NO: 586099 - DNA, 339 bp, Homo sapiens
  misc_feature (188)..(188): n is a, c, g, or t
  misc_feature (197)..(197): n is a, c, g, or t
  misc_feature (256)..(256): n is a, c, g, or t
  misc_feature (308)..(308): n is a, c, g, or t
ggtgaagtcaagatgaagaaccatttgcttttctggggagtcctggcggtttttattaaggctgttcatgtgaaagcccaagaaggtgaaaggattgttcttgttgacaacaaatgtaaggttgccccgattacttccaggatcatccgttctttccgaagatcctaatgaggacattgtggagaganacatacgcnattattgttcctctgtaacaacagggagaatatctctgatcccacctcaccatttaganccagattttgtgtaccatttgtcttaccctgtaaaaaatgttatcctacagnaggggggctggagtatcagaagtttctgtta

SEQ ID NO: 586100 - DNA, 544 bp, Homo sapiens
  misc_feature (277)..(277): n is a, c, g, or t
  misc_feature (338)..(338): n is a, c, g, or t
  misc_feature (426)..(426): n is a, c, g, or t
ggatatgatttagggcaagttgcttgacgctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccaggntgggatggtggggagataagaaccgtgagagaagttggcacaaaggagttatgggacaaanggtccaagataggcagaaaagaaaatgttgccagttgatggggaagaaaggaagtcggagggctcagacactgagggggacagaacanctccatgtgcagtctcatctcttatagtcagcaacaggtatacacggggagggccctacatcatctgctacccttaatgatctggaggtcggaagctctgagcggaggttcagttaac

SEQ ID NO: 586101 - DNA, 259 bp, Homo sapiens
  misc_feature (20)..(20): n is a, c, g, or t
  misc_feature (28)..(28): n is a, c, g, or t
  misc_feature (31)..(31): n is a, c, g, or t
  misc_feature (40)..(41): n is a, c, g, or t
  misc_feature (46)..(46): n is a, c, g, or t
  misc_feature (65)..(65): n is a, c, g, or t
  misc_feature (86)..(86): n is a, c, g, or t
  misc_feature (91)..(91): n is a, c, g, or t
  misc_feature (106)..(106): n is a, c, g, or t
  misc_feature (108)..(108): n is a, c, g, or t
  misc_feature (111)..(111): n is a, c, g, or t
  misc_feature (123)..(123): n is a, c, g, or t
  misc_feature (128)..(128): n is a, c, g, or t
  misc_feature (136)..(136): n is a, c, g, or t
  misc_feature (150)..(150): n is a, c, g, or t
  misc_feature (177)..(178): n is a, c, g, or t
  misc_feature (190)..(190): n is a, c, g, or t
  misc_feature (202)..(202): n is a, c, g, or t
  misc_feature (217)..(217): n is a, c, g, or t
  misc_feature (242)..(243): n is a, c, g, or t
  misc_feature (249)..(249): n is a, c, g, or t
ttttccagccctagctcttntttagttnagntaagtacannacagntcttttcacaagtgttttnttttagcagcagcagtagagncttanttgagcccatagtgngncanctagcagagctnatagncagcatantaagtagtgggagncccagctttttttcctctcccacaaannccaggtagtgangttatattaccngttacagcaaaagantttgtgtttcacaagcaacaataanngtagantctttatact

SEQ ID NO: 586102 - DNA, 422 bp, Homo sapiens
  misc_feature (57)..(57): n is a, c, g, or t
cctgcgacagagatgggcttgaaccagaaggagcagccggctttctttttttcctgncgattggggagcagctcactgaacggctgttgttctctccaccagcacggccacaaagtcaggccagggggttgcaaatgtgggtactttccgtgagaactcataagggtagttgggatttcctgatctgatgaagtgggaaaagtactgcatgattttcagcgacaggctcttctcctccagagaaaactgcccctcgtaggctgggtagaagggaagccccaaggcaaactgaacatccgccagcagctccaggctgccatggccgtagttttcaggagcatggtacatgaagacgtttcctcgggccctctttgcccaggcactggccatgtcgattatagggcagatgataaagtagtccc

SEQ ID NO: 586103 - DNA, 1216 bp, Homo sapiens
tgccccgacccgccctccacctgtctgtggttggttattaatccgctcttgttgaccaccccgagctgtgtgttcgccccgcctttgtttatgatatactatatcatactatatataaaaagtgggttagaaagccgcctggggggcccacggccttaatgttatgggagtactatgcgccacccccattatgatgtgggtgtcgcccacacagtgttgtttgtgaagtcttttatgatatctaatatatgtggcgccctttacactcttgtgttttttctaaagatggatgattatatattcttttggtttaatgaggtttagatcgtcccaccaacgcccacggcggtgttgtttttaggaagaaagtttgagagaaaattggtgtttggtatgaacccaacgtgtgtttccaccccccacggttggggttttggggggagtatttccctctggggtccactttataaaggggcttgtgtgtggttaaattttttatagaaggtccccccgctgtggggctttttttttttcttcctgagaccttgagcacacctcgtgggtgttctcacacatatggttatggtataaagagattggcctatattgggcggcgcacatgtttatttagcgccccgtctggcgcacaaaaaaggtccctccacgtttgctagaccagcacacatgggttatacaccgctctctatgcctgagatataatccacacacacacctcataactcgggggagatttttatatttatataaaggggcgttctatagagaaaaacagcgagagtttatattcaccacccacgcactcacttcttataactaaccactctctcgaaactaagttaagtggcacgctttttcactttgtggttgttgtgggttgggttcttcacaaaactaaggttggaagtttttctcctctgctgagggagaaccacgtatccgaaagttcttttttcttgtggcacatttgtaattaatataaaaacttggtgtgggggagaggaggcacccaaaactccacgcccacctgaacctctgcccacttaagatggtgttgggttaggttacactctgggtactgtcctggggaaatcactttttaattgagatggccttcccagtggttttaaaatttactgaagtttttaggtccattatgtatgttgactaaatttaccaaataaacttgtttatccca

SEQ ID NO: 586104 - DNA, 1034 bp, Homo sapiens
ttgctcttttctgttcttcctgtgttcgtgtctccctctcttcgttattttcttccttcttcgtgtttcctctcgtctgcttggctgtcgtcttttgttttgtgcatctcctcccacggtgttcggctgtgttgctgtgcagtccgctttgtgtctcttcgccttcgtcaccctcgcctgtactttgttctgtgccccagtgccagttgcgcgggggcacgtgcaccttgacttgggtccggggttcctggttcacccccatcccagtgccttggctgggcttcgttcgccagttcggtgccgcgatgggtcgtgtcatagggcatttcctgtctcggcgtgggcgtggtctgacctggaagcgcggccggtgtgggtttcatttccctttgcccggccccgcttcactcctggtcgtcggccgtcaggcctgcgcctaccttggcacctcccagccgtgcgcagtcccatccctttgtgtcggcctctcgtgagctctcccgcggccacccagcaggtggcggacttccagaggcatgggaggaggcgttgctctgacaagttaatgtgctctacatgactcggatccagtaggaacgatttggctctacccaggagtacgaagcttgctttggtcagcctcatcctcactccccacatcatgacccgggccacagaagaatatggtggtgattgcacccgatgcccccgtgtcaacgacgataagcgtggaagtggatctcggatccccgcgcagcctacttccgaccaggctgagatcggctatgtacatccgcactggctctgttagccaccgtgctgggccgtctctagcggctctggcttcctcagcctcttctctttaggccctgctgactgggccaaggaatgcccgtggtcctcctatcgggggcagcacacttagatattcctggacatccagatagctcacatgtgctgtaccacaccattcaggctcgtggacctggagctctctggcatgggggtggggcctcagatgctgggcccagtcg

SEQ ID NO: 586105 - DNA, 411 bp, Homo sapiens
ccccctggggcccccccccttttcaagggggttttcaaggggccgtttccccccccgttcttttgggggggccctaaaaggaaagaaagggtttttccccccaggccaaaggtccttttggggggggggggtggccccggccaaaattaaggatgggccggggtttcttttaaaacccccccaaaattgttcccccccccttttttggggtcccggaggcccctataacattttgtggggggggggtggtggcccccacttttttgggcctttggggttccccttcccaataaaccggtagggcccttcgggccgggggttgatttttcccggttttgtttggcccctgttttgccccccctcccgcttgggggcaggagggcgggggcccattaaatttttttggcttga

SEQ ID NO: 586106 - DNA, 387 bp, Homo sapiens
  misc_feature (308)..(308): n is a, c, g, or t
  misc_feature (311)..(311): n is a, c, g, or t
cgccagcacagcagcgggatgtcttttgatttgcttctgttatttgcatgtctctcttgtgatgtctgtgaaatgtttagaatgacaaagtttttaaaagacctgctgactccgcctgaaaaatgtgaaaaacctcccatttagagacctattatgtccagctagcctgcattttctatatctttttctttattttttattaatgcaaacatttgcatgaagacagaacctttgtttcttaaagagttcatctgctcctgctgcttactgccctgccatgcaagagcacaacagaacctttgttaggnttnagcaaagctgtttatgaacggtggcttactgaggactgcttcctgtgctgtgtgcttccattttgtctaaaaagga

SEQ ID NO: 586107 - DNA, 1308 bp, Homo sapiens
  misc_feature (635)..(635): n is a, c, g, or t
cagctacttgggaggcaaagtgggaggattgcttgagcctgagagattgaggcttcagtgcagtttgagccactgcacacactccagcctgggtgacagtgagaccctgtcttaaaaaaataagagtatgacatgagcatgtgagagcaaaagaaaacaaggaagtctgcgaccatgaagcgaatgcttagtctctgatatcacaggcttaaagaaaatgataaagacctaaaaagaaaagaaatatcccagcatgctgaaggaaagaaaagttccccaatacccttcctgcttatttttccaatatattacacagctgggtccaccttaccacgtcctgtttgattccagcgttaccaacttttctattggagccaaataagacatactgcaatcagtgatgaactgtctatatgccaagtgtatcccttgtgtaactgtgtaatggctgaaactgagaaattggggcgaagtatcaagtggcttaaaggattgccaaggatccaaaatttgaacgattaccaaattaccacgcacaggaaggaatctatgcagatgactgcttagcacagagagttactcagcataagtgttgtagccacgaacctgggaccttaaaagaagaatcctaagantcttggagttctatcatgtacatttctaaccatagatacaacatgggaactgatgtcagatgattatggagccccttggttctaattcttgcccaagttcctctgcctttcttccaccaactttctcttgttgccagttcattaaacatggaatagaatgttattctgttcaattcatttgccctgttatcagctgaatatggttaaacacactcaatttttcatgctgttttgaaattgatattttgttgcatttaaaaaatttaaatgatggtcaaagggtacaaaatctccgacaggaagaatccattttataatttttttgaggtctgttgcacagtgtggtgaatatagttagtagagtattatacatttcaaaattgctaagagtaaatttcaaatgttctcactacaaaatgctaagtatttgaagtgatggatatgttaactagctcgatttaattattctacattgtatccacagattatgacatcattttgtaacccataaatttatacaattataaattgtcatttacagtaagaaataatttgttgcatctttttagaaaaataaaataattttttacatctgtgtacgtcacggttacaaaacattttttcatttttacataattccctcacaaaaagggggggcaaatcccgaggccgt

SEQ ID NO: 586108 - DNA, 658 bp, Homo sapiens
gccgaataggaacagctccggtctacagctcccagcgtgagcgacgcagaagacgggtgatttctgcatttccatctgagaccagtgaccttttctatttcatagtaaacaaacttcagtgagtactgtgccggagtctagggatagcgaagtgcacatacaaaaatcaagagccaaagggttgatgacggcgtggtggcatgcatgtgaaaattatacagacccatagttactggatgtcagaagaaaaccagaacaccgagtcatcacgcctgaacacccattggggcaagctaacgaattcacagaaggcctttattcctgggagtataccaaatacctggcttacgcagccactttttcatattgacgatactttctgtgtcttttcacgaccaggggacacatcctcggactcgggggaatcccaacacacaggttgtgactacttaagccgtggactaatgtgtccttcttcatacaaagagcgtgtccttccccaatcattcactttgggtaggcccagtattttgtgaacaccaatgtggggtgaagggggcctttcagcctttccattttccaagcctggctaaaggtccccgtgccccaaagcaaggttcttgttggtaacccacgcaacattataccaattccttca

SEQ ID NO: 586109 - DNA, 284 bp, Homo sapiens
cccgtacggtgggatatgcaggcacccacagttagcagaggggtcaggctcgctgacagcaatggaacaagaaaaaggccatggaggacctaactgggataacaaacaggaagggaggacagaggtggcactgcacccccaacaagcctgctgctgcccacgccacatggatcagtgaaccacggcccgaagggaacccagagccacactaactgctcagcgtttgaagtgcagtagttcagatgggctctaagcatgaaagactcaccaggtttcaaatctta

SEQ ID NO: 586110 - DNA, 630 bp, Homo sapiens
  misc_feature (18)..(18): n is a, c, g, or t
  misc_feature (104)..(104): n is a, c, g, or t
  misc_feature (130)..(130): n is a, c, g, or t
  misc_feature (151)..(152): n is a, c, g, or t
  misc_feature (156)..(156): n is a, c, g, or t
  misc_feature (178)..(178): n is a, c, g, or t
  misc_feature (194)..(194): n is a, c, g, or t
  misc_feature (201)..(201): n is a, c, g, or t
  misc_feature (203)..(204): n is a, c, g, or t
  misc_feature (206)..(206): n is a, c, g, or t
  misc_feature (208)..(210): n is a, c, g, or t
  misc_feature (283)..(283): n is a, c, g, or t
  misc_feature (335)..(335): n is a, c, g, or t
  misc_feature (344)..(344): n is a, c, g, or t
  misc_feature (347)..(347): n is a, c, g, or t
  misc_feature (353)..(353): n is a, c, g, or t
  misc_feature (414)..(414): n is a, c, g, or t
  misc_feature (437)..(437): n is a, c, g, or t
  misc_feature (459)..(459): n is a, c, g, or t
  misc_feature (565)..(565): n is a, c, g, or t
  misc_feature (583)..(583): n is a, c, g, or t
acctagcgagctgctgtncaaagagtccctatgctattaacaagtgggaattacatcatttaaaaagcctgattattccaggcttctgaatctttcgatataanactgcctttgttttgctgctttgttnaactgagaggcccaggaaagnngggngggtccctgattagggtcaggnggccacctcagaagcncaggccnannantnnncaagcacatgtcagggctcagaacaaggccttaaccaagaggcgttgatggcctccagtcaagaaactgtggntcatggtagtagagctctctcttcttccagcaggcgccatgcaagggcaggntaaaagacntcnagtgtntcaacatccatctatgagagagaaaaggggcactgaagcagctatgtctgccaggggctangggctccttccagacagcaatgntacaataaaggacacagaaatnggggaggtgggggagccctatttttataacaaagtcaaacagatctgtgcgttcattcccccagacacacaagtagaaaaaaaccaatgctgtggtttctgccaanatggaatattcctcctcntagttccacacatggcgtttgcaatgctcgaaaagcattgcactggg

SEQ ID NO: 586111 - DNA, 350 bp, Homo sapiens
  misc_feature (16)..(16): n is a, c, g, or t
catagaggatccccgntctagacgctgaactatgtgctatgcttttcatctgccttccatacaacagtgcaagacaaaccccagctccccgaccctgaaattttacaatttctagtttttcacacagttataaggctttactgtaatcatataaaatgtgtagtccccagtctaacaaagtgacctcctatagggacactttaagagagacaacagaagtacacgggagaataactactcagttgcacaaactcttacaatcacgtggcactagtaagaaaccatgttcttagcaaaatcaagcttttcttcaggctgagtgtgtgcacacacatagttcagcgtctgac

SEQ ID NO: 586112 - DNA, 1157 bp, Homo sapiens
  misc_feature (635)..(635): n is a, c, g, or t
cagctacttgggaggcaaagtgggaggattgcttgagcctgagagattgaggcttcagtgcagtttgagccactgcacacactccagcctgggtgacagtgagaccctgtcttaaaaaaataagagtatgacatgagcatgtgagagcaaaagaaaacaaggaagtctgcgaccatgaagcgaatgcttagtctctgatatcacaggcttaaagaaaatgataaagacctaaaaagaaaagaaatatcccagcatgctgaaggaaagaaaagttccccaatacccttcctgcttatttttccaatatattacacagctgggtccaccttaccacgtcctgtttgattccagcgttaccaacttttctattggagccaaataagacatactgcaatcagtgatgaactgtctatatgccaagtgtatcccttgtgtaactgtgtaatggctgaaactgagaaattggggcgaagtatcaagtggcttaaaggattgccaaggatccaaaatttgaacgattaccaaattaccacgcacaggaaggaatctatgcagatgactgcttagcacagagagttactcagcataagtgttgtagccacgaacctgggaccttaaaagaagaatcctaagantcttggagttctatcatgtacatttctaaccatagatacaacatgggaactgatgtcagatgattatggagccccttggttctaattcttgcccaagttcctctgcctttcttccaccaactttctcttgttgccagttcattaaacatggaatagaatgttattctgttcaattcatttgccctgttatcagctgaatatggttaaacacactcaatttaaggcgcgttaaaattggattttgtggctttaaaaaattaatgtagggcagaggtcccaaaattcgcacggaaaatctctttatactttttagaggtgttgacaagtggggaaataagtgggtaggttatccctcaaaaatgctatagtaaattcaaaggtctacttcaaaagtaggatttgaagggatggtttctaactagctcgcttattatttaactggttccacgatttgcatcattggaaccaaaattatccaatttaaaggctttcacgagaataattgtggtctttttaaaaaaa

SEQ ID NO: 586113 - DNA, 274 bp, Homo sapiens
  misc_feature (238)..(238): n is a, c, g, or t
  misc_feature (248)..(248): n is a, c, g, or t
atgcctgcagccaccgtgcagacccccatcaagcctggaagaggctgcaccctgtcctcaggacctcacagtgtgagtggggtctcctctgtccctgacccctcgctgttctcaggacttcacagtgtgggtggggtctcccctgtccctgacctctcactgtcagcaagtccttgcaatatcaggtgaggccttttgtgtcacttgaccattccttgtccactggaacttcaaaacnaacatgatanacaagtagtaaggatttaggaacttt

SEQ ID NO: 586114 - DNA, 1255 bp, Homo sapiens
cagctacttgggaggcaaagtgggaggattgcttgagcctgagagattgaggcttcagtgcagtttgagccactgcacacactccagcctgggtgacagtgagaccctgtcttaaaaaaataagagtatgacatgagcatgtgagagcaaaagaaaacaaggaagtctgcgaccatgaagcgaatgcttagtctctgatatcacaggcttaaagaaaatgataaagacctaaaaagaaaagaaatatcccagcatgctgaaggaaagaaaagttccccaatacccttcctgcttatttttccaatatattacacagctgggtccaccttaccacgtcctgtttgattccagcgttaccaacttttctattggagccaaataagacatactgcaatcagtgatgaactgtctatatgccaagtgtatcccttgtgtaactgtgtaatggctgaaactgagaaattggggcgaagtatcaagtggcttaaaggattgccaaggatccaaaatttgaacgattaccaaattaccacgcacaggaaggaatctatgcagatgactgcttagcacagagagttactcagcataagtgttgtagccacgaacctgggaccttgatacaacatgggaactgatgtcagatgattatggagccccttggttctaattcttgcccaagttcctctgcctttcttccaccaactttctcttgttgccagttcattaaacatggaatagaatgttattctgttcaattcatttgccctgttatcagctgaatatggttaaacacactcaatttttcatgctgttttgaaattgatattttgttgcatttaaaaaatttaaatgatggtcaaagggtacaaaatctccgacaggaagaatccattttataatttttttgaggtctgttgcacagtgtggtgaatatagttagtagagtattatacatttcaaaattgctaagagtaaatttcaaatgttctcactacaaaatgctaagtatttgaagtgatggatatgttaactagctcgatttaattattctacattgtatccacagattatgacatcattttgtaacccataaatttatacaattataaattgtcatttacagtaagaaataatttgttgcatctttttagaaaaataaaataattttttacatctgtgtacgtcacggttacaaaacattttttcatttttacataattccctcacaaaaagggggggcaaatcccgaggccgt

SEQ ID NO: 586115 - DNA, 339 bp, Homo sapiens
atatcatggcgttattttatcttattagaagttagtattttgttatactaacttggatgcaaaggtttagtttcctttaacaatacactatgtgataggtttatgctaggtgttgaccagaaaataaatcatggtacttgctctcaaaagaacttgagccctgacatggtggtggctcatgcctgtaatcccagcactttgggaggccaaggcgggcggattacttgaggtcaggagttcgaaaccagcctggacaacatggtgaaacccccatctctactaaaaatacaaaaattagccgggcgtagtgacacatgtctataatcccagctatttggg

SEQ ID NO: 586116 - DNA, 132 bp, Homo sapiens
ctgtgctgtaattataatacgagtggcggcttcactcgggagtcctactcgatggtacaacgtcaaggagtcgcaggtcgcctggtactaagaataatgggggaagtaagtaggagttgaagattagcccga

SEQ ID NO: 586117 - DNA, 190 bp, Homo sapiens
catgcatcaccacgcctggctagtctttgtatttttagtaaagatggcgtttctccatgttggccaggctagtttcaaactcctggcctcaagtgatctgcttgccttgactcccaaagtgctgggattacaggcgtgagccactgcgcccagcctccaccaaaccatccttgaaaaatcccagctattc

SEQ ID NO: 586118 - DNA, 190 bp, Homo sapiens
  misc_feature (118)..(118): n is a, c, g, or t
tcgtactgtggtgtaccgtgtcttttttccataacgatctctgcacaatcactgggtcctgtaacttgacccccacactttccctaaactgtggaaccttcctttcatagtccttgcnacaggttcccaccatagaccctcaccacagagtcccaccatgaccctacgtaagactcacttttcctggcag

SEQ ID NO: 586119 - DNA, 113 bp, Homo sapiens
cactgttgctctgtggagacatgggtgtacctctaaacgcactgcgttgtaagcaaaggaatgacctgatttaatctgatcttttaaaagtcattctaggccaggccgagtgg

SEQ ID NO: 586120 - DNA, 106 bp, Homo sapiens
ggatctactgcgcagaagaagttggtccaccaacaacctggtcagaagaaggtcaataggttgtctttccttaaggcagcctcctgcctggcccgtggcccttgag

SEQ ID NO: 586121 - DNA, 954 bp, Homo sapiens
atcaaatggttcacacccgtgtttgacacgccgataccggttcgcctgttagtggcctcctaaagtgtgcgcccctcttgtggtcgcgggaccccgttttgaaccccgggcccctctttagacgcggccgtgctgtccggtcccccgcgcgttgccacttttttggggccacccccgggtacacctcatgggtcggttgacaacgcttggcgccgcctgttggccgactcgtgcacgtgtgtgtcaggccgccgcgtgggcgctctcattggggctgcttttgggcacaaatcctgttgaacagttgtggtagggacgttacaaacacggggggttcccgtgggggaatgattgaagtttctccgccgcccgaccccggtgtcctgtagtgaaagcagcgttattccggggcatatcattctctgccgcgaaagtagattagaacctgtctcatggcaaaatacgagtaggtctatacactctgttcgtgcacaagacatctgtgagaaatatccagtacgcttttgaggaaaatgattctctgccccccccccaggggtcccccccaacaacgaaattgcctttctctgaagcctccttattgggtcctgataggaccattgtgtcttattctctcgttcacgcacacgccggtcgtccttcttgggttctctgccttttccccgccaacccctgggggatttactcctgcgcccgactcacttcgctcaaaaaacccccgacttgggctctccgacggccgagaccccgcagaagacggaggaagtacgttgtattcctccacgcaggtgcgtcgtttaatacccgtttgactccacagagggagaacttacacaaaatgggtgggcccaaatatacgctgggaggacccaaagaggagtagccactgtgcggccccggaaaaattttttttcccaacccacaacaaaaaca

SEQ ID NO: 586122 - DNA, 138 bp, Homo sapiens
caaaacttccccaaaacttagtaacaaagaactgataaccacagaaaagtgttcgtgtcagacctttatgcttgatgatgttaaggtcagtttaccactgctcaaggccctctggctacacagttgcctagtttgtat

SEQ ID NO: 586123 - DNA, 256 bp, Homo sapiens
aagagacaagccaagaaacagaagacaaggcggacttgaggaggaaggggacagttgcagtctcacttgggacaggccacagccaggggtccggccactacccgcccgtgggataaaagccaaaagcatgcgttagtaaccttcagccttgtcttgcttggcccgaccccatgtcccttgtactgtggatcctgaccatcctacccctccgtagagccctcgtgcatgaatgaatggaccctcgtgtaattttgtg

SEQ ID NO: 586124 - DNA, 237 bp, Homo sapiens
  misc_feature (19)..(19): n is a, c, g, or t
  misc_feature (201)..(201): n is a, c, g, or t
  misc_feature (203)..(205): n is a, c, g, or t
  misc_feature (207)..(207): n is a, c, g, or t
cttgtgctagtttttgtgnggtgtttagaaacatgggcatttgtctggatcctaattacaaataagtaccctagaattctcttcagatagtgcactaacagcaatgaatctattctaaatttcaaatatccaaattaaaatgacttgtattagcataagtactgaaatggataatacaataaatgtattaatggaattganannntncatgatacagaaataaatgatagtaacgaa

SEQ ID NO: 586125 - DNA, 532 bp, Homo sapiens
ggtcggcatgtacccgatgtcgtccccgctgcacctcatcgtagcggtggcacagcgaaatagaattcgctgaaatacctgatactccgcttatcttgtggcgacgttttctagccgtatagcagtgtaacctcaggaaaggtactgcagaggactctatcagcacgtatgcggcgaacgagagcgggagaggtctccagattctttgtcaatgaggagaacactacctccaatagaagggactcttggcctttctgcttgtatactccccaattcagtctttccacgatgtactgagagacacctccaagagagtgtcttatctgaacaggcactcatgcagccagaggaaccaagattattggctagatgaaatgaccaaagacgcagcgctcgatacttcttcaactgtagaaagccttggagaaactacctgatatcttaaacatgacacacatcatgagcctgaattccactgccacgtcctttacacattatcaccagttcagacacaacaagaaacaacaaacaa

SEQ ID NO: 586126 - DNA, 467 bp, Homo sapiens
cgaggaaacaggcttcggctcaggcacccgggcctggagcaagccctggagaagacgaaagccaacctcatccaggcagtgacacgacgattctccaccgagtatgagctgcagcagtggttcacagaaaacagcaaatagtccccagcccttgaagtcacccggcccccatgcaaggtgcccacatgtgtccatcccagcggctggtgcagggcctccattcctggagcccgaggcaccagtgtcctcccctcaaggacaaagtctccaagcccacgttctctctgcctgtgagccaagtctagttcctgatgacccaggctgcctgagcacctcccagcccctgcccctcatgccaaccccgccctaggcctggcatggcacctgtcgcccagtgccctggggctggatctcagggaagcccagctccagggccagatgagcagaagctctcgatggacaatgaa

SEQ ID NO: 586127 - DNA, 1735 bp, Homo sapiens
  misc_feature (1310)..(1310): n is a, c, g, or t
  misc_feature (1547)..(1547): n is a, c, g, or t
gtacccctagaagccacaatgggaaaggagaagactcatgatcgaacattgtcgtcattgggacacgtgagattcgggcaaggtgctaccactactggccatctgatcgtagtaacagtgcggtggggatcgacgaaacagaaccagttgaaaagattcgagaaggaggtctgctgatgatgggaaagggcgtccttcgaagtatgcctggggtcgttggagtgagaatcgtcgaaaggctgaggcggtgaagccgtggtagtcacctattggatatcgtccttgtgccggaagagttctgagacctagcgaaagtactagtgtggacttatcaattttgatcgcgcccatggatcaccacgaaggacctcttcattccaaaataacaattgagtttaccaggggaaacaatgctactagggctcgtacctggtcgcccttgatgccctggaatttgtctgtcttagcctgggctcgattcagggttcgagaattctccgagacggccataggtggttagtccatattcgcacatggagatgggggcgaccaggtaccccgccgtatggcaggaccactaggcccgcattctactggagatcttaatcaccacgtccatctttgcgagttcgctagcgagagaatcacaaccgttacaccttggggctaccgcggcctggttctagaactcgaggaccattacttgcggggaattttgtcccctttcgttggagacgccgcctccacacagcgccttgagaaacacggagaccccaacggcagaggcgcaaagtcacttcaactttggacacggggggagaacagtatgggttattaaaaccgtggagaacaacggtctttccgagaaggcgagcatatccaccggagttttaataagagggggaccacaccaacattcaggggggcttttaacagagaaacacgggcgcccgagataaccacacgacacagcgtttcagctcaccaagctgtctgtaggagaatggtccctcgaaacagtctctgcacctgcggaaataacgcggtacaaaatgttgaggagtttgggccacccaaaacacacatgtcggccatggtgagccagtgaccagccagataagggatgagagcattatcaaccaactgtgcccccatatcagtaggaccatatcccagacagagggagggaactctggggcacaaacacatgtttgtccacgacacaccccgttgtcaaaaggtccgcacagttgatgtgcacaaaagacgccccgaagtgtgtggcacacaaccagcaacggactgtggcncctaggggaagaggcagccacatgacgcagaagaatgggcacattccacgataaacactagagccaaagaggtcggaactaccacagagggcaggaccgtacaaagcgaaacacgttcgggacgggacaaatggccccgcatgtgcacaccagagcggaaggtggcaccaaaccacacaacgaagcgaggtagggagtagcaatgcgggatgacacgagcgactacacccaggcgantggtgacgcgaacaactggtgacacgcacactgagggaggaggtgcctacaccaaataacgactcgcggacgaacgcgtgatgcaaggccacacacacgtggcggacatccgcgagcgaaaagagagagaagaacaagcgcgagaaggattaagaagacacggacgccgcaacgactgggcaccaagc

SEQ ID NO: 586128 - DNA, 727 bp, Homo sapiens
gaacccattctaatcgcaatggcatacctaatgcttagcggagcgaaaaattctaggctatatacaactacgcaaaggccccaagcgttgtagagcccctacgggctactacaacgcctgcgctggacgccagtaaagactcttcagccaaatgagccccgtaaaagcgccgctcgagcagtctagccaatcaccacctcgtacgatcagccggccccggagccattagtctctgcgaccactgcgcatcttctcactatgcaatcccctccttcccctgtactcctaactcgccgcgtgcgtcatacccttctagaaccatgaagtgccgtaccttgattatatatgcgttagccaacacatcgtgaggccttcagcactgactagcgtcaatactctcttcctggaatacaaggggcgtggtgcctactcaaagacttccaaaactgaacgaccgcatgaagacacggcgggggaacattggcagaaagccgagggtgaagagcggcgctataaagcccatggtgcgtcacatgattgcaagggtttcacgcctgagcgcaatcgaatgtgctaactaactcaactaggtaggtacctaaagatgcgcgccgtttaagcctctctgaccccgttatcgacagaggtgaaggagaccaccctctggatggacgtcctgactcagtcgatgcagccatcgcgggccatgacgtatggcaatggtatc

SEQ ID NO: 586129 - DNA, 387 bp, Homo sapiens
gatccacctatgagacaaagcaagacagagcgcgggccgcccgacgcatcatgtccacacatagttggctcacagggtgggttctgcatgtggaggaggctgacctggcatcagctggaactgtgtggcggcaaggctgtcctctaggaagcccaggaggttgccgatactgcccttctgcactgcaatggcacgagctgacaggctgtccccctgagccaggtaggacagcagtaccacagccatctcccggcacaccgggttctttcggtcactgaggaagcgcaccatagtgctatacaacttctccaggcggctgcaggggggtgtggccagaatcaggtccacattgttgtcctggatgctgagttcgctgcgggtttccaa

SEQ ID NO: 586130 - DNA, 845 bp, Homo sapiens
ggctgtacctcggttaacgggatcgtggacacgctggtggctgttctggagcgcgacacactgggcatacgtgaggtgcggcgtgttcaatgcctgttgtccgctgtgtcctgaggcctgagtgtcagcgtgcagcagctgcaggtgacgccagagaacaggcggaaggttctggtgcaaggccctggtgcctcattcgcattccctgctcatgaccatcgaggagttcgctgcagtgtccctgcacagtacgggacatcctggtggaccgcagaggtggtcagcctcttcctgcacttcaccgtcaaccccaagccacagagtggagttcatatgacctggccccgactgctgacctgcgatgggaatggagtgcaagcaatcaacctgcattccacgcacggttgtgaagacgtccgcatggtgtgcatacatgactgtggaccatggtgacctgcatcagggtatctacaggatcagacaacgcagcatcattcagctggatggcgactttgcggctcgtaatggcatccattcacactggtgacccaaccgacctaccaacgttgaacattccaagattacattcaacacccgatatgcaagcaaccgttctatggcgcccatgacaacgacgaactgaggcatatcaagacatcgcgggacacgagcatcgacgatcaaggcaacactaatccctgcagattcagtgttccacaaggtcggcctgcgtttggtatcgttgcttagtcccgaacacagcccacctaacacatgggccgattgatgcacaatagctcaaacgtggcacccaaggagactccaccactacctggaccccatga

SEQ ID NO: 586131 - DNA, 1112 bp, Homo sapiens
tttgttggttttgctccttcttttatctgttccgcttttgtcatgtgtggcgtgcttgtgtcgtcattctgggaatctgtgctgtgtcgggtgtgtgtgttaggcgtttttctctggttgtttcgtgtgttggttgttttgttctggtctttagcgtctgctttgtgtggtgtgctagctgcgtctgattgggatcgtttggtctgttgctagtcgttcgttgacttggtctgggcttcaatgtgtcatgtctcagttataagtgatgttggcacgggtgtcttctgtatcattgtcgttgtccatctatggattctaatttctatacaatggttctagcacaggtgtccccgtgaagtgatgctcttctatttgtttggtgatgtctggctttctcgctcgttgcctttccatagtatgatggtagaatgttttctgtccttatattggtttgtacttttgtctacattcactattgactatgctttatacctagttcctctttattctctgtagttactggttactctaactgtgttgatatgtattgtaagtttggagtttgggtcgacccgttgcctacgtacatcttcttaacggcgatgctatcactacgctcggggagtgtttgattgttgtacagcacactcgtagtccaaggtatgttgatggattttgatctctcatgcgactatgattatggtgcattatcatccttctaatgtgtagcagcagctgcttcctgcttgtctcagtaaggttctaggacataggtaatatggtaacttaaagctagcagtattatcactaggatacactagagaatgaagtattggaagtcattgcagcacatggctcaatgaatgtggtgataagtattatgcaaacttaatctaaattcatcgccatcaagaataagtatgcaagctagcaaatctcctgtaagatcagcatgatccctcagctgaactcaaaagccgtcaaagaccgtgcctccccactgataggaaggtcctaggctgccgtggtcccctggggatgtgtgcttcattgtgccctttttcttattggtttagaactcttgattttgtacatagtcctctgggtctagt

SEQ ID NO: 586132 - DNA, 124 bp, Homo sapiens
cgatggaacactacctcagcctcccaagttgctgggactatcatggtgtgcaacaccaggcacagttaattttgtatttatagtagaaaaggggtttcactatgttgcccaggccaccctcgaa

SEQ ID NO: 586133 - DNA, 273 bp, Homo sapiens
acaaaggcttggaaaaatgcgcaactccttcccgcccacatcaccacgccgatgtgaagacagtaggtgcatgaatggaaagtgtgtaggcatccttaatctccttgagtaaaggaaagttttagcttgagaggacatgactgaaaagtaaccaaaggctttataacaaacgttaattagctgtatagtaccttaaccctgacctggttaccagtttcataaagtttctacaaccaaaccaatgatgttatctgtgggccaagaggtaggaca

SEQ ID NO: 586134 - DNA, 172 bp, Homo sapiens
ttggccctaacactcactgaacagacactgtaattcacaatagggaatgttattaagtacagactacctattaagaagtaccaaggtaagctgggcagtggtgtgctcacacctataatcccagcgtttttgagctgattcagggcggatcaccttgaggtcagggagttcg

SEQ ID NO: 586135 - DNA, 121 bp, Homo sapiens
accatcactggacaagtagcatccgtactatacttcgcaagcaatcctaatccgtaataccaactatctccctaacttgaacaccaagatagctcaaatgagcctaagaagaacagaagaa

SEQ ID NO: 586136 - DNA, 119 bp, Homo sapiens
gagaagacgacgatgcattattcacagctccttggacatcgctttggactccccagctgacgggtcccatacacctccatcccctctgcgtccacacaggaacgaaggggctgggcagt

SEQ ID NO: 586137 - DNA, 408 bp, Homo sapiens
atagctgacctcttgagcataaaactaatgccatgacccacctactttttgataaggttgttacttgaacataaaacgcttactgtaatgcttaaccaatgtcacctgatacctgggggcggtgaagatttcccagatgttctctagcccaatcgtaattaaactgaagccctttttagagccccccctgctttgaacaatatcaaatatatatttgccattttgccagaaagtgtcttcatttgtgcagtaaatgagctcatgagtaaattgaggagcaaatagactcatttttctcctctttcccatcttcccatagatgcaagcctcccctatccagccccattctagaactgcattcagaggacacacttcagatgggcaagtatcaagctaatgcaaaatgga

SEQ ID NO: 586138 - DNA, 1512 bp, Homo sapiens
tggcttaaaaaaaacccatgagggctcccccacaatccatctcccctgccccatcttggttatttattcctatttatatttgggtatgtcaaaaggccctgtctaacaatattatttcctctggagtcctccttttttctttaccccgggttctctcccggtttgtgacccgagacgccggtcggtccggcccgcgccggccggccggcctgccggccgcgctcgcactgcccgtgccccggcacgccccacacattgtcctccgccggcaaccgcaaagggaacaaccccaaacacatctattaaacgccacaaacgggagacatatctcttccgccccgaaagccctcttatttgacagacccccatatctctttcacagagatatggtgtgacacaccaagaacaccccagcggccccccgatgtggcgacaccctccaagacaggcggcggatatcactgtgacacctctcctctcacacctttgtgtgagagacaaaagtgtgcctcagagagaattgacacacctctcccacacagtgtgcgagggagcacacattctctgttatactatgcttctacaactcgggccacccccacccacacacgcggtcacaccacaagtaggtgacacaaagtggtgacacaacgctccctccgttgtactttttacacacacaaagcagctgtgtggcgacacacttaaaagaccaccactgtattttcaccctgtttctacccacccaaaaatctgcgcgaacaaagtttaataaaaacacacaggaacttctcccaaatatcctccccgcgaatggtgacgagaagagtgttgtgaagcccacacttccccagaggggtactcaacagcacgcccagaatacacaaagccacatcttgacacccgacaacttgtcgagccttaatcatcatcctaacaggcggtcatccaatctgctattacaacgaagcgaaaaatttttggtcgccccaccacaaacacccagagggtgacacaacctgcctctaattaacacgacaacaatattaaaaacactccctttcccagtgaccacacctgttggcgatacggcggaggacgtcacccctcttcacctacacatcgctcacaccccacactgattcgagaatgaccatgtgatgccaccaacaataccgttgcagacgacgcccctcttcattataaagataattcaccccactcagcaagaatgccacacatgtaggagggaaactattgcaacgtgcttcgcactccaacaaaaattattattgtgccccccccccccgagtacgcgaacggcatatacatcttgcagccacacaaagaaactatgtagacagcccccactagcacagtaggcgcctctaaacatcaccttatttgttcacaaccagaagtctatcgtaacacaaaaacacacagcgccactaatatcaccaacacacaggtgatgacaacatgtaggaataccacccacatgatcgaaca

SEQ ID NO: 586139 - DNA, 152 bp, Homo sapiens
tacgacggaaagtagctagggtaaacttctcttgagtcaaggagtttatctactttagaggagtatttctcaacctcagcactaagtgacattgggggctggataattcttggttgtgggagtagtcccagtgcatggttaggatgttgagc

SEQ ID NO: 586140 - DNA, 447 bp, Homo sapiens
ccagtttagctcaggtagaataaagtgcaagaaaacattgaaccttttctgtgggtcaggaagccattgtactaaagatcatgaaccctttcatcttcccctcacaaaataataaacaagggactgcaactttgagggaaatctagaaaggtaggagactggactttggagatgtcagattaggactggtgaaaagcagatattctaggctcctaaaataacgtgggaacaagcccagaacaaccttggacatggtgtgtttgtgcatgggatgcttttcttttgagacggaaggttgatgtgttgaagtcatggaaagtgttcaaaatattgtgagaattaccgaaatgtgacacagaaacatgaagtgagcacatgctgttggaaaaaaatggtgctgatctacttgcttaatgcagaggtgccaaaaaccttcagttgtaaaac

SEQ ID NO: 586141 - DNA, 274 bp, Homo sapiens
gggtggtaccaatcgtgtgtttattgaatatgtctggcacccagtgactgattgattgaccctcaagaaagctataggtgtaccccccttttcagtgaaaacccaccccttcccacacccaaccatatagtgagaaaaggcacaggccatacacacaacaccgcaggcggcacagggtcactataaatcacatgtagagagtagggagaggcgcagagagagaaagagcgcaggtggggtccaagcacaccacagggatcacattacagcgtgc

SEQ ID NO: 586142 - DNA, 165 bp, Homo sapiens
ggacaaaaggaaaaagaataaaaaagaattaagcatgcctacaggatccacaaaataacctccaaagggaaaatctaagagttattggccttaaagaggagagaggggggcaagaggagagagaggggaagaggagagagagagggtttcagaggagagaggtcg

SEQ ID NO: 586143 - DNA, 674 bp, Homo sapiens
  misc_feature (188)..(188): n is a, c, g, or t
  misc_feature (252)..(252): n is a, c, g, or t
  misc_feature (302)..(302): n is a, c, g, or t
  misc_feature (306)..(306): n is a, c, g, or t
  misc_feature (308)..(308): n is a, c, g, or t
  misc_feature (337)..(337): n is a, c, g, or t
  misc_feature (342)..(342): n is a, c, g, or t
  misc_feature (348)..(348): n is a, c, g, or t
  misc_feature (354)..(354): n is a, c, g, or t
  misc_feature (361)..(361): n is a, c, g, or t
  misc_feature (365)..(365): n is a, c, g, or t
  misc_feature (367)..(368): n is a, c, g, or t
  misc_feature (384)..(384): n is a, c, g, or t
  misc_feature (390)..(390): n is a, c, g, or t
  misc_feature (393)..(393): n is a, c, g, or t
  misc_feature (466)..(466): n is a, c, g, or t
  misc_feature (473)..(473): n is a, c, g, or t
  misc_feature (477)..(477): n is a, c, g, or t
  misc_feature (494)..(494): n is a, c, g, or t
  misc_feature (539)..(539): n is a, c, g, or t
  misc_feature (545)..(545): n is a, c, g, or t
  misc_feature (554)..(554): n is a, c, g, or t
  misc_feature (559)..(559): n is a, c, g, or t
  misc_feature (577)..(577): n is a, c, g, or t
  misc_feature (591)..(591): n is a, c, g, or t
  misc_feature (601)..(601): n is a, c, g, or t
  misc_feature (621)..(621): n is a, c, g, or t
tccctagatactttaggccgtcgcatcgattatagagattgaggtggaacccggggcctgggaactggacgcacgcggagggcgaagatggaagcctggcgctgtgtgaggaagggctacggccactgtgtggtgggaagaggccggtgtgataaagcggaattgggaatatatatgtagccatgatnaaagaaaaaacgaagatctctaggagacaaaaatgttgatccccaaattgttgaatgacacgtngagaacaagtttgacttttcagtgatgtcctataatatactttcacaagntttnancggaagataacttcttcaccttttattangacanttgaanggacgnaaagtanttananntgggaggttttaaggnttcccnaantattcctgaaagaaaattaaacaattattgaatgcaagacagtacattctgtcttgcaaagaaagttcaaagnaagatcnattnatgggagccagagatcnaggccaaagttttggaatcactggggttattcactgttgaatatnaagatngcggaacanggaanggaaaccttgattggctngtgctaattttgcnttcaatacanttccaaaaattttcacctcntctgtcaagtgaacccaagttggaaattccttcccgcccctgaatattttctc

SEQ ID NO: 586144 - DNA, 391 bp, Homo sapiens
agataacattcacaatatgtgttaattgatgtttaagttatcagtcagtcttctggtcaacagcagactatcagtaattaagttttggaggagttaaaagttacacataggctgggcatggtggctcacacttgtaatcccagcactttgggtggccaaggcaggtgtatcacaaggtcaggagatcgagaccatcctagccaacatggtgaaaccctgtctctgctaaaaatacaaaaattagctgggtgtggtagcacatgccggtagtcccagctacccggcaagctgaggcaggagaatcacttgaacccaggaggcggacattgcagtgagccaagatcatgccactgcactccagcctggcaacagaacgagactccatctcaaa

SEQ ID NO: 586145 - DNA, 411 bp, Homo sapiens
aaccccataatttaattgagcaccctactataaataatccaggcgctgttttaagcacttcctgatatgctggtaaaaaaaaacagatgcaaatacctgcctttgttacgcctgacattcctagaggacatttaaagagatctagttcccatgtggatagagcaaaatgaaagggaaagttatactttagcacaaatgtcaatttcagaatggtttatttttaaaatgccagactctgccatcctgagattgactaactattgtctcaccatctctttgtcctggttaagttcagagaatacaatgtgcccagagtgcagccctgtttgaaaaggacggcttgcagagttgcagcaaaagtcatttctgggcagacgataatactaaacggaagctgatgaaaaaaaaaga

SEQ ID NO: 586146 - DNA, 1002 bp, Homo sapiens
tcagaaacatccgagtgaagcttgtggacgaatatgcaggagctcgctaggggacagatacgcagggggttcgtgtcttctacctagagttgacacatcgtacggttgtggtacgaaggatgatcgtggctactcggaggctaaagtcgtctccaggagtgcattcataatgacagggagggcgcagcagcgccagacacgttgagaggaacctgctggatgtgtaccatgtttccacagaaggcgagttagaccttaatcagcctctagtttctcggccgttgattccttccagaggtgtcctgaggcgaaacgttcgacactatacgtgacatggcctgtaaaccacgttccactgtggtttaactggtttcaccaaggccggtttgtcatccttgaatccttgcctggcaacaattgaggttgtccttaaaaaacaccagcttggaaggaacaattgtctctaacgttccgaattttgtcgggtataggtcaaactttacaagcgtgtgggacttttcacaccgggctcattcaaggcatcacttgtctaccaatgcggcttgcggcttcgaatgtcccaacgtgggggaattcccaacacagtgtacacacgttcgccccgcggaaatttgtctaaaataactagcacatacgcggttctactctcggaatccgaccgagttggggcccacctagtaatcctaaagtgacccactcccaaaggaaagttctgtgggcgacaccatcttcggcggctcagacagtcgggaaccattttcccccaggcggtggggcgcgccgcctatatcccccgttacccaaccacaatattcgtggcccacagcgggcactttccacccttaccgttctccgatggggacctgtgtggcaaccctttcccacaagcgcagacaccatttaaacctttgtcgccctatatgcaattgcttctgcttcaacggaaaacctttcagcactctgagggacactttaccttga

SEQ ID NO: 586147 - DNA, 884 bp, Homo sapiens
atatgcgtagtcggtcgttggggctagaacaccagcgccttgtggctgggcgcgcccattgctgaaggaggcccccgccccctggtttgttgggacgtctgctcgctcctttggtgggacacgtcttggatggaggaccccccattgtggggggcaaacctttggctgccctccctcctcctgtagggttgggggaaagaataaccttccgctctcgctttttgtggaacggggagacaactgtctccccccgcctcggggttctccggcgcttgacactcgcagatgcccgccctgtcactcgccacgtgcgcagcgtgtacggcctcccccgaaagcacacacgtcccggccgggggggaggcacaatgcgaccggtactgcataacgcagaacacccaaggattggagagcccccccgtcttgcccccacgcgggagcgtcaatgacaaaaaggcagcgcccagcatggcccggggagtgtgtccccccaccgtcgtgatctctcggcgagagctgggagagacacccgccaccgccgcctgcataaaaaaaaagtgtggggtgagtccctccccccgcgcccacaagcccccttcgggtgtggttgagatgacatcccgctggcgtccgttctccccattgcctccctgcccggctccactctcacataccgaactcgcaggggttagaagctgcccctacaaggagcccttctcgtcgccaatatggggagtttttcttcggaagccttgtgggagcgctttgccttgctctcggcacccgcccttgtttctcctggtagaggagttccccccctcatcgtggagatcgagggagattagacatgtccccttttttgtctagggcccacaaacaaaaca

SEQ ID NO: 586148 - DNA, 739 bp, Homo sapiens
  misc_feature (14)..(14): n is a, c, g, or t
catgataccctacnagcctaggatgacatgaccatgattacgccaaccttggcactaggcctacatcgtgctgactggggaagctttgtgacggcaaggggaggggatggttaatgtgggaatacccagtgatattcgaattaggtacgagctactggcgagtttgagcctcagctacataaatctgactgagtgtgcctacaagtggccctactgctctcagtccatgtactatggaggaatgccgacagttgataatgttaccatcctaaacggaatgggagtcacacgaagaattgtatataagcctgaactgcagccctatttgccgcataagagagacaatatttaagttgccttcgactacttcgaggtcttatggccttggtcaggctacctgtgtatcttcattgatgtgaccaagaaagcggcttcctgggaaggcattgtttaaggccatgtaatgatcactgtggcgaccacacatacacagagttaaaaaatggtgcggtacacacttcaacatgggaatgtccccgataaggtgaacatgattgctactccccagctaatcaagagaatgttctggggataggactccaacctgcgttatacacatgggtattttcccagggataatttaaggatgacataattaccctttagaatggaatggagatgacttctactgccaattttaaggtttttttcccaccttttgagaaagaatggggcttta

SEQ ID NO: 586149 - DNA, 473 bp, Homo sapiens
  misc_feature (62)..(62): n is a, c, g, or t
  misc_feature (116)..(116): n is a, c, g, or t
  misc_feature (267)..(267): n is a, c, g, or t
ccaggtggttgtccccggcggggggcatgggcatggtgccagtggtcctgttaatgtccccnataattttgagcgcctccttcagggggtggggcatgtgcagcatcttgtcatgntgctgggcctgctctgccaactcctccatcagggtgttttggttcccccatggggacatattggccagcggctcccaaattattaactccggggttttagagtgggcaaacagggaaaaaggttgggacctggggcctgttcccccctggntccccttttgggcccttttggggatgtgcctgggacttggagccccttggagtatggcttttcccccggggttttataccgctttgactggaagatccccctcccccctgccttttttccctcagatgggggccccggggtccaaaggaaaaaacccctgtcaaatgtcccagatttgggggggggcttaagccttttcttgccca

SEQ ID NO: 586150 - DNA, 240 bp, Homo sapiens
  misc_feature (2)..(2): n is a, c, g, or t
  misc_feature (34)..(34): n is a, c, g, or t
  misc_feature (72)..(72): n is a, c, g, or t
  misc_feature (91)..(91): n is a, c, g, or t
  misc_feature (166)..(166): n is a, c, g, or t
  misc_feature (227)..(227): n is a, c, g, or t
anttcggcacaggcctgaaagagctggttctacntggtgcagacacagctgccaacaaacaaaatcggcacnagtttgtcgatgcttatcnggattacatattcaatacatcagtggcttccttattccgatgcttttcatgcgggctttcataaggtctgtggangaaaagtccttctgctctttcagcctaatgaactacaagcaatggtcattggaaatacaanttatgattggaag

SEQ ID NO: 586151 - DNA, 1342 bp, Homo sapiens
  misc_feature (164)..(164): n is a, c, g, or t
agcgtgaggtgacatgaaatgctaccatcatcgttacatgaaaatacccgtaaatacttgctgttctctggtgtcgcatgtcctgacctcagcggcgcatcgatgattctcctctatcgggcagcatgataagcacgtggcgagtctaacttgttgacacgctntctatcatcgaaggctcccttcgccctgacggccccgtatcaggaaagctattagctcaagcggggtccttactatctgatttacgcttgctacacgcatagctacagacgcttgtaatgatagcgatggtcgtcgaaaggacctccactatggccacgttcacttcgtccgtgcgcaggtttgtgaatggtgcattggcaaacagtgacgatatcttacttgggagggacccaatggtgtcttgcgaagagataatatggacccaatttccaattggttgccatcctgtcagtaggtgctcgtgacttaactgtgaaagacaaaatggggaatgtcctccaaggcggtgcttcgaaatcggaaaagtcattgatggagccctcttttggccaaaaaaactatgtgtgtactagtattttttcgtaaatagtagtagattcccgaattgatcgagcttcgataacgtcactttgggtttattgataggtctaccttatcgataggtctaaatctttcctagttccgggaattttgtcctcttgattaggcaaaaaacaattttccgcttaaccaaatagaaagtcttctcccatatatgggtgttctccaacttgtaggaatctctgcaaaatacacttcgggggtgtggaagagcctaatccctcttatttatttagccctccccaaaatttatattattaactaacctctggtctgtctctccgttctccacccactttggcttccggttatagggttggacattatatagggccgagtagggtttaaactatcttcaactaggggttatagagaataaacacccaattccctttgggcgggctcggggaaacttttttctggaacacatttcggatttacacttatatcattgttacagggagaggttgtgcgcttttttagccacaagcccttgtttagtggttgtgcaaatccaaaggcccatttgttggctttagtaagaatttcaacaggagcgtaaatcgggtgggtgtcccaaaagcgttccttaaccaagcttctctaaacgttggtgaatcactcggggaaagaaacccgttcttttttattgttaaaaggcggttttgaagattaggccgaaagggggttccccagcggtttaacttaactacatttctttaaaattgtgcgccac

SEQ ID NO: 586152 - DNA, 683 bp, Homo sapiens
  misc_feature (253)..(253): n is a, c, g, or t
  misc_feature (337)..(337): n is a, c, g, or t
  misc_feature (388)..(388): n is a, c, g, or t
tgtgctgccagcagacagcctctcagctcttagccccctttgaggatgacctcagctgacaaaagctgcctaacctagcctacacactcttcataggtagccttcattcaatgactgatgaacatgtggttataaaagcctggccacttcaccccaattcaggacagctggtgttggcccccaaaatacttcctaataaatctcctgcatgaaatcaccatctcaaagtgtaccttctggagaatacagtgtntggaaagcagtaagtcatggctaaatacagcaatatgctctggagttcacttggatacttccctaggcaaaaggcaagtccaanttatggataaacatggctagactacgagctcaacatcaagaaaagccattntcacctatgtaaccaactacctagataccaagcctaattatagagttttcattcaaagagccactttgtgcttggtaaacactaatagttgaagcaaggcagcaagtgggtctcacagccagtccctcaaagacgtatcaaaagcaggaacttcttaaaacactagaaactgaactattactttacaatcccatcagacaaactagagacggggaagaccatcacaaagattattcagcttaatcaagaacatgggaccagctcagcagctcatcaccacagaagatagatgaag

SEQ ID NO: 586153 - DNA, 360 bp, Homo sapiens
cgcatcgccagggcgaccaggaggtccggatcattggaatccacggcccgcttcatgatctccgcggagatcatcgatgagagggaccgcagttgcgctagggacgtggtgcggacccattccggatcgggctgagtcatgtcaggatcaactccgagccctgctccaggctgttggtgaccttgatctcctggggcagcgcatcgatgacggtgcggtcatgggtgatgacccagatggagtccacgatgccggtgttcatcgccacccggaggacctcgatgaatgcggggatgagcgctcatcgagggaccgaggggctcatcgaggaacagtgtcgtcactcaccaaccaaggatg

SEQ ID NO: 586154 - DNA, 340 bp, Homo sapiens
agcgggagtcagattcccggcgggcacggccccagccctgtccgggtctccatgtcccgctccgcccccgccgcgcccgcccaacactgtctgtggtgctgacggctccgttgcggtggagggcagggctcaccgaaggcccggcgccgccgccagctccacgcaaaccaggcttcagagaacgctcgcttggctcatcggtggtcgtcggggacggtcgtcgcgatctagcctccacaccgccagggaacagcggcgccggccggcgccacgcacacggccgccgggctcccgcgcttcacaccgcgtccaccccccaccccgacttcgaccccacgcc

SEQ ID NO: 586155 - DNA, 169 bp, Homo sapiens
tcaggctgagtgcaggggacaatctcatcgactcggctctcgggtcaaacaaaatctccggtctcagcctcccaagtagtggggattacaggcatgcgccaccatgcccagctaattttcgtatctttagtagagacagtgtctcacctttgggggccagtctggaggt

SEQ ID NO: 586156 - DNA, 501 bp, Homo sapiens
gagaagcccctcccctgtgccaggaggatgagaagaaactgttccgtggtggttcccacgtggctaaattgccatggtgggtttctgagagcttgggtcggtagttgcagacatctcttctccgttgtcgggtgccgtctctgctcccttgtggttatttgctcaagcccctggcgatcccccagggtgaattgtgcagcaagtcgacggtacgactgggacggacatttcttggtcagggaacttggcatcccattcagcatctcaggactcacaggccaacatgtgttccatggctgggaattgcctaccaccacatcagcttctgtttaaccttttggcatcaaactaatgaacagttgtttggaaatctttctacaggcaattacctccccaagagaagcttccttattttggagtacggtcctaagatacgctcggatgaatccggaaaacatgtgccctctaggtattattaatataagcaggaagggatctaca

SEQ ID NO: 586157 - DNA, 505 bp, Homo sapiens
  misc_feature (423)..(423): n is a, c, g, or t
accggagcggaagccagcataattatttattgaaagaatgaagaggctttttgcagtggctcatgcctgtaatcccagcactgtgggaggccaacacgggtggatcatctgaggtcaggaattcaagaccagcttgttcaacatggtgaaattctgtctctactaaaaatacaaaaaattagccgcgtgtggtggtgcgcacctgtaatcccagctactcaggaggctgaggcaggagaatcgcttgaacccgagaagtggagcctgcagtgagccaacatcatgccactgaactccaccctgtgtgacagagcaagactctgtctcaataaaaaataaaatgaaataaaattaactggtctctttgttgcaccttgaatagatcttttatctatgcatgatttttgtcacatcatgaattgngaatttggacaatatccatgactaagttatatagatattacagttgttgatgcatagtataatatcatattctcacatgtta

SEQ ID NO: 586158 - DNA, 725 bp, Homo sapiens
ccccattggcactttcacttattgggggagcttcagggctgttttcacctactcccagaagatccctagttgtggatcaaggtaactcgagtggagggtaacctggggcccctcgacatcaccgtcattgatggacctgaaccctgtgctcctcgccgatctgttgttgttacttccctcccagaggctggaaaagggctccgagcttctgaccaggaaccagagggtgaccccatttcaggaggtgcccggtacccagcctgactaggtaccaaggccagcttgtgtgggccccaccaggccccttggtagagctggtgcccagatgtgggctccagatcctgggcccatgatgggcccgagcccacctcggatcccactgattggccagccgagcgagaacccggctgctgcatggcactgaccgccgcttccagcttcctctgagccgccgggcctgctacgcgggcacagcgtgctgcctctcttctgtgtcgttttgttgcccaggcagaatgaaaagtccttaaccgtggactcttcctttatcccctcctttaccccccatatgccatgacttttaattttcacttttgtagtttaatcctttgtattaccacatgaatatagttgcatatatggaccccgacttgggaggaccggtcctgaatgtcccttctcccgtgtaacatgttttactcccccaataaaattctttccagcca

SEQ ID NO: 586159 - DNA, 138 bp, Homo sapiens
cgcttggggtatgaacactgcatatcttaactataatccagccattagcatgatcagagcaattcccataagttatactgcgccacaatgagccggcactaatgagccacacaacgcgccactcgaagagccacacaa

SEQ ID NO: 586160 - DNA, 102 bp, Homo sapiens
gccggcctatccgttggaaaaaaacaaaaaaaacacaagtactttcatttaaaaagatacggcagcggggaagcacggtggctcatgcctgtaatcccagaa

SEQ ID NO: 586161 - DNA, 255 bp, Homo sapiens
gcgacagtcagccgcatcttcttttgcagtcgccagccgagccacaatcgctaagaaaccatggggaaggtaagggtcggagtaaccggatttggtcgtattgggcgcctggccaccaggcttgcttttacctctggtaaagtggaaatttttgccatcaaatacccctcaattacctcaactcaatggttacatgttccaatatattcccccatggcaaattccatggcaccccaaggcttagaacgggagctt

SEQ ID NO: 586162 - DNA, 490 bp, Homo sapiens
cagctgtgctgtatgtcttaatcttctacgactccaacacagtgaagcagaaacatctgagcttcactcctcctgagaaagatggcttcccttctggaacaccagcacagaatgccaagggaacataagcacccgtagtagtgacagaggaggaggatgattgataaagagactgctcctctcgtaattgccccgcgaacggttcatacgaaatcaatttacacacggtctgtaattgaccctgttcctgcaccagttggggattcacatgttgatggtgctgccaagtctttagacaaacagaaaaagaagactaagatgacagatgaagagattatggagaaattaagaactatcgtgagcataggtgaccctaagaaaaaatatacaagatatgaaacaattggcccaggggcttctggtacagttgtcactgctactgatgttgcactgtgacgggtggttgctatccaacaaattaatttacagt

SEQ ID NO: 586163 - DNA, 731 bp, Homo sapiens
agtctgaaggaacatatctgaatagtgtgattgaaagccacacagagttcatatttactcgatgcataaatggctcctcttgaaaccgatatccatgtttactccatctggataaacgtctcttcattcaaagaaatacatatcactagttgactgggagtctgaacgtggacatagttacagctcaccagagggatcttcccggttctctggtcctgcattgtgtctatgtgtcatgtcttatccattggttgcaaattgggagtgaacaaggtggagtatgctccctgtgattactccaattatggtgacaagtaaggttggagcccttttaaagctgaagagtgtggtcgactagtcgattttgggtgtgataacatagtactagagctgggatgtcttccatgatgacaacagaaatacataaacacaaggtgacttagtgagtcttagtggatatacaactttgtgtgacctacaggatcggaatccctctctgatcaacagttactagtactcttctttgtcagtattatcaagctaacagctccgtgcatatgcaaaggcaggaagagtgttaaagtggggacagtgggcctctccgtgttgaataaccagcttggcatgaatgtgggtcaaccgactaaggtcttcggtatggaagcaagtcaagggggtttggcttgcggagcgggaaagcgaaggtcgttctgaatgagacccgaagctgg

SEQ ID NO: 586164 - DNA, 611 bp, Homo sapiens
ttctcagatgtggttcacaaatgttaaaactgaatctcaatagctaatgcacaagaaacgcttttgaactttgtaacttgttttgtgcagaaaaatgtgcttctggattgcttgtcacgagtgcttaagaactagaattcactttgaaatcaaacgtgcgcgtctcacacaatctattaccaaccaacaaggactgacttcaggtcaggcaataaaatggagagtaccttgatttgagtcaggttctataacaaaattaacatatgtagagtttctattaagtctttcaatgtaaaagccattgttttgacatggcaaaaattactgtaagagtctccagattaagtatctttttgtacttaactgcacagcttttgctcaaggagtctttgtgccagtcactttataagtttattagtttacaaacgattgcaacatcccgttaataaaatggaaacgtaagatgacttagtattttaaataacttgaagctctgtactgtggctcttgttcataagaaacactgaaccaacaagcagcagattcagcccagccaagactctgatgccccagtgcaatcactactcacagccttattgataaggttacac

SEQ ID NO: 586165 - DNA, 365 bp, Homo sapiens
gatggagtatagatcactgtctttctgtaaaggtatagacaaaccacgacgacggccaaaacgacgctgacactggaacggtacgtacgacaatgacgataattatcttcttaacaaataatagttgtatatacaaggaggctagtcaaccagattttatttgttgagggcgagcagtctacagcaaccagacctaggccttgtttgacgagatgtagagtcgagtcatgtaatcacaaatgggcctagagcgagacagggatataaacaaactatttccaaggtttaacccggtgcattcattcgagttgcctcaggatagctgggcttttcacttggactgggacgtcaagactgagttttgt

SEQ ID NO: 586166 - DNA, 172 bp, Homo sapiens
catgtggcgtagtgtcgcgaactgagcagacggtgatctcaatccggcacagcagcgatctctgctgaagattggtacgccgccatcgattacctgattcccaacgaaagcgacgctcggctttagttggcgtgctgttgaatccattggacagcgccaaggtcgatgcaag

SEQ ID NO: 586167 - DNA, 197 bp, Homo sapiens
gaataaaggattctatcaacacggctatggtattcaagccagtgcgataaaaaagggggggacaggaactagtgccgggtcccccactactaaagggcctctctccactaccccgactatcccggcacataaactccgttttttttttttttttttttttttttttttttttttttttttttttttttttttttttc

SEQ ID NO: 586168 - DNA, 105 bp, Homo sapiens
caggatctcgtcatcaaccctgctcggttgtgggaaaaacattaatttgtgcagtccaacacttacatactttcttgacggaaggcaatcctgagggttcgatga

SEQ ID NO: 586169 - DNA, 137 bp, Homo sapiens
gaatcatcgtgtcctccctccttcccctttctaatggcccagtgtctgttgttaccatctttgtgtcatgagtacccagtgtttagctcccacttgtaagtgacagtatttggttttgctacttatgagatgcggta

SEQ ID NO: 586170 - DNA, 110 bp, Homo sapiens
gcacatgcaccaatctgaaactggatcagaactcatttggatataaagtattgcagagtgcttagcagccatccgacatgcccgctggtcgaggaaaatgctctagtcca

SEQ ID NO: 586171 - DNA, 169 bp, Homo sapiens
caaagactggaaactattcttagctccgtcactgactccaagttcatccctctcgtctttcaagtttggttgagatatagggtattcttccaaatcagtcttgaagggtataacaactgcctaatgtgtggggacctcactgtgtatgaagtattaatttggggtaatt

SEQ ID NO: 586172 - DNA, 404 bp, Homo sapiens
  misc_feature (1)..(1): n is a, c, g, or t
ntgccaaatacttccagtcagctgatcttgacaagcaaacaaaaacataagtggggaaaggacacccttttcaaaaaatggtgctgggataattggctagccacatgtaggagaatgaaactggatccttatctctcatcttatacaaaaatcaactcaagatggattaagagcttaaacctaaaacctgaaactataaaaattctaaaagaaacattggaaaaacccttctagacaatggcttaggcaaggatttcatgaccaagaacccgaaagcaaatgtaataaaaacaaaggtaaatagctgggacctaattaaactaaagagcttttgcatggcaaaaggaacagtcagcagagtaaacagacaacccacagaatgggagaaaatcttcacaatctat

SEQ ID NO: 586173 - DNA, 299 bp, Homo sapiens
tactaatctctctggtccatgatctgtgagtacagctggagaatcgtgactgatagcatcactgggtggatagcgttgtcatagaaaactgtgtcaggtaggatgagtaccgctatcgaatgtaccagactcaggtctcagacgcagggctagtacgcgctgcatggtgacagcctggtcacctgtcagtggccgcctttgctgagaagcagcgaccagtctctccgatcctattgagatagacttccaaacctcaggtcctaatatttaatgcttctgtgcattcagacacaccatca

SEQ ID NO: 586174 - DNA, 384 bp, Homo sapiens
attttaccagccctgattcctgctaaggaatcctgggtgtgagggatgggaacatggatgagtacctatgtacatacacacagtaaatacacaaacacatattcctcacccacatatctgtctaggatttttttttacatgcattctccttaatcaaatgacatgactatcagtccaatcccagcattcgctaggcccaggaagagaaaatgatgtgtttgaagctaacgaatcatccaactaggttcattcctgcaagtctaatcaccaccaccccagagagtaacatggttaccttcttacagaaaggaaacagggactgtccgcatttctgtgaagattgaaatgatatctttgggtatgaacgactctctcgcgaatatc

SEQ ID NO: 586175 - DNA, 321 bp, Homo sapiens
tatgtcaaacttacaatatcagttcttggtatagctcttggtcgagaatccatctcacattgagtctgtagcaatgtacaacatggcatggaccagtagtcataacaggtcatgattgggcacggcttgacgaaaagcagaataactgccccaaattgaaattatttattcagcttaaactaatgccacaaccatcccacttggaatcactccaccctgacacttctgaaacccactctttctttctttcatctctgacatgtcccctacgactgagaggcatttcactcaataaaccaaggaagatgacagatgttatct

SEQ ID NO: 586176 - DNA, 343 bp, Homo sapiens
cctctgtactggccacgcgtgtgttgctcgagcctcatgacatcaccccggtcaacgtgctgggcattgtgttgctgtcgttggtgctgttcagcgagcggatcgaagccttcttcgaccgcgatcgctgagtgcaccgctctgctatctgactcaaggaaaccaaggatgaacagaagcctcatcgtcttgctcgccgccctcttcacccagggcgcctgggcagaaacccacagtatcaaggcgttcctcgccgacccggtgacagtgctggacgagcagggcaagcaacaacgtgagctggcgaaaaaggacgcgcccacccagcccctgccggtattgc

SEQ ID NO: 586177 - DNA, 306 bp, Homo sapiens
gtaccccccatcacctgcacatgggacagaccggggtggagggtgcccttggctgtgtacgtcccagcaaaaaagttttggcccgcatctcgctgtgccctgaagggggatgaagggcgatgcctcgcccgaggttttgggctgctgcactgcatggtgggactgttcctactttttgtcccccccctcccccagctgtggtccggctttgggagagtggtgaattgcgctgcccgaactcggagcggagcagggtagggcccgtgtacagcttgataccccttaataaaaagggagtttgcccag

SEQ ID NO: 586178 - DNA, 178 bp, Homo sapiens
gcgtatctggcgctgtacagagaggggcagcctcccgtgctagacgaccctagaaacaggatagacgggcgggtagacccgtagccccgtaacccacgacgttagggtcccctagaggcatctctccaggcctctagcctgtaaggaagaaaaagagcaaagacaaggtagagccgag

SEQ ID NO: 586179 - DNA, 106 bp, Homo sapiens
cgagaactcacggcacctccacatggagctcattttctttccagaagtctagaggatgccttaaaacttactgaacaaccagaattagcatatagagtagacatgg

SEQ ID NO: 586180 - DNA, 245 bp, Homo sapiens
  misc_feature (72)..(72): n is a, c, g, or t
tggtcctcactgaactctctgcccttgaactgggcaagcaccctctccctggacttcattcttaggcttttntctttcacacacctgtaaactatgacttgcccccaagatgttggcatcattcaatgtgaaccaaagacccccttccaaaaatcagctgactacaaagaaaaatattctttccttagtgttcttaacacagaaacttctccactttatatgattccaccccaaaacgtagacgc

SEQ ID NO: 586181 - DNA, 113 bp, Homo sapiens
cggtcaggtgtagagtaggtatattatagcatcatcatccatccatcatccatcgcttcatctactcatctatccatccacccatctggtatcacccccaagttatccatcta

SEQ ID NO: 586182 - DNA, 929 bp, Homo sapiens
ccccccgtggttcttaagaaaacccaaggaattttccggatgacatttaaggaaaggaaacccccccccacaaaaaaggctcggtggaacccccccccgggcgcccggttttttaaagggagaaaaaaaaaaaagggggaaattcccaagaaccccaattccccccggggaaaattaacagagtttccccccctcaattcctaaacccgcccctttgatttccgctttgggtccccaccaggcaaagcgggcatgggcccctctctattcctcctctcgcaagagtccaagttccccatgaaaacttctgcgaccccctctgcacacccactgccagtcaggccactccctcattctgcgttgggattctgaagaagactctcccttccttcccttgccccgatgcgtgggggttggaaagccaaaggcggatgtttgccccaaaccgctcccaagaaaggatgagacctgcttagtccctcctccccctgtggacagggacggggagagtgataattcagaccgtgttcctgtgcccagttttcaaaattccttcagccaagctatggaagcacccttcatgaacctggaccccccggcaccttcagatcccctctctgaaggaaaggggggaaagaaagaaaaaaaccagaaacagaagctccttttcagccccccagtcctccacaccaagtgaaaatactgggccaggctaccctctccaattgggttttggttttgtttttttttcccccaagcctttggttggccgccgtaatttttaagtaattgagtttgaacaaattagctctggggggggggggtttccccaatgtgagggggaaccaagaaaattttaaatacagtgtattttcccgcttcctgtctttacaccaaaataaagtattgaccccagagaaaaaaaaaaa

SEQ ID NO: 586183 - DNA, 218 bp, Homo sapiens
  misc_feature (1)..(1): n is a, c, g, or t
  misc_feature (34)..(34): n is a, c, g, or t
  misc_feature (62)..(62): n is a, c, g, or t
  misc_feature (64)..(64): n is a, c, g, or t
  misc_feature (89)..(92): n is a, c, g, or t
  misc_feature (99)..(99): n is a, c, g, or t
  misc_feature (102)..(102): n is a, c, g, or t
  misc_feature (104)..(104): n is a, c, g, or t
  misc_feature (139)..(140): n is a, c, g, or t
  misc_feature (164)..(164): n is a, c, g, or t
  misc_feature (198)..(198): n is a, c, g, or t
  misc_feature (214)..(214): n is a, c, g, or t
ntcatctggggccgcagcatgcctatggttccgnttccggccgggagccctgaacacgggtntncagactcaccctaaagggcggcccnnnncccacgntanangttcttgtcgtagtaccgtaagtcagtcatgttgnngtgtcctctcctgtgtgtagttgngtgtgtgtttgttgtttttccccacagttgtgtncttcagtcatgtcgtncccc

SEQ ID NO: 586184 - DNA, 111 bp, Homo sapiens
cggacatcgccattctgtggatccgaggaggcggacaagttcacggggtcactgcaggccaatgcgcagagtctgaaggagtaccgctccatactcatcctcttccccagg

SEQ ID NO: 586185 - DNA, 477 bp, Homo sapiens
  misc_feature (88)..(88): n is a, c, g, or t
acatggtgagattttttaaatgtgtctttttaaagtgtacagtgaaaagtctccctcatgccctcaatttcccagccactgttccttntggactcttctacaaatagtccctgtttctacaaatgtattggaggtaggcaggctattttgatttctacccttaacagcttcaaaaaaaagagaaaaagaggctcccaactgccacatattttgccattaggaaaagcctgcattcctgttttcagttatgaacattcacttatttaaccggcagacttaaaatatgcctcaaaccacaatgaacctgctacataccttccatggcaacccacgttcctgtgtccctatgcacacccaacatctgtgcctcgttcacaacagactttgacatctccaatttttaacattttaaagagaatgaattcatgtgttactgggaaatcccaccgaataataaaagtgtcattttccaggaaa

SEQ ID NO: 586186 - DNA, 3754 bp, Homo sapiens
agcggattcccagagccggggctggggctctaggctgccgcggcggctctaggctgggctgctgggcgcgaggccaggcgggccgggagaggctgcgccggcggcggatcgcgcagagggcggtggcctgggctggccgaaccatggcggccccggagccggcgccgaggcgggcccgggaacgggagcgggagcgggaggacgagagcgaggacgagagcgacatcctggaggaaagcccgtgtggtcgctggcaaaagcgacgggagcaggtaaaccaagggaacatgccagggcttcagagcaccttcctagccatggacacggaggagggggtagaggtggtgtggaacgagctccacttcggagacaggaaggccttcgcggcgcacgaggagaagatccagaccgtgttcgagcagctggtgctggtggaccacccgaacatcgtgaagttgcacaagtactggctggatacctctgaggcctgcgcgagggtcatcttcatcacagagtacgtgtcatcaggcagcctcaagcaattcctcaaaaagaccaagaagaaccacaaggccatgaacgcccgggtatggggagcgggctggggcagccacggggacaggacggggttggggcagcctcggggactgggatggtgagggggtgcccggcggcctcggacaggggctgggcgaggatgcggggcgggctccgcaggcccagccgcctctcctgcgcccacccgaccgacggagtcgtgcgtccgccgccaggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcaggaatggaatctacccactgatgaactttgcagccactcgacccctggggctgccccgtgtgctggccccacccccggaggaggtccaaaaggccaagaccccgacgccagagccctttgactctgagaccagaaaggtcatccagatgcagtgcaacctggagagaagcgaggacaaggcgcgctggcatctcactctgcttctggtgctggaagaccggctgcaccggcagctgacctacgacctgctcccaacggacagcgcccaggacctcgcctcggagctcgtgcactatggcttcctccacgaggacgaccggatgaagctggccgccttcctggagagcaccttcctcaagtaccgtgggacccaggcctgacccggagccccagccccaggggaccatgccggggtgctgcctgggcaggccatgttggggagactccagcaccgtggggctgccctcctccatgcgcctgggagcacaaaggccccggtagtgaaggaaccccccgtctcctgagagtggggctgaccctgccttgggcgccgaggggttggggggtgggtgtgggggagccgttaggcctcccaggtccttaggatcagggttgcccccagaaccccttcccatatcctccattctccgccctgagttcctacccaggctgcctggccggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagcatca

SEQ ID NO: 586187 - DNA, 703 bp, Homo sapiens
agcggggtagacttcttgtttcctggcagagcggggtcccggcaccgcggcgctcggtgctgttttgggggcccgggtggagggcccgggtgccggggcccaaggtgcggcctcgctagcgggagagggagcgggagtcaccggcccggagagagctctcagggccagaagcggggcaggaggatgcttttcctcgagcgcccgaccagtggagctgcgcgtgtgggcggattgcatgttcagcttctcgctttgattcacgggaatctaacccacgtggagaacggtggaatctttgtccagttgatggggaaggggtaggaggtggggcgtcagccctgaccagtggcattgcctcttcccctgactactgaattccacgtgtggacccgaccagactgtgctgaaacggaattgtgacgaatgggaacaggtcatggttctacgttcagcgtccggggaggaatgccaggaaaactcaatcaagatcaacattatgaacatgaacgagcagagcaagctgtattcccagggtcatggtgccctctttgtgcgcacgagatgccgcacgccggccacgctggtgaacgctatacgagagcggcccgagctttgagatgacagagacgcagttgtgttatcctttgttcatcgtgttcggtggagggccgtggggccaccaccgttcttcgcttctgatacc

SEQ ID NO: 586188 - DNA, 382 bp, Homo sapiens
atggttgcgcagattgaatattatgccgcttgtagtggggattgtccggacctggagcccaagaatcaagaacttggcgagaagctcagcaaagacccaaatatcggcatagccaagagggatgccacatgtcaatgatgcagcctcttttcatatgaagtcagagtttgttctaccatatacttgttttcagccaacaagaagctaaatccaaagaaatatgaaggtggccgtgcattgagtgattctattatgctatctacaaagagaatctacaaacacctctttaattcaagaaaaataaacccattaatgacatattcaaacatattgcatgtataaagaatacttgtgaggagaagagacatcattccaaatgctt

SEQ ID NO: 586189 - DNA, 4121 bp, Homo sapiens
aagggcggacggggggcggattaggattggggcacttacgcggcggtatagtggtgcgctgggcgggagagggtgtggggtcgacgggtggaccagcgggatcatggagcgcggcggaaggaggggggaagagaaaataagagaggggggggaggggggggaaggtaaaggagagggaggtggggggggggggataagagggggaacctcggtcaaggttagcgggcagggggctacaaaaaaaagagcgaggggggcggggggagggggtatttcacacataaccctttattcacccccaggtaaaccaagggaacatgccagggcttcagagcaccttcctagccatggacacggaggagggggtagaggtggtgtggaacgagctccacttcggagacaggaaggccttcgcggcgcacgaggtgagaccgctgccccctcctcatcctgcttgggtgaccacctgctgaccacccagcgaccaccctccctccccaggagaagatccagaccgtgttcgagcagctggtgctggtggaccacccgaacatcgtgaagttgcacaagtactggctggatacctctgaggcctgcgcgagggtgagcacgggcaaggccccgggcaggcagagaccacagctaggtggggcgggcatggggacgaacccgcagctggtggaaatcctgagctcgcaccgtgcaggtcatcttcatcacagagtacgtgtcatcaggcagcctcaagcaattcctcaaaaagaccaagaagaaccacaaggccatgaacgcccgggtatggggagcgggctggggcagccacggggacaggacggggttggggcagcctcggggactgggatggtgagggggtgcccggcggcctcggacaggggctgggcgaggatgcggggcgggctccgcaggcccagccgcctctcctgcgcccacccgaccgacggagtcgtgcgtccgccgccaggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcaggaatggaatctacccactgatgaactttgcagccactcgacccctggggctgccccgtgtgctggccccacccccggaggaggtccaaaaggccaagaccccgacgccagagccctttgactctgagaccagaaaggtcatccagatgcagtgcaacctggagagaagcgaggacaaggcgcgctggcatctcactctgcttctggtgctggaagaccggctgcaccggcagctgacctacgacctgctcccaacggacagcgcccaggacctcgcctcggagctcgtgcactatggcttcctccacgaggacgaccggatgaagctggccgccttcctggagagcaccttcctcaagtaccgtgggacccaggcctgacccggagccccagccccaggggaccatgccggggtgctgcctgggcaggccatgttggggagactccagcaccgtggggctgccctcctccatgcgcctgggagcacaaaggccccggtagtgaaggaaccccccgtctcctgagagtggggctgaccctgccttgggcgccgaggggttggggggtgggtgtgggggagccgttaggcctcccaggtccttaggatcagggttgcccccagaaccccttcccatatcctccattctccgccctgagttcctacccaggctgcctggccggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagcatcaataccaccattgctgcacttaatcatgtctctgttgaatttttccttttaaattttatcttttcagaattatatatgtattgtttttaaagtagaatagttttttttttgaggccaataataaataataaatgcaggctcctactctgatcctctcca

SEQ ID NO: 586190 - DNA, 3766 bp, Homo sapiens
gagcgcggcggctggaaacctctccgcggcccctcgcggcccgcgaatcagccacccctggacccctttggcctggcgctcgccctgggactccctgagggccagtctcctcccaggaccacctccccatgcctctggactcagccgctagcttcctggggatccccctcgaccccctgaaacctgctccaaatccccttagcccagcccttggataggagcccttggctcctgggggcagctaccctccaagccccaccttcccgcagagtggctcagggcctgcagcccacgcttgggcccactggacaggtaaaccaagggaacatgccagggcttcagagcaccttcctagccatggacacggaggagggggtagaggtggtgtggaacgagctccacttcggagacaggaaggccttcgcggcgcacgaggagaagatccagaccgtgttcgagcagctggtgctggtggaccacccgaacatcgtgaagttgcacaagtactggctggatacctctgaggcctgcgcgagggtcatcttcatcacagagtacgtgtcatcaggcagcctcaagcaattcctcaaaaagaccaagaagaaccacaaggccatgaacgcccgggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcaggaatggaatctacccactgatgaactttgcagccactcgacccctggggctgccccgtgtgctggccccacccccggaggaggtccaaaaggccaagaccccgacgccagagccctttgactctgagaccagaaaggtcatccagatgcagtgcaacctggagagaagcgaggacaaggcgcgctggcatctcactctgcttctggtgctggaagaccggctgcaccggcagctgacctacgacctgctcccaacggacagcgcccaggacctcgcctcggagctcgtgcactatggcttcctccacgaggacgaccggatgaagctggccgccttcctggagagcaccttcctcaagtaccgtgggacccaggcctgacccggagccccagccccaggggaccatgccggggtgctgcctgggcaggccatgttggggagactccagcaccgtggggctgccctcctccatgcgcctgggagcacaaaggccccggtagtgaaggaaccccccgtctcctgagagtggggctgaccctgccttgggcgccgaggggttggggggtgggtgtgggggagccgttaggcctcccaggtccttaggatcagggttgcccccagaaccccttcccatatcctccattctccgccctgagttcctacccaggctgcctggccggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagcatcaataccaccattgctgcacttaatcatgtctctgttgaatttttccttttaaattttatcttttcagaattatatatgtattgtttttaaagtagaatagttttttttttgaggccaataataaataataaatgcaggctcctactctgatcctctcca

SEQ ID NO: 586191 - DNA, 482 bp, Homo sapiens
tggctttcagtcaatgaacacgtgtccctccaacaaatgtttgaatgtagccattgcagagaacaggctgattatcacattacgaaacagaaaaagtagtttccagaaaaacaaataagtattttttgtaataaaatatatgtaagctagtacaaagaagaaagaatctcgaaaaatacgtgtaattccaaggatgagaatttaaatttttattctatacaaatctgccatgtttacactttacccaacattttcatgtattaattatgagatttaaaatttaatttgtggaataaacacattaattcaagacaggaagttccaaaatgtaatatcatattattaattcgctagtgtcattcaaaaacttgataatgtttctcatatatcagctcttttatccacttgtagcttgtttttaggacatttgttctatttttaaaaaatgtatgaataaatacgatacaatgtttaaaaattgc

SEQ ID NO: 586192 - DNA, 641 bp, Homo sapiens
ccacatcagttgactcttcctttcacaagagatttctctgtagcatgcaatcctgtttgatagcatttacccacagtagaacttctttcaaaattggagtcaatcctatcaaactctaccactgcttactctactaagtacctataatattctgaatcccgtgttgtgatttcaacaatattcatggcatcttcaccagaaatagattccatcccaagaaaccactttctttgcttatccgtaagaaccagctcctcagccatctacattttgtcgtgagattgcagcaattcagtcccatcttccagctccacttctagttctcttgctatttccaccacatctgcagttccttcctctgatgcagtcttgaacccttccacgtcatccatgagagttggaatcaacttcttccagactcctgttaatgtagatattttgacctcctcccatgaatcacaaatattcttaatggcatctaaaatggtgcatcctttacagaaggttttcagttaactttgccgagatccatcagaggaatcactatccatggcagctatagcttacatgtatttcttaataataagctttgaagtcagttaccccgatccatgggctgcttgatgttggttagcaggctg

SEQ ID NO: 586193 - DNA, 2359 bp, Homo sapiens
  misc_feature (16)..(16): n is a, c, g, or t
  misc_feature (19)..(19): n is a, c, g, or t
  misc_feature (127)..(127): n is a, c, g, or t
  misc_feature (129)..(129): n is a, c, g, or t
tgactcagaggatgcnttngcgggcttttcccctctctcccactccactcctggctcagtcttagagatttctatgccctcatggattctacccctgccttcctggcctcttgattctgggcttgcntntcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcaggggttggggggtgggtgtgggggagccgttaggcctcccaggtccttaggatcagggttgcccccagaaccccttcccatatcctccattctccgccctgagttcctacccaggctgcctggccggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagcatcaataccaccattgctgcacttaatcatgtctctgttgaatttttccttttaaattttatcttttcagaattatatatgtattgtttttaaagtagaatagttttttttttgaggccaataataaataataaatgcaggctcctactctgatcctctcca

SEQ ID NO: 586194 - DNA, 393 bp, Homo sapiens
  misc_feature (35)..(35): n is a, c, g, or t
  misc_feature (135)..(135): n is a, c, g, or t
  misc_feature (167)..(167): n is a, c, g, or t
acaattaccaatactttttatacagttcatatttnggtacatcaacactattttatttacactctatttatgtacattaacatctttctaaagtcagtgcattgtcaacaagttttatacagtaatttacaaggngaatgtagttaatagttaatttaataaatttnctgctagttcatgccttcccaaaattaaccaccatcaccacccaccacacagctcaccaccccttagtagactcccctacctgcttccataaaacatctgtaaagacaattatttaaaatcttccactttttaatgggaatggacagattttatatactgaaaatcttgaacctataaagtatgcatttggtctgactttattacattagacaatttaggccagtc

SEQ ID NO: 586195 - DNA, 319 bp, Homo sapiens
  misc_feature (9)..(9): n is a, c, g, or t
  misc_feature (80)..(80): n is a, c, g, or t
  misc_feature (107)..(107): n is a, c, g, or t
  misc_feature (132)..(132): n is a, c, g, or t
  misc_feature (187)..(187): n is a, c, g, or t
  misc_feature (193)..(193): n is a, c, g, or t
  misc_feature (303)..(303): n is a, c, g, or t
gaattcggnacgaggatctctcttggtgcctcttttataagggcactaatcccatttatgaggacactgcccttattttnttaatcaccttccaaaggccccacgcntcctcgtgccgaattcggaggaagnagtctcgaggagggggactacaggtgcatgccaccacgcccggctaatttttggnattttnagtagagacggggtttcaccctgttagccaggatggtctcgatatcctgacctcatgatctgcccatctcagcctcccaaagtgctagattacaaggtgtgagccaccgngcccagccaagcatca

SEQ ID NO: 586196 - DNA, 4067 bp, Homo sapiens
aagggcggacggggggcggattaggattggggcacttacgcggcggtatagtggtgcgctgggcgggagagggtgtggggtcgacgggtggaccagcgggatcatggagcgcggcggaaggaggggggaagagaaaataagagaggggggggaggggggggaaggtaaaggagagggaggtggggggggggggataagagggggaacctcggtcaaggttagcgggcagggggctacaaaaaaaagagcgaggggggcggggggagggggtatttcacacataaccctttattcacccccaggtaaaccaagggaacatgccagggcttcagagcaccttcctagccatggacacggaggagggggtagaggtggtgtggaacgagctccacttcggagacaggaaggccttcgcggcgcacgaggtgagaccgctgccccctcctcatcctgcttgggtgaccacctgctgaccacccagcgaccaccctccctccccaggagaagatccagaccgtgttcgagcagctggtgctggtggaccacccgaacatcgtgaagttgcacaagtactggctggatacctctgaggcctgcgcgagggtgagcacgggcaaggccccgggcaggcagagaccacagctaggtggggcgggcatggggacgaacccgcagctggtggaaatcctgagctcgcaccgtgcaggtcatcttcatcacagagtacgtgtcatcaggcagcctcaagcaattcctcaaaaagaccaagaagaaccacaaggccatgaacgcccgggtatggggagcgggctggggcagccacggggacaggacggggttggggcagcctcggggactgggatggtgagggggtgcccggcggcctcggacaggggctgggcgaggatgcggggcgggctccgcaggcccagccgcctctcctgcgcccacccgaccgacggagtcgtgcgtccgccgccaggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcaggaatggaatctacccactgatgaactttgcagccactcgacccctggggctgccccgtgtgctggccccacccccggaggaggtccaaaaggccaagaccccgacgccagagccctttgactctgagaccagaaaggtcatccagatgcagtgcaacctggagagaagcgaggacaaggcgcgctggcatctcactctgcttctggtgctggaagaccggctgcaccggcagctgacctacgacctgctcccaacggacagcgcccaggacctcgcctcggagctcgtgcactatggcttcctccacgaggacgaccggatgaagctggccgccttcctggagagcaccttcctcaagtaccgtgggacccaggcctgacccggagccccagccccaggggaccatgccggggtgctgcctgggcaggccatgttggggagactccagcaccgtggggctgccctcctccatgcgcctgggagcacaaaggccccggtagtgaaggaaccccccgtctcctgagagtggggctgaccctgccttgggcgccgaggggttggggggtgggtgtgggggagccgttaggcctcccaggtccttaggatcagggttgcccccagaaccccttcccatatcctccattctccgccctgagttcctacccaggctgcctggccggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgttggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagcatcaataccaccattgctgcacttaatcatgtctctgttgaatttttccttttaaattttatcttttcagaattatatatgtattgtttttaaagtagaatagttttttttttgaggccaataataaataataaatgcaggctcctactctgatcctctcca

SEQ ID NO: 586197 - DNA, 3992 bp, Homo sapiens
  misc_feature (3940)..(3940): n is a, c, g, or t
aagggcggacggggggcggattaggattggggcacttacgcggcggtatagtggtgcgctgggcgggagagggtgtggggtcgacgggtggaccagcgggatcatggagcgcggcggaaggaggggggaagagaaaataagagaggggggggaggggggggaaggtaaaggagagggaggtggggggggggggataagagggggaacctcggtcaaggttagcgggcagggggctacaaaaaaaagagcgaggggggcggggggagggggtatttcacacataaccctttattcacccccaggtaaaccaagggaacatgccagggcttcagagcaccttcctagccatggacacggaggagggggtagaggtggtgtggaacgagctccacttcggagacaggaaggccttcgcggcgcacgaggtgagaccgctgccccctcctcatcctgcttgggtgaccacctgctgaccacccagcgaccaccctccctccccaggagaagatccagaccgtgttcgagcagctggtgctggtggaccacccgaacatcgtgaagttgcacaagtactggctggatacctctgaggcctgcgcgagggtgagcacgggcaaggccccgggcaggcagagaccacagctaggtggggcgggcatggggacgaacccgcagctggtggaaatcctgagctcgcaccgtgcaggtcatcttcatcacagagtacgtgtcatcaggcagcctcaagcaattcctcaaaaagaccaagaagaaccacaaggccatgaacgcccgggtatggggagcgggctggggcagccacggggacaggacggggttggggcagcctcggggactgggatggtgagggggtgcccggcggcctcggacaggggctgggcgaggatgcggggcgggctccgcaggcccagccgcctctcctgcgcccacccgaccgacggagtcgtgcgtccgccgccaggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcaggaatggaatctacccactgatgaactttgcagccactcgacccctggggctgccccgtgtgctggccccacccccggaggaggtccaaaaggccaagaccccgacgccagagccctttgactctgagaccagaaaggtcatccagatgcagtgcaacctggagagaagcgaggacaaggcgcgctggcatctcactctgcttctggtgctggaagaccggctgcaccggcagctgacctacgacctgctcccaacggacagcgcccaggacctcgcctcggagctcgtgcactatggcttcctccacgaggacgaccggatgaagctggccgccttcctggagagcaccttcctcaagtaccgtgggacccaggcctgacccggagccccagccccaggggaccatgccggggtgctgcctgggcaggccatgttggggagactccagcaccgtggggctgccctcctccatgcgcctgggagcacaaaggccccggtagtgaaggaaccccccgtctcctgagagtggggctgaccctgccttgggcgccgaggggttggggggtgggtgtgggggagccgttaggcctcccaggtccttaggatcagggttgcccccagaaccccttcccatatcctccattctccgccctgagttcctacccaggctgcctggccggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcccgtggcccaatgcatatcccattgtattntctccttttatttgattcttaaattgtatcaaaaccaccattgatgcactta

SEQ ID NO: 586198 - DNA, 354 bp, Homo sapiens
caaagagaaacttgggacatgtgctcaaattggtgacatgttcaaaaatgttcactgcaaatattcacctagttgggcaggtgtggcagctcacacctgtaatccccacactttgggaggctgaggtgcgaggattgcttgagcccaggagctgagaccagcctgcgcaataaggcaagaccctgtctgcagacacatcaacaaaattagccaggcatgctagcacacctgtagtcccacgctacttgggacggctggggcgcgacgactgcttcagcttgggcgcgtccagcctgccgtaagccacgctcccccgctcgggcaacacactgacgaccctgtctcaaaaaacac

SEQ ID NO: 586199 - DNA, 3956 bp, Homo sapiens
aagggcggacggggggcggattaggattggggcacttacgcggcggtatagtggtgcgctgggcgggagagggtgtggggtcgacgggtggaccagcgggatcatggagcgcggcggaaggaggggggaagagaaaataagagaggggggggaggggggggaaggtaaaggagagggaggtggggggggggggataagagggggaacctcggtcaaggttagcgggcagggggctacaaaaaaaagagcgaggggggcggggggagggggtatttcacacataaccctttattcacccccaggtaaaccaagggaacatgccagggcttcagagcaccttcctagccatggacacggaggagggggtagaggtggtgtggaacgagctccacttcggagacaggaaggccttcgcggcgcacgaggtgagaccgctgccccctcctcatcctgcttgggtgaccacctgctgaccacccagcgaccaccctccctccccaggagaagatccagaccgtgttcgagcagctggtgctggtggaccacccgaacatcgtgaagttgcacaagtactggctggatacctctgaggcctgcgcgagggtgagcacgggcaaggccccgggcaggcagagaccacagctaggtggggcgggcatggggacgaacccgcagctggtggaaatcctgagctcgcaccgtgcaggtcatcttcatcacagagtacgtgtcatcaggcagcctcaagcaattcctcaaaaagaccaagaagaaccacaaggccatgaacgcccgggtatggggagcgggctggggcagccacggggacaggacggggttggggcagcctcggggactgggatggtgagggggtgcccggcggcctcggacaggggctgggcgaggatgcggggcgggctccgcaggcccagccgcctctcctgcgcccacccgaccgacggagtcgtgcgtccgccgccaggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcaggaatggaatctacccactgatgaactttgcagccactcgacccctggggctgccccgtgtgctggccccacccccggaggaggtccaaaaggccaagaccccgacgccagagccctttgactctgagaccagaaaggtcatccagatgcagtgcaacctggagagaagcgaggacaaggcgcgctggcatctcactctgcttctggtgctggaagaccggctgcaccggcagctgacctacgacctgctcccaacggacagcgcccaggacctcgcctcggagctcgtgcactatggcttcctccacgaggacgaccggatgaagctggccgccttcctggagagcaccttcctcaagtaccgtgggacccaggcctgacccggagccccagccccaggggaccatgccggggtgctgcctgggcaggccatgttggggagactccagcaccgtggggctgccctcctccatgcgcctgggagcacaaaggccccggtagtgaaggaaccccccgtctcctgagagtggggctgaccctgccttgggcgccgaggggttggggggtgggtgtgggggagccgttaggcctcccaggtccttaggatcagggttgcccccagaaccccttcccatatcctccattctccgccctgagttcctacccaggctgcctggccggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacctggctggcatcctctgggaggagggcggtcacctgcctcagtctcctggcggcatcattccagtgttacgggcatcatagctgcatgggtgttattacagcttcattaccacacgtctcaggagagaacacggtgttctaggatggcatttcttgcacaactttttgttttccctggagttaataattgccttttttttggtttgccta

SEQ ID NO: 586200 - DNA, 1250 bp, Homo sapiens
  misc_feature (16)..(16): n is a, c, g, or t
  misc_feature (19)..(19): n is a, c, g, or t
  misc_feature (127)..(127): n is a, c, g, or t
  misc_feature (129)..(129): n is a, c, g, or t
tgactcagaggatgcnttngcgggcttttcccctctctcccactccactcctggctcagtcttagagatttctatgccctcatggattctacccctgccttcctggcctcttgattctgggcttgcntntcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagcatcaataccaccattgctgcacttaatcatgtctctgttgaatttttccttttaaattttatcttttcagaattatatatgtattgtttttaaagtagaatagttttttttttgaggccaataataaataataaatgcaggctcctactctgatcctctcca

SEQ ID NO: 586201 - DNA, 737 bp, Homo sapiens
gagggggcaagagccaaggaatgtaggcagctctacaagctggaagtgagcttagtttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagcatcaataccaccattgctgcacttaatcatgtctctgttgaatttttccttttaaattttatcttttcagaattatatatgtattgtttttaaagtagaatagttttttttttgaggccaataataaataataaatgcaggctcctactctgatcctctcca

SEQ ID NO: 586202 - DNA, 248 bp, Homo sapiens
  misc_feature (183)..(183): n is a, c, g, or t
  misc_feature (188)..(188): n is a, c, g, or t
tcaaaggagattgttctggagctttaagatgtaatataatcccagcagttagaaagcccaatgcaatagggtcacatgcgcccaggagttcaagaccttcctgggcaacatagggagaccctgtctctgtgaaaagtaaaacaaattcgcctgccttgttccccccccctttttcccttctcnccttnaatccctgaggtaggagggtcagtagggtccaggagattgaggctgcagtgagccatgac

SEQ ID NO: 586203 - DNA, 3465 bp, Homo sapiens
aagggcggacggggggcggattaggattggggcacttacgcggcggtatagtggtgcgctgggcgggagagggtgtggggtcgacgggtggaccagcgggatcatggagcgcggcggaaggaggggggaagagaaaataagagaggggggggaggggggggaaggtaaaggagagggaggtggggggggggggataagagggggaacctcggtcaaggttagcgggcagggggctacaaaaaaaagagcgaggggggcggggggagggggtatttcacacataaccctttattcacccccaggtaaaccaagggaacatgccagggcttcagagcaccttcctagccatggacacggaggagggggtagaggtggtgtggaacgagctccacttcggagacaggaaggccttcgcggcgcacgaggtgagaccgctgccccctcctcatcctgcttgggtgaccacctgctgaccacccagcgaccaccctccctccccaggagaagatccagaccgtgttcgagcagctggtgctggtggaccacccgaacatcgtgaagttgcacaagtactggctggatacctctgaggcctgcgcgagggtgagcacgggcaaggccccgggcaggcagagaccacagctaggtggggcgggcatggggacgaacccgcagctggtggaaatcctgagctcgcaccgtgcaggtcatcttcatcacagagtacgtgtcatcaggcagcctcaagcaattcctcaaaaagaccaagaagaaccacaaggccatgaacgcccgggtatggggagcgggctggggcagccacggggacaggacggggttggggcagcctcggggactgggatggtgagggggtgcccggcggcctcggacaggggctgggcgaggatgcggggcgggctccgcaggcccagccgcctctcctgcgcccacccgaccgacggagtcgtgcgtccgccgccaggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcaggaatggaatctacccactgatgaactttgcagccactcgacccctggggctgccccgtgtgctggccccacccccggaggaggtccaaaaggccaagaccccgacgccagagccctttgactctgagaccagaaaggtcatccagatgcagtgcaacctggagagaagcgaggacaaggcgcgctggcatctcactctgcttctggtgctggaagaccggctgcaccggcagctgacctacgacctgctcccaacggacagcgcccaggacctcgcctcggagctcgtgcactatggcttcctccacgaggacgaccggatgaagctggccgccttcctggagagcaccttcctcaagtaccgtgggacccaggcctgacccggagccccagccccaggggaccatgccggggtgctgcctgggcaggccatgttggggagactccagcaccgtggggctgccctcctccatgcgcctgggagcacaaaggccccggtagtgaaggaaccccccgtctcctgagagtggggctgaccctgccttgggcgccgaggggttggggggtgggtgtgggggagccgttaggcctcccaggtccttaggatcagggttgcccccagaaccccttcccatatcctccattctccgccctgagttcctacccaggctgcctggccggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagcatcaataccaccattgctgcacttaatcatgtctctgttgaatttttccttttaaattttatcttttcagaattatatatgtattgtttttaaagtagaatagttttttttttgaggccaataataaataataaatgcaggctcctactctgatcctctcca

SEQ ID NO: 586204 - DNA, 110 bp, Homo sapiens
tgtttgcgcctcagcatggaggaggcgtgacaggcgtcacggagtctgggagtagtacaaccacgtcagggtaggttagtacctggttaggctttgtgtactagtgttcc

SEQ ID NO: 586205 - DNA, 107 bp, Homo sapiens
atattatcacctggcatattcaaaagggacttatcttttcctttgatctgcaatcctctcttttcccccaacttttttcaatcttattccacaaaatataccgggat

SEQ ID NO: 586206 - DNA, 162 bp, Homo sapiens
tctagaggatctcatttggcgaggcagtctcgtgcacaatccttaaaggtgtcgtcctgtacgctgctactcctgggtcaaagactgaacggcctggatctatgtctcagagtcgatttccatggtattgctgggtttccctactttgaactacttgtattc

SEQ ID NO: 586207 - DNA, 1042 bp, Homo sapiens
cccaagcgttcgatagaattatacagcagatagttatccaggaatgacacaggacaggaccctgagtccacaccttaggaaaacaatagattattaaggaattgtcggtacgaagtgttggttaatgaaaatgaagttaagcagtggaaagaacaggcggaagaagcatgagagaagagcacaatgagctacagcagaaactggaaaagagtagaacgagaatgtgatgctaagactcaagagataggaagcacgtatgatgcagaccgttaaataaacatgaaagagaaacttgcaagaggcagactcactgagcatcaagcaagtcgaagcagctaggtggcggacctcacagaactagctccaatgagctcagctaggaggtgccagtctgtagcttcgaatcccaggtggaccctcgacctagggagccaccaggaagggccctgttgccttgccatctgtgcctgagcaattcttcgtcccgtaatcacatccccacccaaggatcaccgacacacgatcccaccgcgaaaccaacagagcgtcgaaggccaacacccccccgcgcgtacaagatacatgacacacacaaaacgaacaaagaacaaaccgatcagaaccgcgacccgaccgcacaacgaactagctacaaagcaaaagggtgaagacaaaaggagtaacgggtaggtccagccagtcaccagatggacagaacagaggagacgcccagatgcgcgaaggtgaacatagacaccagccagggagcccccctgccaccaccaccgacccagcccaacggcacacccaccacacaatagatctgcgcgacgacgacccagccggcgagaagagcggcgcgacggaccatgaggcggaaccggcgaacatcaccacaacgatgggggcacagaggcacgagacgcagcgggagcgacccgcggaacaacataggcgaccgacgtccagccgaccggccggacataccagcctcaggagggagagcggcgcgacagacagagagcgggatcagcccaggacc

SEQ ID NO: 586208 - DNA, 242 bp, Homo sapiens
  misc_feature (32)..(33): n is a, c, g, or t
ggaacttagttttggtttaagtcatttttganngcttttttccaatggaaaatgtaaaaaccaggttttagcaaaaagcccccctttggctctttttgggaaatgttctttatattttaatgtgaggaaaaaccctaagaaccaactaaattgtgatttatgatcttcctttattttaatgggaaaggttttaaaaaatgttcccgattggccatattgtaaaaaaaacatgtttttttcca

SEQ ID NO: 586209 - DNA, 214 bp, Homo sapiens
ggtatctacacggatccccgagtgggtctgcatcaggagaagctcgtgacaggtgtcagttgctgcgccgagggacgagctcggtttgcgcattcagacctaaccagttgaagctagagtctacagccactaaatttgcttcaggccaccattagtttctcacaacttagtaccttacttgctcttgaggtccactactaaaggggaggtaggt

SEQ ID NO: 586210 - DNA, 126 bp, Homo sapiens
gttttaaaaaaaaaaaaaattttaaccccccctgtggtaagggtttttttttccctggaggggaaaatttttcctttccccaaatccccctttttaggtctttcctttattaatttttccggggga

SEQ ID NO: 586211 - DNA, 874 bp, Homo sapiens
caagacacataacgagttggtacagctctttaactttttgtgtcaaaattatgtctcatagtaccgtaatatctggaccattaaaatgatgtgactgtgcacttcaaccttgtttcccagtgaccagtcaacccactttagggttccaaactggaaagggccccatgttaacaccggccaagatggccgtgccaaaacatatacggtgccgacacgaaatgtttttcatagaaaagcgcctaatgccagagtcccaagtggcacagaaacccctgggacaagccaccaatcctttcaacgtttgaaatctgtattgaacatagcggtccccaagaggtttaatgctgtaacacttctgccttcgccggcgcggagtatatccgccaccttcttgtgagtgaagggggccccatccatgagccccaccgcaaacttttgtggagacgtctgctggaaacaacaacgcccacggcgctcccacaatggagcccccttgtaaacagtgtatttgaatgagtttcgccagccatttgtagaagaaatggcccacaacgcctgaccactattaaggagacctctccttttcccgagaggaaggggttaaaaaaaactgtgtggctgcaaaattctcaagcctgctcgctagaggcgtgtatttaacacactccagctttcaccagtcttcctcgccctcccctagagaattatagagaaaaaaatttatagagtccaaaaccttattctatatggttcttcttttttttggttggggttaaacgccaacaccccccgtctttagaaacaaaaaattttttaacatttcccctttttttttggttccaataaaaaaaaaaggggaaaaacccaaaaaaaa

SEQ ID NO: 586212 - DNA, 508 bp, Homo sapiens
ggagcacctagatgttgggtagctaatctggctttgctgttttggtgaaaaaagtcccatgtgttgtgggaacttggagctttctacatccctgcttagttttgtcaagtctgctggccagtaatcctgaaaaacatttgatgcgttgactgcccgcacagttgtcaatttggccagagtcagaaacatgaatttcactccttaaccttttcaagagatcttgacaaaaaaaaaaaaaaaaaaaaaaaaaaaaaaaagcaaactttggagttcattttgttaacacttacgtttactggttttctagagacccggtttggggtatgtgtgtgtggcgggggtgtggagagaatgcttgtgtttaaaaaagggaaaactgttttcacagggaggagtttactggtgggttggcttatttggttggctctcagcctttgaatgaggcctgtctttcaatacaaggctttccatcaacatgatgtgtatcctgctgaaaaagtaggatgct

SEQ ID NO: 586213 - DNA, 415 bp, Homo sapiens
ccgcaatttttttaccggtggaaacccccccctttggggggtttcctcggagaacccccccttgtttttcccgggtttttaaaaaaaaaagggggattaaagggtgtcccctttttggggggatttttattttagatttttttaatcccgggcccaaaggatttttttttttgtttttttttttttttttggttattttttttttttttttttttttttttttttttttttttttttttttttttttttttttttttttttttttttttttttttttttttttttttttttttttttttttttatataaagaccatattttttttttacttatatagattcatataaagagcacacacacacacacacacacacgtgtcttaatatactctctatagagtagagtttctcgtggc

SEQ ID NO: 586214 - DNA, 423 bp, Homo sapiens
  misc_feature (282)..(282): n is a, c, g, or t
  misc_feature (374)..(374): n is a, c, g, or t
  misc_feature (398)..(398): n is a, c, g, or t
  misc_feature (418)..(418): n is a, c, g, or t
tttttttcttgagacagggcctcatcctgtcacccaggctggagtgcagtggcatgaacctggttcactgcagccttgacctcctgtgctcaagcagtcctcctgcctcggcctcctgcagtagctgggaccataggtgcatgctgccacgcctggctaatttttaaatttttttgtagagacgagatctcactttgttgcccagcctggtctcaaactccaggtcttaagtgatcctccagcttggcctcccaaagtgctgggattacaggcatgagcctntgtgtctggctctaattttcttttgatcattggaattcagggactttttttccaaccagggtatgccttggttttgtgtttgtataacattnaaccctgccttttagtccatgccntttttcagtgttcaggtttnaagta

SEQ ID NO: 586215 - DNA, 206 bp, Homo sapiens
ggatgctggaggggatggagaatgtagaggtgctgagagcgaggagagaggaaaaatcaaattaaagtagatcttgtagatgagaatgttacagaattaagaggagaaatagcaggactccagacacaccatatgaaggaggaagataccaactagagataaaaataccagaaacatacccatttaatccccctaaggtccggttt

SEQ ID NO: 586216 - DNA, 358 bp, Homo sapiens
gaggaaagccacgaatgtgaaagagagaggtgaaaacaatcagaaaaaaggaattccagggaaatggagacatggggccaggcacggtggctcacgcctgtaatcccagcactttgggaggccaaggtgggcggatcacgaggtcaggagttcaagaccagcctggctaacatggtgaaaccctgtctctactaaaaatacaaaaaattagctggatgtggtggcacatgcctgtaatcccagctacttgggaggctgaggcaggagaatcgcttgaacccgggaggtggaggttgcagtgagccaagatcgcagcattgcactccagcctgggtgacagagcaagacgctgtcttga

SEQ ID NO: 586217 - DNA, 1195 bp, Homo sapiens
ggttagcatcatgtgacctccttgtagcaaaagacttgtggatagcagcaaagacctgatctttatgtcccggcacatctcatgagtgccacctactcatgtagaggacaacgctgctgatgacattgaaaaaccactctcatacacgagcgcagtgacaggtagtcacgcatgtttggactgttgagagagagagtgcatagctgcgacaggaacgcagatgacatcttatgggtgaaggaggtgaacaagcaagataacgatgttgattaatgatagaattaaggtacagcatgttgagagaattctggctaaagtaatgcgatcatatagtgcaaaatcaataattggtaagggcctgcctttgggtaatgcaaaagtgcgagagcacatgaagaagacgcgtgtagccagatagagatactcgcgccttcaccgtttctcaatgtatctaacttggttttgcatcggagtgggctcattccagcatggggcacgttaccacgattcgtgttcacatttaacgcaaacgtggcgttttctcctggttttccttaggggcgggtataacaacacttggggataccggaccacagaacaacttgtgagcacgagttttttaaactttttacaactcagggtccgctcatgtgctgctgctgctcaagagctgggacccatcacgggtggggtgtcatctggtcctctggaggtccaggagattctaaatggacttttccagggttggggacagcatccggaagttttccctatgacttcatataggggataatgtcacagtgttagggcagggcccaaatagcatagcccacaaggttggggtaatggggggataaaatttctaccaaacccagaacttgggacgccttgggagaaagcccgtatatgtgtggtgtcttcaccctaattaaggttgtagcgacacaaacggcggaacgggaagcaaccaataacgggcgccaacaggtaagcaccctcggtactccagggggggatctcctgagggaccactgtgcagcagattatacgtacagaaccccaattgttcgcaagggcccagtacttgttgctacaaccacttgtgcgtttaatcaaacagcacaagtcggctctttgtgaaaaatgagtagctgtgttcgccccttaagaagcccagtataatcacgatgcgcaa

SEQ ID NO: 586218 - DNA, 236 bp, Homo sapiens
aggcccccagccccccccccgggggggtccggggggccctggaattaataaaggggggggcccgtccgctgggccccccaacccgccccccttgatggcccccaaaagggggtttttaacccccctggggggggttaaagggggggggggggtttggatttttagttatttttttttccgttttaaaaaactttttttttaaaaaacaaaaaaccccttttcccccggggaaggga

SEQ ID NO: 586219 - DNA, 880 bp, Homo sapiens
gacggcccgtttgcagccgccggaagctactgcaagggcaaaagcctggagtggaacggtgtctatgtgaaactggctgctctttcaccttctcacggctgtcacctgagagctcagcactccagtgcttgacacctctgtacccatttgggcacagaactggaaggctgattgcatctagtgagacatgctataccaagacgtacattggaagccatcagactggctttcaggagctaaccgaaacctggtgtgcacagcaacatactggcgatttctggccacattcacaccacaaccttggcattccagtcagtgcgcattgcaaggcactgcacaactgtgggaacaccggcctatctaccagcaaacctcaccgcacttcccagggcaccttaagggcacataggactcaacacctgccatgcacaccccacggacaatgggcgctttcctctcaacagtgcacactggggggcacaactacccaggaaggaacaacttccccctatagttgaacaacagcacgcaccttttatagctacataggacagggttccaacgggcagacgagggcaccaccatggtaggcattatggccaacttttctcttacccacggatgcacctgcccacgcactttcccagggttgttacccgcctactttaacgaacccagggaccgaattctgggcgccacattaaatttggtcccaagacgacaaaccacccgttcgtaaggcacctcacaaatattagtggcaacgcctgtaattggtggtcacaacacggcaccctttccctatgggtagaccgagcacggtgcgtattccagacgctcatttcccccagaaatatgccaagtggctaacaagcgactg

SEQ ID NO: 586220 - DNA, 247 bp, Homo sapiens
tatccggttcaatattcaaaatgcgatctagagccgggagtggtagctcatgcctgcaatcccagaactttgggaggccaaggcgggtaaatcacttgaagtcaggagttcgggcccagcctggccaacatggtgaaatctcgcctctattacaaatacaaaaattagccaggtgtggtggcagacgcttgtaatcccagctacttggaaggctgaggcacaagaatcgattgaaccggatagcttg

SEQ ID NO: 586221 - DNA, 411 bp, Homo sapiens
atctctatcatcatcttagtgactgcatagtattctattcccgtgttgacatattataatttatctaaacagtttgctattgaatctaatttatatgatttttaacatttttacatgcgtaaacaatgccgtgatgaacatcacttgcttaaacccgttattaaattactgactgcaaaaaaatttctataatatgtaaaagcttaaatctgataaaaaatatgtgcacatcatattgatatatgtatcaaaattttggaatactttcaagatatattctgcatttagattgacaaatggaaaactaaaaacgaatattatttttcatttttctgagccaacttgctttacattattgtgattattaacatatatgaaaactatgaaactacaaataaaatttaaaatgtt

SEQ ID NO: 586222 - DNA, 226 bp, Homo sapiens
tggtgactagggctcacaaatgcttcccactccatcatactagcaaaataatttgatccagtgaataactaatcaaagaaaatctaagaagagaggaagtggaaggagggaagccctttcactgcacacttgggatgaacagatgcttttaaagtgaatagcacaaaaacatcttttcacgatgaagttgggatacaagcagtcaactgacatctctcagcagcat

SEQ ID NO: 586223 - DNA, 890 bp, Homo sapiens
  misc_feature (98)..(98): n is a, c, g, or t
agcggagcgggcgaagctagcgagcgagaggcatccgctgccgcgctcgtccgctccctgcctctgtatgccagctcctcttcccgggcgcggccgtncgcgctggatcactaggcagtccaggatgccaacccgaccgcttcgtcggtatgattgttggtttgtggcctgggaggacttgacgtgatggccgcgccaagaattgactcgacagttccaatgttcccagggaaagatcgacgaatcctgggtctagcggtctgtgggattgaatattctatctttcctcagacatagctccatagatattacatggttatattgctatgtgtagttgcttgttaacatcagatctaaaatgttttgaatgtgatttaagaggttatctcagtggcatagatttgtcggagtatggtggtgggaaagtactaaatacgcgtattattgtaagggttgggaagataatgaaaggaccttgcatattggaaaagggtgaatcagctatatgaacgaaggagacaacggctttgcgcagaatcctttgggaagtagccaagatttattctgcggcaaatccttcgttggttaaacgcaacaatccagacattgcctcgtgcgcatgtttatccgcataccgtgaataatcttattgggatggcaggaaacaaaagtgggacaggggccagactttcctagaggcgaatgtcggtcgattgcctctggtgatcgtagattcatcgggtgcaaaagcggcgtgaggtaaacctggggaatgatgatgcttaccgtgcacagcaagctaaattggccggttcttcctttgaaggataagacttgatgcatatccttttggcttcatgtcaaccctgtaacgtattccattggggtcg

SEQ ID NO: 586224 - DNA, 726 bp, Homo sapiens
gacaagaatctatcattgtaatattaacagtgcaaggtgtcatgtgcttggacatagtgaaagataattggagtccagcactagccatttctaaagtcctcctttctatctgctcacttcttacagacgtgtaatcctgccgaccccttggtgggaagtatgccactcagtatatgaccaacagagcagaacatgacagaatgggcagacagtggaccaagagatacgctacataaatggggtctcacaattcgttacattatttgtctgtcacagaagagagcgtcttatgatttgaaggggtcagggagggtgggagtcggaaagagtaggggattctatggacagatattatgccagtctgatttcctaagattgcgtgtaacttaaggtatctgtgcgacagtagacagaatcggtgaatagcaagttaagaatgtcatgagttctggaatatgagctgaaatgtagtacagaagaagaatgtacgtttagacattcgggttcagtgcctgtaggctgtaaactgtaccacagccttactttggtacaggttacggcatatgggcatttatgtaaagtcgctctaagactacatacgtttagtttcacaacccaacgcatggaatcggtgtgcccttctgggaagggaccttgatattcaccagcagtccagacagtgccactcctatatataacacgggcccgggcataaaccccttcaca

SEQ ID NO: 586225 - DNA, 922 bp, Homo sapiens
ggtttcaaaacttttgggcacagataacttgggtttccagtcactccggacacattttcctaaaaataggctttttaaacctaattttgggaaaacgctgttttcttctggagcacccttgatttcggaaatgtccatcgcgaccggggccccgacctcttctaaagtcccggagcttaaatttaggggcccgtttaaagtgttaacttatttgaacttgaaattttcttgcccaatttcggtttagatcccaggggtttaaccacagggtaaacttgggggaatggaagtgtataccgccaacgtttctttcacggacgcctttttaaggaaccttattgggcacgcctcttaagaaaggctgtttctttgttttttaagcccaaagggaggagacccccccgccacgcgtttttggaataactatgaaaaaaagtccactcttggcttgtacactaattggccactctttatgaaaagcttctgaatgtgaaaatcacaaatgtttgacctcctcggtaacttaaaagcccaccacacttttaaagcgcacgtaagttttatactcggccactttaaagcttctttgtgaccacagtggtgcacaatttgtaaaaaaagaaaaaacgagaaaaaaattctccacattaaaccactgaggaataaccacttttaaagacttcccaaatcacagaagaaagtgcttcacaaattaattttgtttggagattaaatttttaaaaatgtaaagcactaatacttgttgcttagttattttgtttattattttcactgtttgagtttctgtgccatatttttctattatgtccgcttgataggaccacgtgaccacaatttcgtaagtgaataacttaatttataaagtgttaacattaaagctccataaaccaatttcctgcca

SEQ ID NO: 586226 - DNA, 116 bp, Homo sapiens
cctggaaagaagcaggagatgaatctgtatctcgagagaaccgagcagcataggcatataggtcgatgagccccgtgtgccatccgctgcagcagaaacggtgcatcgaccatcct

SEQ ID NO: 586227 - DNA, 693 bp, Homo sapiens
gtcgggtctgctttccaacgtataggacatttgaagaactggtatgctactcacgtggctgaaggacagtcaggtgcaaggactgtaagcccacacaagctcttcttatctctactagaattaaaatgttaagtcaaaaacggctccttttttgcgcctcctagtgaaacttaaccagctagaccactttgagtaccagcatttagttacaaacgtcaaaggcttccggtgctgcttaccttccttttttgttaatgtgcttttatttattaacacaaaacaattacaatgcaagatgcctgttatgtctctactgtgtactctgatcgtatctttccaaagtgcagactcttgctgaagttttcttaaattgttcactttaacagacaaatgacgtaccaacaactgactttggcttcttatattactgtaacgcatgcccataactgttaactgtgcgatgtagctgcttttacctttacagacttgacttggacataagattattgcatatgaatttacccacaggacctctgactcactgttacccaactcccctcacaatgttgtccacttagctgagttgcattgatctatccgttaccaaactgactgttgactaattacatatcttccttgattatactgatttcttatttcggctcactattacttaaatctctgtcaactatt

SEQ ID NO: 586228 - DNA, 299 bp, Homo sapiens
ggggcccgcttattcaatatgtactcagatagtacgccgggacaggacgtaaggagtcaatgacctagcttaatcccatcactgatgctagcagactcctttgcacaactgattagctatcgtaactaccacaggtattcttagctgctagatcattctgtgcatgggattaagctaggtcttgaactcattaactccagttccttggctcctacagagtacatactgaataaggcaaaatcgactcacctctttggtatcgctcccctgtggtagaattctaggggtacagaccgtcg

SEQ ID NO: 586229 - DNA, 339 bp, Homo sapiens
ggggaggcccccagtgatgccagcccttaggttccaagagcccccaaccgggacccaaccctgcctccttgggttaggttttggcctgggcactcaccccctggtttagaccccttttcaagggttggccttcagggacccctggtgggtttgcctgcttgggccacccttcctgcttgggcctccccttggcctacttgggccagcccccaccacttggcatgccctcttggggccaaaagtgggcctgcaacccacccacttgcctgcccacccaatttttgggggctccccattttgcccaggccttgagtgtccacattaaatgggtttccccca

SEQ ID NO: 586230 - DNA, 341 bp, Homo sapiens
  misc_feature (104)..(104): n is a, c, g, or t
atgcacacgtctgactcccaaagtgccgggattataggcacgagccaccatgcctggcctcatttattagttctaacgtgtgtgtgtgcacacacgccctttcngcatttctacttataagatcctatctgcaaatagagataattttacttctttcttttcaattttgatgccttttatttccttttcttgcctaagtgtgccggttagaacttctagcactgtgttgcatagaagtaatgaatgcagacatccttgtcttgttcctaattttagaggaaaagctttcagttttcaccattgagtgtgatgtggctttttcatatatgacttttattatg

SEQ ID NO: 586231 - DNA, 104 bp, Homo sapiens
cagcgtgcagcccatgtggtgtttggttttttgttcttgtgctcactttgctgcgcccgcatggtctcccagcttccattccatgtctctcacacacaggcacc

SEQ ID NO: 586232 - DNA, 312 bp, Homo sapiens
agccgcagatttagataccttacattctcgctttaagagagagaatgtaagggctggtgcggtggctcacacgtgtaatccagcactttgggcggccgaggagggtagatcacctgaggtcaggagttcgagaccagcctggccaacatggtgacaacccgtctctgctcagaatacaaaaattagccgggcgtggtggcgcactgcctgtaatcccagcaacttgggacggctgaggtaggagacactgcttgaacccaggaggcagaggttgcagtgagccgagatggtagccattgcactcctgcccaa

SEQ ID NO: 586233 - DNA, 126 bp, Homo sapiens
cagagaactctgacgggtatgttgcctttgaacttgaagtagcttctccaatctccctgcccaccctaagctctccatgacatccactgtaattccctaaatgcaggtgcagcttccggaagagga

SEQ ID NO: 586234 - DNA, 264 bp, Homo sapiens
tacggtccatgaggatgggcgagctcagtgtgactggattacttaactgtagaatttccagtagcacattgcaggcaggaaggaacttggtaagaaaaattctgccactgccggtatgcttcacagtgcaggaaagagcagacaggagagttacgaagcgacctgaattaatattctgtttttattagtcacccaggttcgaaaatagcctccaatttaatcttactttctgccgtaagatctctttgtgtatcagtatcccat

SEQ ID NO: 586235 - DNA, 509 bp, Homo sapiens
gcacgagctcgtgccggtctttgttcagtgttaccactcaccggggttgaaaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagaacgtggtccggcagggcctgttgtggaccttgccacccccctaaccggaccgactgacctgtctttggaaccagaacatcccaagggaacttcttcaaactggcgtggagtgggacccccgggtccaggctggcccaaggcgggcaccctaagggctgggccccgctgaagtgctacgtgggaggcagaacaaacgccaaggtggccccaaaaaccccaatggttttttggtggggggaccaagggctaggggagcttggcccaacttt

SEQ ID NO: 586236 - DNA, 880 bp, Homo sapiens
attctgtcttgttctctattccatcacgttgtaaatggttagcatatgtttattgaatgaatgagaatcacctcagtgccagtggcaagagggtggtctgactggcataagaggatgaactgggactaaaagtgggtagcagttgagaacagccacaattactaggatgaggggcttaataaaaattaatttccaaggtgggaaatgatataatacacattttcttagaaagtaattctagaagtatagaatttaaataggaggtaactatttagaaaggttcttaagggtttagaccccaattgtaagcacatatctgaagaaggcattctctgtttatgggcaacttaaaatctagcaagaagaggtaattacctaaaaccaagatgcataattaggaagaggttctgtgtatattttgaagttgtagattttttggtgaatatgagttcagggaaaaggacctgtgtgttttaggcactgaaataggtctcttcaaaaaggccaagaatcactgaaatgtaggttcagtttttgctgtagaactcttagattcttagagtccttaatttctttttaggggttatttttataatgtaattcctttagtaaacctgcttaacatttgcaccatcagtgacattttgccttttttttcccccgatttcaaaacatttgtgtggtatatgtcagaaagtgttctattcttaccaataaaaccaagcctggcacggtggcgcgttgcctgttaattccagctactccaggaggttgacggtgcggacggacatggcggttgagcccggcctgggcaaaattagtgagattccatctaacaaagaagtttggctgggccccggtgcccacgccttggggtcca

SEQ ID NO: 586237 - DNA, 342 bp, Homo sapiens
tataaaatatgatattaagtcagttactaatagttttagtccatatatgttaatagaaaaggccaggtgcggtggctcaccctgcaatcccagccctttgggaggccaaggcaggtggatccctgaggtcaggagttcaagaccagcctggccaacatggtgaagccccgtctttactaaaaatacggaaaagttgccaggtgtggtggtgggtgcctgtggttccggctactcgggaggctgaggcaggagaatggcgtggacccgggagatggagcttgcagtgggctgagattgcgcccctgtactccagcctgggagacagagtgggactccgtctca

SEQ ID NO: 586238 - DNA, 179 bp, Homo sapiens
gtgtggtgttatgattccatcacactcacaagtacagattctaatcagaaccacaaattgatctgtcgggttaaggagttattcttaatcggagcacaactaaatgtcggagtaatggcttatactgacggttatagcctaataccgtcggtgttactcactaataccgacggtattag

SEQ ID NO: 586239 - DNA, 459 bp, Homo sapiens
acttcatacagatacaaacactactatacacagatactctcgtctctctctagagttaccctccatagtgtgtgagttccacatccatggattcaaccaaccacacatcaaaaataattggaaaaaaaggatggttgtgtccgtatcgaacatgtaccaacttcatttcttgtgattattccctaaagtatacagtgtaacaactactgacatagtatttacattgtattaggtataaataatctagagatgggaccaggtgtggtggctcacccctgtaatccctgcactttgggaggcgaagatgggtggatcacttgagctcaggacttcaagaccagcttggggaacatggtgaaaccccatccctaaaaaaaaagagctacaaaaattatctgggcatagtggcacacacccgtcgtcccagctacttgggaggatgaggtgggaggattgctt

SEQ ID NO: 586240 - DNA, 990 bp, Homo sapiens
aacgcagtccatggctcgtggtcccaagaagcatctgaagcgggtggcagctccaaagcattggatgctggataaattgaccggtgtgttagctcctcgatccatccgaaccggtccccacaagtagagagagtgtctccccctacagtacatttgccttgaggaacaacacttaaagtatgctcctgatccggagcatgaagtaaagaaccattatgcatgcagcaggtgtcattcacataggagtctgactgcgtggaaggatccgaagctgatagtaacgctaccctgactggtattcactggtatgtcatcgaggctattgacatacgacgggagagaatttccgtctgatctatgatcatcctaaagggtctgcgtttgctgtacatcgtaattacacctgaggaggccaacgtactagagttgtgcaaagtgagaaagatctttgtgggcacaaaaggaatccctcatctggtgactcatgatgcccgaatcatccggtaccccgatcccctcatcaaggtgaatgataccatttcagatcgatttagagactggcaagattactgatctcgtcaaatggttcgacactggtaacctgtgtatggtgactggaggtgctgacctaggacgaattggtgtgatcaccaacagagagaggtcctgggatcttttgacgtggtgcacggtgaaaagatgcgcaatggcaacagctttgccaatcgacgttccacactttgtgttgattggcgaggcaactgaccatggatttccttcccgagggaaggggttccggcgcctccatggtggagaaaagggaacaaagagtggggccaccaacagggacaagggcccggggagagtggcacttgcggcgtggaaatgtggggggcaacaacacgggggcgaaaacacacgggggaagcccctgtgaaggccagagtctaaaaagcgcggcccagaagcggtggagactggggcacacct

SEQ ID NO: 586241 - DNA, 120 bp, Homo sapiens
cccccggggccccgggggggggaacccccccttttttgggggggggggggttttcccccgggggggggtccccccccaaaaaaaccccccctttttttaattgggtttttttttttttta

SEQ ID NO: 586242 - DNA, 237 bp, Homo sapiens
atttttccccccttttttgcaaactaggagtttcccgttcattcctttatcaaagaaaagtatttacttcctttttagaataagggtactagctttccccctttgccctttacttgaacgggagttttgattcttttttggcctaatcagagaaggaatttggactccccatcccccccccaggataaaagtcctgccctttgtttttttgagggaataaaagcttgtttttcctta

SEQ ID NO: 586243 - DNA, 760 bp, Homo sapiens
  misc_feature (45)..(45): n is a, c, g, or t
gtcaatttcctataagaatattattctgaagacctggaggaggangtagcagcagcgctgaaaaatgggaatgacttctaatagtttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttctcttaaaaaaaaaaa

SEQ ID NO: 586244 - DNA, 144 bp, Homo sapiens
accacgcgtcgcttttgagaccaaaaaagttatgggtttttttattgttcaaataaagagtgcactgcattacatctgaaatataaaaaaacccataactttttgagaccaaaaaagaaaatagaaacaagaaaaaaaaaagac

SEQ ID NO: 586245 - DNA, 393 bp, Homo sapiens
  misc_feature (207)..(207): n is a, c, g, or t
aggtgttgtattcctgtttggtaacctcagtttcctgtaagacctcctaccacatggggagtatacaccaatcaggagagggtagctgcctgcataggagcctggcttccgattattcccttcccaatattattcatccagatttagccccagggcacaaaagcaaacctgttagagaggcagtgaacaccacagtttctccccagntaggtgccttttacatggggtttgttctccttccatggtgtgttgctgacattgtcactgagtcccatgtgaggggctggtgagtattccctttcatttgtgccatgctttagacccttgcccttgatagttccccccctttgagggatccctgttttaaataaaaacgattccctttaaagccta

SEQ ID NO: 586246 - DNA, 784 bp, Homo sapiens
  misc_feature (12)..(12): n is a, c, g, or t
  misc_feature (29)..(29): n is a, c, g, or t
  misc_feature (31)..(31): n is a, c, g, or t
  misc_feature (47)..(47): n is a, c, g, or t
cgaacgggaatngcaacatgacccagtcntntagagcgatgaagcanagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttctcttaaaaaaaaaaa

SEQ ID NO: 586247 - DNA, 730 bp, Homo sapiens
  misc_feature (12)..(12): n is a, c, g, or t
  misc_feature (29)..(29): n is a, c, g, or t
  misc_feature (31)..(31): n is a, c, g, or t
  misc_feature (47)..(47): n is a, c, g, or t
cgaacgggaatngcaacatgacccagtcntntagagcgatgaagcanagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcagtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttctcttaaaaaaaaaaa

SEQ ID NO: 586248 - DNA, 189 bp, Homo sapiens
aggaacaagaggaagaagaagatgaagaaagtgaagaagaggaggaagaggagggagaaagtgaaggcagtgacaggtgatgaggaagatgaaaaggtgtcagatgacgaaggattcagggacagacattagactaaaaacgccaagtacaagaaatgaggctcacgattctgaactatgacctctgag

SEQ ID NO: 586249 - DNA, 431 bp, Homo sapiens
atatcatattccctattcacagcagcgaaagctgcagttcagatttgagatcagtctccattcacttccacgtggcatcacagatagagtgaccggaggcagagagctcttattgggtcagctttctaataagcagtgtcacgtgatatagaaccctcttgtagtacactgatttagtttgtccgatggtatttaacgagttaccgaagctctgtgctccttttttgtgctgctgcgtcctttttctcctctttctttccttcactctttcccttatcttgatctttctccctttcctctttcctatcctttgttgctctcttcttactcctgcccctctttcttctctgcatcccggttggctatcttgttgttgatgaggttgtgcagggcgaccacggaacggatcagcgaggccaagtacactacca

SEQ ID NO: 586250 - DNA, 1116 bp, Homo sapiens
cctgggtcctgctcttccaagtgcccaaggcatggcatggtggcagatgtgccccacgaccagtgctttggagcacagatgactctgggggcagaggtgggctcatgtttatgtgatgggcagtgagaccacccagccaaattgcttctcaaccactatgcacaacagcctatatgagtcaatgaggtgatggtgctgtatagttgggcagcccttctgggtttcagagaccggttggctctagactggtctcatctccatagccttaatgccaggtggcccaggagtacccatgcacacgccagctgtggggtgtgggcatcttcagagtggtgtactggataaaatcgttagaatagctgtatgaaggaaaccagtgggaggaaatgaagttaacaggatggtgggatgtgatatagacagtgcacatgctgttagaggctgtcactagggagtgagcttcatggagggtggtaacagcagctcaagtccagacaaaatgtatagaaacactcagtctctggtcccagaggatgagttctcagaggaatgacaaagtaaaagtgtcaccttcctgaaagatgaatgagacagctgacacattctcaagactcatctgcctagggcgggtcaagacggcaggatgtaggacacaatgtgtgcactacttgcacacgttcatgaaaacatggaggccagacgcgccatggacacatcaagggacaaaaggcccacgagcagacatggacacagacaggacagcgaccaagacaggaccacaatgactgaggaaccacaacacgcacacagacagacaagtggaccagcaggcaagcccactcacccccgcactgcacaggcaccacggcacgcgaccaccgtcacacccccggaggaacgaggcacacaaaaaacatacctcaccggacaccccacaaagaagagaaaaaaacaacaacacaggagaacatagggagccacgacgtcgcacaggggcgcaagaggagcgccgccaggactacagagagcgccggcgacgagagagagtgcccgggcgatgagagacacaaaagggacggcgcggaacgggacgaccccagggcgccgcagagagct

SEQ ID NO: 586251 - DNA, 218 bp, Homo sapiens
  misc_feature (37)..(37): n is a, c, g, or t
  misc_feature (103)..(103): n is a, c, g, or t
  misc_feature (139)..(139): n is a, c, g, or t
  misc_feature (145)..(145): n is a, c, g, or t
  misc_feature (170)..(170): n is a, c, g, or t
  misc_feature (186)..(186): n is a, c, g, or t
  misc_feature (211)..(211): n is a, c, g, or t
cggcagaggaccatcaagtttgggaaaccgctagatnccgcactgtggctgtcattggtggcatctccagagaagacccaggggctttcaggctgcgatgggnttgtgaagattgtgattgctacccctggggcgtttnatttangtgctggagaaccgctaacctggtnctgagccgctgtaccnatgtggttctggatgaggcagatanggtgatt

SEQ ID NO: 586252 - DNA, 696 bp, Homo sapiens
  misc_feature (426)..(426): n is a, c, g, or t
gcacaagacaattgttccctaagcaaccaactctagctcataactacaatcaaatttcacgtagacaaaacacagagaacagacaacgtcgcgaaaatctaactacactaataaacaaaataacttatacaacggattattaccctagacttttctatatgggccatattcattaaaaaccccaaaacgctaccttagccttaacccttcaataatacaggaactatccttaaacatgcatcactccgctatataaccaaaaattccactccaaaacaacccgagataataggatatatagtaccacaccacctaacacactaaatgcataacaaactctaccctcaccaaataatataaccacacatcaaatcaatggtcctggtatcaaagataacccacataacatccttacacaactactantactccaaaacgctaactctacaaactaacgacacaacattctaaggaggcacaaactgctcaaatacttgacgacattattaacataactatccatactatctacatcattcaccaactaccattacacaatgcaaccaaacaatactttacactttacacccgccaaatcacactccacttccaacagatgtgtaaccacaattaccaccacaaactattcctaaatacggcctaaaccaatcaaccttactaccagacaacctaacc

SEQ ID NO: 586253 - DNA, 156 bp, Homo sapiens
ctgaggatccccactaacaaaggcaagttagctcttctctttttttttctcctgcatttctagtcttcaagcctctactaatgtatgtattctttgttagatccttgtagatttatcactttgatttcagcacttctaactccagtgtggagagag

SEQ ID NO: 586254 - DNA, 682 bp, Homo sapiens
  misc_feature (10)..(10): n is a, c, g, or t
  misc_feature (18)..(18): n is a, c, g, or t
  misc_feature (21)..(21): n is a, c, g, or t
  misc_feature (28)..(28): n is a, c, g, or t
  misc_feature (33)..(33): n is a, c, g, or t
  misc_feature (38)..(38): n is a, c, g, or t
  misc_feature (41)..(41): n is a, c, g, or t
  misc_feature (50)..(50): n is a, c, g, or t
  misc_feature (59)..(59): n is a, c, g, or t
  misc_feature (64)..(64): n is a, c, g, or t
  misc_feature (70)..(71): n is a, c, g, or t
  misc_feature (81)..(81): n is a, c, g, or t
  misc_feature (83)..(83): n is a, c, g, or t
  misc_feature (94)..(95): n is a, c, g, or t
  misc_feature (106)..(106): n is a, c, g, or t
  misc_feature (546)..(546): n is a, c, g, or t
  misc_feature (548)..(548): n is a, c, g, or t
  misc_feature (565)..(565): n is a, c, g, or t
  misc_feature (591)..(591): n is a, c, g, or t
aacgtttgtngtgggagnacnccaaagnactantcgantcncggttgatntacagacgnttagntcctanntgcaagtgantngcacaaccagnngtcttagaggncaacttagacttgttagagacagacttggtagaacgacgaggcttcgaagcaggagtctgctttttagtccctccttaggttgctgcaggcaactcagcactggagtaataccagttcctacctggcctttattgcgccggcatagccccagataaggtaagcctctcggcactctaagctagcttgaaagcagtgcagttggttttgtaagtacgccgaacaggatttttgcaggttgtaggcccatttaacaagttgacaggagtagcagcctaagaagtataggaaccaggcttgccctagagagaagtgtgcaacactgtcatacctccaaagggacgcaaagcagaacgagtatagtgtctgtctgaagcggagggagactactttgctgaggtcttgttggcagcaggtgcaggcttggactccttgacagccntntttgcactgttggcatntagttataatacccattatcagcctnccctcacaattactgaggaggttgtccggacactgtttcagaaagaacttaacggctatttttaaatttcattttgtaggaatagtatcct

SEQ ID NO: 586255 - DNA, 766 bp, Homo sapiens
  misc_feature (10)..(10): n is a, c, g, or t
  misc_feature (18)..(18): n is a, c, g, or t
  misc_feature (21)..(21): n is a, c, g, or t
  misc_feature (28)..(28): n is a, c, g, or t
  misc_feature (33)..(33): n is a, c, g, or t
  misc_feature (38)..(38): n is a, c, g, or t
  misc_feature (41)..(41): n is a, c, g, or t
  misc_feature (50)..(50): n is a, c, g, or t
  misc_feature (59)..(59): n is a, c, g, or t
  misc_feature (64)..(64): n is a, c, g, or t
  misc_feature (70)..(71): n is a, c, g, or t
  misc_feature (81)..(81): n is a, c, g, or t
  misc_feature (83)..(83): n is a, c, g, or t
  misc_feature (94)..(95): n is a, c, g, or t
  misc_feature (106)..(106): n is a, c, g, or t
aacgtttgtngtgggagnacnccaaagnactantcgantcncggttgatntacagacgnttagntcctanntgcaagtgantngcacaaccagnngtcttagaggncaacttagacttgttagagacagacttggtagaacgacgaggcttcgaagcaggagtctgctttttagtccctccttaggttgctgcaggcaactcagcactggagtaataccagttcctacctggcctttattgcgccggcatagccccagataaggtaagcctctcggcactctaagctagcttgaaagcagtgcagttggttttgtaagtacgccgaacaggatttttgcaggttgtaggcccatttaacaagttgacaggagtagcagcctaagaagtataggaaccaggcttgccctagagagaagtgtgcgacctagagcatatctccgccgcgtgaggtatctgcatcgtctttgtaatcgataacgtgcacggtccgcatgcttgtggtggggctgtttcgttctaggttgcatgactttgtgcaccctgtccggcctcgtagtgctcctgggagaagctaatattatagagacagagctaactgtagaaacagtggtaaaggatgacgagctgatataaatatcagaggatcggagcggtctagctggtgaatgatcagcttgtgatgcagctgattcagtgcctaagacagagaagtagagaatgcgttctcagaggagtctagacacgagatctaggggtaccacagta

SEQ ID NO: 586256 - DNA, 256 bp, Homo sapiens
  misc_feature (16)..(17): n is a, c, g, or t
  misc_feature (79)..(79): n is a, c, g, or t
  misc_feature (201)..(201): n is a, c, g, or t
aatgagtctaagcagnncgcagaagacgcgattttggtgattggctcgggcgcttttcggatgggggatgcggcatctngtggttatgcgacgacaattacgctgtcagagttacgccggttgcagtatccaaccattattatgaataataatcctagtgacgcgacgttgttaccacatttagcagataagcagtatttngaaccattggaaatttctgatgtgatgcaggttgttgaattagaacagccaaagc

SEQ ID NO: 586257 - DNA, 228 bp, Homo sapiens
atggtaaaaagatattcccaaaaattagtcctcaaaggcctccaagaaaggacatggagtgagctgtatttaaaatatagagctcatcctccaattctatatgtaaagagcgtttttctttgaaaacatgtatatggataataataactccttctttctaaaatgtttgaaatatcagacatagaaatcagagcatctattaaaacaactttgcctttacaaaaaaaa
